United States Patent 8,586,006 (ORGAN-SPECIFIC PROTEINS AND METHODS OF THEIR USE) - sequence listing, part 18

SEQ ID NO: 53192 - DNA, 3197 bp, Homo sapiens
cgcggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacaggggctggagggctgggcagggccctgtggctccaggagcagcgtgcaggagcaaggctgccctgtccactctgctcagggccgcggccgacatcagcccggtgtgaggaggggcgggagtgatgacggggtgttgccagcgtggcaacaggcggggggttgtctcagccgagcccaggggaggcacaaagggcaggcctgttccctgaggacctgcgcaaagggcgggcctgtttggtgaggacctgcggccttgggtc

SEQ ID NO: 53193 - DNA, 3300 bp, Homo sapiens
cgcggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagtaaaggcagcccgtgcagagggcccctgtgtggatgctgccccggacgctctagccagaaggtcagtttgaaagatcgtgtcttctccagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacaggggctggagggctgggcagggccctgtggctccaggagcagcgtgcaggagcaaggctgccctgtccactctgctcagggccgcggccgacatcagcccggtgtgaggaggggcgggagtgatgacggggtgttgccagcgtggcaacaggcggggggttgtctcagccgagcccaggggaggcacaaagggcaggcctgttccctgaggacctgcgcaaagggcgggcctgtttggtgaggacctgcggccttgggtcgacctgcgcaaagggcgggcctgtttggtgaggacctgcggccttgggt

SEQ ID NO: 53194 - DNA, 2912 bp, Homo sapiens
cgcggagcgaggtggccgcagcgtctccgcgcgcggcccaagcccggcaggagtgcggaaccgccgcctcggccatgcggctcccggccggggggcctgggctggggcccgcgccgccccccgcgctccgcccccgctgagcctgagcccgacccggggcgcctcccgccaggcaccatggtgcagaagtcgcgcaacggcggcgtataccccggcccgagcggggagaagaagctgaaggtgggcttcgtggggctggaccccggcgcgcccgactccacccgggacggggcgctgctgatcgccggctccgaggcccccaagcgcggcagcatcctcagcaaacctcgcgcgggcggcgcgggcgccgggaagccccccaagcgcaacgccttctaccgcaagctgcagaatttcctctacaacgtgctggagcggccgcgcggctgggcgttcatctaccacgcctacgtgttcctcctggttttctcctgcctcgtgctgtctgtgttttccaccatcaaggagtatgagaagagctcggagggggccctctacatcctggaaatcgtgactatcgtggtgtttggcgtggagtacttcgtgcggatctgggccgcaggctgctgctgccggtaccgtggctggagggggcggctcaagtttgcccggaaaccgttctgtgtgattgacatcatggtgctcatcgcctccattgcggtgctggccgccggctcccagggcaacgtctttgccacatctgcgctccggagcctgcgcttcctgcagattctgcggatgatccgcatggaccggcggggaggcacctggaagctgctgggctctgtggtctatgcccacagcaaggagctggtcactgcctggtacatcggcttcctttgtctcatcctggcctcgttcctggtgtacttggcagagaagggggagaacgaccactttgacacctacgcggatgcactctggtggggcctgatcacgctgaccaccattggctacggggacaagtacccccagacctggaacggcaggctccttgcggcaaccttcaccctcatcggtgtctccttcttcgcgctgcctgcaggcatcttggggtctgggtttgccctgaaggttcaggagcagcacaggcagaagcactttgagaagaggcggaacccggcagcaggcctgatccagtcggcctggagattctacgccaccaacctctcgcgcacagacctgcactccacgtggcagtactacgagcgaacggtcaccgtgcccatgtacagttcgcaaactcaaacctacggggcctccagacttatccccccgctgaaccagctggagctgctgaggaacctcaagagtaaatctggactcgctttcaggaaggaccccccgccggagccgtctccaagcccccgaggcgtggctgccaaggggaaggggtccccgcaggcccagactgtgaggcggtcacccagcgccgaccagagcctcgaggacagccccagcaaggtgcccaagagctggagcttcggggaccgcagccgggcacgccaggctttccgcatcaagggtgccgcgtcacggcagaactcagaagcaagcctccccggagaggacattgtggatgacaagagctgcccctgcgagtttgtgaccgaggacctgaccccgggcctcaaagtcagcatcagagccgtgtgtgtcatgcggttcctggtgtccaagcggaagttcaaggagagcctgcggccctacgacgtgatggacgtcatcgagcagtactcagccggccacctggacatgctgtcccgaattaagagcctgcagtccagagtggaccagatcgtggggcggggcccagcgatcacggacaaggaccgcaccaagggcccggccgaggcggagctgcccgaggaccccagcatgatgggacggctcgggaaggtggagaagcaggtcttgtccatggagaagaagctggacttcctggtgaatatctacatgcagcggatgggcatccccccgacagagaccgaggcctactttggggccaaagagccggagccggcgccgccgtaccacagcccggaagacagccgggagcatgtcgacaggcacggctgcattgtcaagatcgtgcgctccagcagctccacgggccagaagaacttctcggcgcccccggccgcgccccctgtccagtgtccgccctccacctcctggcagccacagagccacccgcgccagggccacggcacctcccccgtgggggaccacggctccctggtgcgcatcccgccgccgcctgcccacgagcggtcgctgtccgcctacggcgggggcaaccgcgccagcatggagttcctgcggcaggaggacaccccgggctgcaggccccccgaggggaacctgcgggacagcgacacgtccatctccatcccgtccgtggaccacgaggagctggagcgttccttcagcggcttcagcatctcccagtccaaggagaacctggatgctctcaacagctgctacgcggccgtggcgccttgtgccaaagtcaggccctacattgcggagggagagtcagacaccgactccgacctctgtaccccgtgcgggcccccgccacgctcggccaccggcgagggtccctttggtgacgtgggctgggccgggcccaggaagtgaggcggcgctgggccagtggacccgcccgcggccctcctcagcacggtgcctccgaggttttgaggcgggaaccctctggggcccttttcttacagtaactgagtgtggcgggaagggtgggccctggaggggcccatgtgggctgaaggatgggggctcctggcagtgaccttttacaaaagttattttccaacaggggctggagggct

SEQ ID NO: 53195 - DNA, 1878 bp, Homo sapiens
gcaaaaccgagctgacagcgcaggcgatgctgccagcgtttccattccatcaccaggctggggctgaataaaggcgtgcttgtgtggtagtgtctctttttaaaaaatctcaaagccaagaagaacaagctgaaatagcatcttcaaaaaatggagcgtaaaataaacagaagagaaaaagaaaaggagtatgaagggaaacacaacagcctggaagatactgatcaaggaaagaactgcaaatccacactgatgaccctcaacgttggtggatatttatacattactcaaaaacaaacactgaccaagtacccagacactttccttgaaggtatagtaaatggaaaaatcctctgcccgtttgatgctgatggtcattatttcatagacagggatggtctcctcttcaggcatgtcctaaacttcctacgaaatggagaacttctattgcccgaagggtttcgagaaaatcaacttcttgcacaagaagcagaattctttcagctcaagggactggcagaggaagtgaaatccaggtgggagaaagaacagctaacacccagagagactactttcttggaaataacagataaccacgatcgttcacaaggattaagaatcttctgtaatgctcctgatttcatatcaaaaataaagtctcgcattgttctggtgtccaaaagcaggctggatggatttccagaggagttttcaatatcgtcaaatatcatccgatttaaatacttcataaagtctgaaaatggcactcgacttgtactaaaggaagacaacacctttgtctgtaccttggaaactcttaagtttgaggctatcatgatggctttaaagtgtggctttagactgctgaccagcctggattgttccaaagggtcaattgttcacagcgatgcacttcattttatcaagtaattacctgtgtcacgaacaaaggcaacaagcatgcagccagcaagcttcggaaaaccacagcatcaaagacatcccaaataacatgcccagctagctctgtactacagagccctgctactaatcaattactgtgagctaacggtatgtaaattctatcgctaaagatgtccttcctctggggtgttcctactgatcagactcttccacctaaaatgaaaacagtaaccttctatatactgtaaataaagactgaaagcttttgctatttatttgtccttaagctgtctttcaattcagattgtcttgggtatttgcacaaaaagaaagcatgtacattatctatcgttcatttaagtaaatggtaataaaatattttaaggggctattaatatttaaaatccttttctactatggcaaaaatctacagagaaactgaactggcaaaattaactacctggagcaaaacagatgtgcagatctaactaaaacagagctatagtgaaacaaaatgagattgtaagaagacattaaagctattgatttgatttttccatagcaagcaccaaaagcttatattcacagttcctgtgtttcatattagacttatagctgaattggtattttgctgaaaattcctagaaaactgcttgatgacaataaaaagtaaataaaagcactgctaccttctttgattgtattaatgattataataaaaagttacaggtcactttaaaagcaaacagtaccacttgatgattttgcataaaattatgcattgatgtcaaccggcaggctacaggaaccctggctggtcctggaagtgacaaaaaccagcaaattcaattctttgcaggctgagttcccacaaagcatgggtaacttagtctcaatagagtatctgttattagaataataaaggagttcattttcagaaaaaaaaaaaaaaaa

SEQ ID NO: 53196 - DNA, 6801 bp, Homo sapiens
gctgccgcgggcggtgggcggggatcccccgggggtgcaaccttgctccacctgtgctgccctcggcgggcctggctggccccgcgcagagcggcggcggcgctcgctgtcactgccggaggtgagagcgcagcagtagcttcagcctgtcttgggcttggtccagattcgctcctctggggctacgtcccggggaagaggaagcgaggattttgctggggtggggctgtacctcttaacagcaggtgcgcgcgcgagggtgtgaacgtgtgtgtgtgtgtgtgtgtgtgtgtgtgtgtgtgtgtgtgtgtaagacctgcgatgacgacgaggaggaacaagtgggacggcgagtgatgctcagggccagcagcaacgcatggggcgagcttcagtgtcgccagcagtgaccacagttcttgaggccaaatctggctcctaaaaaacatcaaaggaagcttgcaccaaactctcttcagggccgcctcagaagcctgccatcacccactgtgtggtgcacaatggcgccccccacaggtgtgctctcttcattgctgctgctggtgacaattgcaggttgtgcccgtaagcagtgcagcgaggggaggacatattccaatgcagtcatttcacctaacttggaaaccaccagaatcatgcgggtgtctcacaccttccctgtcgtagactgcacggccgcttgctgtgacctgtccagctgtgacctggcctggtggttcgagggccgctgctacctggtgagctgcccccacaaagagaactgtgagcccaagaagatgggccccatcaggtcttatctcacttttgtgctccggcctgttcagaggcctgcacagctgctggactatggggacatgatgctgaacaggggctccccctcggggatctggggggactcacctgaggatatcagaaaggacttgccctttctaggcaaagattggggcctagaggagatgtctgagtacgcagatgactaccgggagctggagaaggacctcttgcaacccagtggcaagcaggagcccagagggagtgccgagtacacggactggggcctactgccgggcagcgagggggccttcaactcctctgttggagacagtcctgcggtgccagcggagacgcagcaggaccctgagctccattacctgaatgagtcggcttcaacccctgccccaaaactccctgagagaagtgtgttgcttcccttgccgactactccatcttcaggagaggtgttggagaaagaaaaggcttctcagctccaggaacaatccagcaacagctctggaaaagaggttctaatgccttcccatagtcttcctccggcaagcctggagctcagctcagtcaccgtggagaaaagcccagtgctcacagtcaccccggggagtacagagcacagcatcccaacacctcccactagcgcagccccctctgagtccaccccatctgagctacccatatctcctaccactgctcccaggacagtgaaagaacttacggtatcggctggagataacctaattataactttacccgacaatgaagttgaactgaaggcctttgttgcgccagcgccacctgtagaaacaacctacaactatgaatggaatttaataagccaccccacagactaccaaggtgaaataaaacaaggacacaagcaaactcttaacctctctcaattgtccgtcggactttatgtcttcaaagtcactgtttctagtgaaaacgcctttggagaaggatttgtcaatgtcactgttaagcctgccagaagagtcaacctgccacctgtagcagttgtttctccccaactgcaagagctcactttgcctttgacgtcagccctcattgatggcagccaaagtacagatgatactgaaatagtgagttatcattgggaagaaataaacgggcccttcatagaagagaagacttcagttgactctcccgtcttacgcttgtctaaccttgatcctggtaactatagtttcaggttgactgttacagactcggacggagccactaactctacaactgcagccctaatagtgaacaatgctgtggactacccaccagttgctaatgcaggaccaaatcacaccataactttgccccaaaactccatcactttgaatggaaaccagagcagtgacgatcaccagattgtcctctatgagtggtccctgggtcctgggagtgagggcaaacatgtggtcatgcagggagtacagacgccataccttcatttatctgcaatgcaggaaggagattatacatttcagctgaaggtgacagattcttcaaggcaacagtctactgctgtggtgactgtgattgtccagcctgaaaacaatagacctccagtggctgtggccggccctgataaagagctgatcttcccagtggaaagtgctaccctggatgggagcagcagcagcgatgaccacggcattgtcttctaccactgggagcacgtcagaggccccagtgcagtggagatggaaaatattgacaaagcaatagccactgtgactggtctccaggtggggacctaccacttccgtttgacagtgaaagaccagcagggactgagcagcacgtccaccctcactgtggctgtgaagaaggaaaataatagtcctcccagagcccgggctggtggcagacatgttcttgtgcttcccaataattccattactttggatggttcaaggtctactgatgaccaaagaattgtgtcctatctgtggatccgggatggccagagtccagcagctggagatgtcatcgatggctctgaccacagtgtggctctgcagcttacgaatctggtggagggggtgtacactttccacttgcgagtcaccgacagtcagggggcctcggacacagacactgccactgtggaagtgcagccagaccctaggaagagtggcctggtggagctgaccctgcaggttggtgttgggcagctgacagagcagcggaaggacacccttgtgaggcagctggctgtgctgctgaacgtgctggactcggacattaaggtccagaagattcgggcccactcggatctcagcaccgtgattgtgttttatgtacagagcaggccgcctttcaaggttctcaaagctgctgaagtggcccgaaatctgcacatgcggctctcaaaggagaaggctgacttcttgcttttcaaggtcttgagggttgatacagcaggttgccttctgaagtgttctggccatggtcactgcgaccccctcacaaagcgctgcatttgctctcacttatggatggagaaccttatacagcgttatatctgggatggagagagcaactgtgagtggagtatattctatgtgacagtgttggcttttactcttattgtgctaacaggaggtttcacttggctttgcatctgctgctgcaaaagacaaaaaaggactaaaatcaggaaaaaaacaaagtacaccatcctggataacatggatgaacaggaaagaatggaactgaggcccaaatatggtatcaagcaccgaagcacagagcacaactccagcctgatggtatccgagtctgagtttgacagtgaccaggacacaatcttcagccgagaaaagatggagagagggaatccaaaggtttccatgaatggttccatcagaaatggagcttccttcagttattgctcaaaggacagataatggcgcagttcattgtaaagtggaaggaccccttgaatccaagaccagtcagtgggagttacagcacaaaacccactcttttagaatagttcattgaccttcttccccagtgggttagatgtgtatccccacgtactaaaagaccggtttttgaaggcacaaaacaaaaactttgctcttttaactgagatgcttgttaatagaaataaaggctgggtaaaactctaaggtatatacttaaaagagttttgagtttttgtagctggcacaatctcatattaaagatgaacaacgatttctatctgtagaaccttagagaaggtgaatgaaacaaggttttaaaaagggatgatttctgtcttagctgctgtgattgcctctaaggaacagcattctaaacacggtttctcttgtaggacctgcagtcagatggctgtgtatgttaaaatagcttgtctaagaggcacgggccatctgtggaggtacggagtcttgcatgtagcaagctttctgtgctgacggcaacactcgcacagtgccaagccctcctggtttttaattctgtgctatgtcaatggcagttttcatctctctcaagaaagcagctgttggccattcaagagctaaggaagaatcgtattctaaggactgaggcaatagaaaggggaggaggagcttaatgccgtgcaggttgaaggtagcattgtaacattatcttttctttctctaagaaaaactacactgactcctctcggtgttgtttagcagtatagttctctaatgtaaacggatccccagtttacattaaatgcaatagaagtgattaattcattaagcatttattatgttctgtaggctgtgcgtttggactgccatagatagggataacgactcagcaattgtgtatatattccaaaactctgaaatacagtcagtcttaacttggatggcgtggttatgatactctggtccccgacaggtactttccaaaataacttgacatagatgtattcacttcatatgtttaaaaatacatttaagtttttctaccgaataaatcttatttcaaacatgaaagacaattaaaacattcccacccacaaagcagtactcccgagcaattaactggagttaattgtagcctgctacgttgactggttcagggtagttccccatccacccttggtcctgaggctggtggccttggtggtgcccttggcattttttgtgggaagattagaatgagagatagaaccagtgttgtggtaccaagtgtgagcacacctaaacaatatcctgttgcacaatgcttttttaacacatgggaaaactaggaatgcattgctgatgaagaagcaaggtatttaaacaccagggcaggagtgccagagaaaatgtttccccatgggttcttaaaaaaaattcagcttttaggtgcttttgtcatctcccgcagtattcatcctcatgggaccatcttatttttacttattgtaatttactggggaaaggcagaactaaaaagtgtgtcattttatttttaaaataattgctttgcttatgcctacactttctgtataactagccaattcaatactgtctatagtgttagaaggaaaatgtgatttttttttttaaccagtattgagcttcataagcctagaatctgccttatcaggtgaccagggttatggttgtttgcatgcaaatgtgaatttctggcataggggacagcagcccaaatgtaaagtcatcgggcgtaatgaggaagaagggagtgaacatttaccgctttatgtacataacatatgcagtttacatactcatttgatccttataatcaaccttgaagaggagatactatcattcttatgttgcagatagccctctgaaggcccagagaggttaaataacttcccagaggtcatggccaagaagtagtggctccaagaactgaatgcaaattttttaaactgtagagttctgctttccactaaacaaagaactcctgccttgatggatggagggcaaattctggtggaacttttgggccacctgaaagttctattcccaggactaagaggaatttcttttaatggatccagagagccaaggtcagagggagagatggcctgcatagtctcctgtggatcacacccgggccacccctccctctaggtttacagtggacttcttctgcccctcctccttttctgtccttggccatctcagcctggcctctctgatccttccatcacagaaggatcttgaatctctgggaaatcaaacatcacagtagtgatcagaaagtgagtcctgtcttgtcaccccatttctcatcagaacaaagcacgagatggaatgaccaaccagcattcttcatggtggactgcttatcattgaggatctttgggagataaagcacgctaagagctctggacagagaaaaacaggccctagaatatgggagtgggtgtttgtagggctcacaggctaacaagcactttagttgctggtttacattcaatgaaggaggattcatacccatggcattacaaggctaagcatgtgtatgactaaggaactatctgaaaaacatgcagcaaggtaagaaaatgtaccactcaacaagccagtgatgccaccttttgtgcgcggggaggagagtgactaccattgttttttgtgtgacaaagctatcatggactattttaatcttggttttattgcttaaaatatattatttttccctatgtgttgacaaggtatttctaatatcacactattaaatatatgcactaatctaaataaaggtgtctgtattttctgtaatgcttatttttagggggaaatttgttttctttatgcttcagggtagagggatttcccttgagtataggtcagcaaactgtggcctacagcctgtgtgtgcacgccccatgagccgaaaagtgggtcttatgttttcaaatggttaaaaataaataaaaaaatttgaaacatgtgaactatatgacattcagatttgtgttcataaataaagttttattggaacatatcc

SEQ ID NO: 53197 - DNA, 5027 bp, Homo sapiens
atggtgttcatcgggtgtcccatagtcatggtgttcatcaagttccacagtcacagcattcatcaagtgtcatggtcacggtgttcattgggtgtcacggtcacggtgttcatcgagtgtcacggtcatggtgttcatcgagtgtcacggtcacggtgttcattgagtgtcatggtcatggtgtttgagtgtcccatagtcatggtgttcatcaagttccacagtcatggtgttcatcaagttccacagtcacggtgttcatcgagtgtcacagtcatggtgttcatcgagtgtcatggtcatggtgttcatcgggtgtctgtgtcatgcgcccagcctccgacccttcccctgcccactgtgggggccagctatactgcacaacccactcctgggatggaccctgccgtgaacccggcctttcccccagctgccccggcagggtacggtggataccagccccactccggccaggacttcgcctacggcagccgaccccaggagcccgtccccacggccaccaccatggctacctaccaggacagttacagctacggacagtcagcagctgccaggagctatgaggacaggccgtacttccagtctgctgccctccagtctgggcgcatgacagccgcagactccggccagccagggacccaagaagcctgcgggcagcccagcccccatggcagtcacagccacgctcagcccccacagcaggcgcccatagtggagtccggacagccagcgagcaccttgtcctcgggatacacctaccccacggcgacaggcgtccagcccgagtcgtcagcttccatcgtgacctcctaccccccgccctcctacaaccccacctgcaccgcctacacggcaccaagctacccgaactatgacgcgtcggtgtactccgctgccagccctttctatcctccagcgcagcccccgcctcccccgggacccccgcagcagctgcccccgccgcccgcgcctgcaggctcaggaagcagccccagggccgactcgaagccaccgcttcccagcaagctgccgagacccaaggcggggcccaggcagctccagcttcactactgcgacatctgcaagatcagctgcgctggcccccagacctaccgggaacatctgggagggcagaagcacagaaagaaggaggcggcccagaagacaggcgtgcagcccaacgggagcccgcgcggggtgcaggcgcagctgcattgcgacctgtgcgccgtgtcctgcaccggggcggacgcctacgcggcccacatccggggatccaagcaccagaaggtcttcaagctgcacgccaaactggggaagcccattcccaccctcgagcctgcactggccacagagagcccccccggggcagaggccaagcccacgtcccccactggccccagcgtgtgtgcctcgagcaggccagcgctggccaagagacccgtggcctcgaaggccttatgcgaggggcctcctgagccacaggcagcaggctgcagaccccagtgggggaaaccagcccaacctaaattagagggtcccggagcacctacccaaggaggctcaaaggaagctcccgcgggctgctctgatgcgcagccggtgggcccggaatatgtggaggaggtgttcagcgacgaagggcgagtgcttcgcttccactgcaagctgtgcgagtgcagtttcaacgaccttaacgcgaaggacctgcacgtgagggggcggcggcaccggctgcagtaccggaagaaagtgaacccggaccttcccattgccacggagcccagcagccgggctcggaaggtcctggaggagcgcatgaggaagcagcggcacctggcggaggagcggctggagcagctgcggcgctggcacgcggagaggaggcggctggaggaggagccaccccaggacgtgccgccccacgcgccgcccgactgggcccagcctctgctcatgggcaggccggagtcacccgccagcgccccactccagcccgggcggcggccggcgtccagcgacgaccggcacgtcatgtgcaagcacgccaccatctaccccacggagcaggagctcctggccgtgcagagggccgtgtcccacgcagagcgggccctcaagctggtgtccgacacactggccgaggaggaccggggccgccgagaggaagagggtgacaagcgcagcagcgttgccccccagactcgggtcctgaaaggcgtcatgcgagtaggcatcctggcgaaaggcctcctcctgcgtggggacaggaacgtgcgcctcgctctgctctgctccgagaagcccacgcacagcctgctgcggaggatcgcccagcagctgccccggcagctccagatggtgaccgaggatgagtatgaggtctcctccgaccctgaagccaacattgtcatctcctcctgtgaggagcccaggatgcaggtcaccatatctgtcacctcacctctgatgcgggaggacccctccacagacccaggtgtggaggagcctcaggctgatgcaggtgatgtcctgagccccaagaagtgcctcgagtccctggccgccctccgtcatgccaggtggtttcaggctcgagccagcggcctgcagccatgcgtgatcgtcatcagggtcctgagggacctctgccggcgtgtgcccacctggggggccctgccagcctgggccatggagctgctggtggagaaggctgtgagcagtgcggctgggcccctgggccccggggatgcagtcaggcgagtcctggagtgcgtggccacagggacgctcctgacagacgggcccgggctccaggatccctgcgagagagaccagacagatgccctcgagcccatgaccctccaagagcgggaagacgtgaccgccagcgcccagcacgccctgcgaatgctggccttccggcagacccacaaggtcctgggcatggatctcctgccgcccagacaccggctgggggcccgcttccggaagaggcaacggggacctggcgagggagaggagggcgcaggggagaagaagcggggccggcggggcggagaggggctcgtgtgagccgcctacctcccccacctgcgggcctttgcatccctgcactcctggacgtgtgcgcgccgaccaatggctgcttcatccccgacgttggacaatggtcatttccttttgagtaacgctctgtaggtttcctttaaaacacctgtgcttcagaccgggcactgtggctcatgcctttaatcccagcactttgggaggctgagttgcttgagcctgagagttcaaggccagcccagacaacagagtgagacccccatctctccaaaatatttttaaaaatcagcttggcatggttggtggccaggcgcggtgattcacgcctgtaatcccagcactttgagaggccgaggtgggcagatcgcctgaggtcaggagttcgagaccggcctggtcaacatggtgaaaccctgtctctagtaaaaaacacaacaattagcctggcgtggtggtgtgcacctgtagtcccagctacttgggaggctgagtccggagccttgaggccaggagggcagtgagctgtgattgcaccgtgacactccagcctgggcaacagaagaagactttgtcacttaaaagaaatgttttttaacatttgtgcttaaattgttacagaaatgacaccatccagccctgggagtggcaccccttcctcgagggccccatcccccacagccaggggggccagcagtacagcaagcagattctaaactcgggggcatcttgctggctctaaactcacctcgtggtacaggaaggggttttaaaatacttcctctgggctgcgcatggtggctcacacctataatcccagcactttgggaggccaagcttggtggatcgcttgagcccagcggtttaagatcagtctgggcaatatggtgacaccccatctctacaaaaaattagccagttgtggtggcccaagcctgtagtcccagctactcgggaggctgaggccgtaggatcccttgagcccaggagttcgaggctgcagcgagccgagattgcgctactgaactccagcctgggttacagagcgagaccctgtctcaaagaaacaaacaaacaaacaaacaaacaaacaaaactttctttggatgcggctgcggcatggatttgaaatcacgtgggcaggccctgttctggggccccaccacatgtgcaggacaagcccaggggagctcccagccggcatccccacgcccccagcccagcctgctccaaacagaccccccacccacctccacagccaggatgtcagcagggcctgagccaggctcgtcccctgtggggagagccacagggccaggtggacacgccgacgggcgatgaggatcctggctgggcctcccccgggaacagctgtgctggacagtcagacccggagcccagaggcacccccacccaccccccgccccgagccctgtaccactgagtgcctttcacagagaaaacccactctgccatgtgtcactgaggcctggatttgagcttccgtccttccttcctccctctctccctgatgtaggccttggctggccctgaggcagggggtccccaatccccccttgtggtagcagggcccgggacccgtgcctgggggacccggggaggggccgccgtcttgtggatgctggccatggtgggcaggcgcctcctggcactgatggatgtgggggcacccccttctgagtccccaccccaacctgttcaaaccttccgcttggtcagtttttttttctttggccagctgcccagtggcattgaatgagaaaagtccacctttgggcagatgtgatctccagccagtggctcagttttgtttctctgtgtttgaaggacagcctgcatgtggctctgtctgaatgtctttgtagagctacctggaaattgggaggcagggggaataaaggaaatcatttgtcttttgt

SEQ ID NO: 53198 - DNA, 5027 bp, Homo sapiens; identical to SEQ ID NO: 53197

SEQ ID NO: 53199 - DNA, 3722 bp, Homo sapiens
cagggatggcgcttagcttcatctgtgctgcaaactctcatcagtaggcttgctggctctgtgaccttactagctgaactccttaatctctctgcacttcatttttctagtctataaaatggagataacaacagcacctacctcagaagactgttatgaagactctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcaccaggcagctgaaattgaatggctgggatttcgaaaacctagccaagctgacatgttacattctaaacatgatgaggagcagaaggtttgggatgaagaaattgatgatgatgatgatgataattgcaataatgatgaagatgaagttcgagtgatagaatttaagaaaaaacatgaagaggtttctcaatttaaagaggaaggtgatgcaagtgaggactccccactgagcagtgccagttcccaagctgtgacacctgatgagcagccaaccttagggaagaagagtgatatctccagaaatgcttattccagatacaatacaatatcctatcggaaaatcagaaagggaaataccaagcaaagaattgatgaattcgagtctatgatgcatttataaactaactggaactgagaaattctcatgcccactaaaggaaaagctaattctattgccccagggtgcatatttctatgccttatttgagttatcacttggagggaggtggaagttgactctctttttcactgtagaataatgtggaaataaccctagataaaaattcagtctgataacctcaaatcaaaaagctttaaataaattcttgggcatttatcttttaaaacttcactaatatagcattgtgtgataagcactaagcagtcagtcccctgggggaatctggcataattcggctataaatgtagcaatgcttggaaaggtagtcatcaaatgagactatttgaggggactatttgaaatgattctggtatttcttttggtatctttcttcctgtacattggagtgatggaaagtctggtattaaaacctctcttacttttaaacttgattttgcagactctggcaataagccttccaaaattctgtgccttttctattatcaccaaacaatatgttaagtggctttccttggcatctacagagaaaacattctatagccctccttcctaggtgttaccattcactgaatcttctctcagagggagatgagcaattgtcagtcaggataattctgtttgctaaatgttgcctttatgctttcaaactgaattaaacccattgtgaggttgacactgggaggggctagaagattggtgggcagcagactaaagagttatgttggatagttttatttctgtggctgaaaataaaatcttgtctagcacagttaaagtcattaaaaataaaaatgacagctttagcacaattttaagaaaatgcccctctctattaccacattttctcttattaacagtatctcagaataattttctttccttagaaacctgagagaatgctagtcataactgtactagttactatgaaaatggaaataattatcttagaatattttcaaagtagagcgtgagcatgtatttttagtgggagagctctgatagttgttgggaatatataatttactggacctcagcccaaatcaagatgcttaaaattgtacttgtggagcttcactcaaaccaatgtgtcaaataacgtattgaatatttatgaaaagagagactatatttatattcttagatagtttgttccacaatttttcatttcatgcttccatatatattaccctgaactttctatcaccacagataaagattttgttttgccctgcaaataaaaagacaattccttattgtctgaatgtaatacagtcttcattgtactattcaaccctttgtttctttctttttcattttgtgaaaaactccatgttagtcctcttagatgactgcttatttatgtgtaacataaatcccacatattctaatgacaacttctttaatccttccgggtcatatattatatttccatagtatcacatactattatttagttgtttacaagactccaatttgaattcaggattacagtgctcctttcattctttcaaacagataacataaaagttctgttaccctcattctatacaacctatggatttcatgtgttacaatatcagtttccagaataaagtgagggaaatcaggtctttattgataaagttagggagaagattgatgcaataggacaatttccaatttaatttagatcctctaatctttctacatggacaagctgttttcttttctaggttactgataacccctacaattttcgacttaacttcaaaacacagtattgtgttatctatcacataacaggaccatgtttttaacctaccatcaagagcctgtattttgagttattccaacagagatgatggattcctgtagaactagaggtgggtgacctatggttatgtggcacggcaaagcaagtacctcttaagggactctaatatatgctaacgctggtcctcttagctctgtgctctcaccagacaatgaatgaactatgaaagatttagtcaacagaaactattttagggtatgtttagttggtaaatgcttcatgttcatggatgacacaatgtttttgcaaaaaaaccctgaaactattctttggcattggtgtccatggccctataccgccatcttacacgaaagccacagagttgaaagccacagagttgaaagccacagagttaagtgacctcaggtaacataatggtgatggttggccatttgagtctttgtaacctaggaaagacaaaggtctgattcagattgcatgggggatttttaacatatttgaaactcagggggaacatgattaagaacacaaactggtagctacacatgaaggtttacttgagcttttgtgattcaaagttcaggggtggtaaggactctggtaccagggaagagggagaattaatttattgtgcaaatgctggtatttcttacatgattttttgttttcctctgttgctagataaatagaaactaataatagctctatttctctgccaatataaaatctacctttcatataatgctacattgaaggcacagaatttgctaccatctctctctccccctacctaccaaactatccacaatttaaataaagaactgctgtgtctgacttactctcaataaaagtgtgtgtctttaaaaaaaaaaaaaaaa

SEQ ID NO: 53200 - DNA, 3790 bp, Homo sapiens
agcaacaaagaaggtggtgattggctggattcttgctcatggctcctggcagatctgacaaatcctcttgcttttgctctaatctctgtctggatacttttaggaaaagaaccttgttattatgtactaaagtgaataatttgtgctcttagagtaggagttggaactataggacttgaaggcaagagcaggtatcttatcaaggatctactcactcagtttccctaaagctctctctccagatcggattcaaccgcacatcatgacagatgttccggctacatttacccaggctgagtgtaatggggataaaccacctgaaaacggtcaacaaacaatcactaaaatcagtgaggaattgactgatgtggacagccccctgccacactacagggtagaacccagtctggaaggtgcactcaccaaaggaagtcaggaggaaagaagaaaattacaagggaacatgctgctcaactcatccatggaggacaaaatgctaaaagaaaacccagaagagaaactctttattgttcataaggctatcacagatctttctctccaagaaactagtgctgatgaaatgacattcagagaagggcatcagtgggagaagattcctctgagtggcagtaaccaggaaataagaagacagaaggagaggattactgagcagcctctcaaagaggaagaagatgaggacaggaagaacaaaggtcaccaggcagctgaaattgaatggctgggatttcgaaaacctagccaagctgacatgttacattctaaacatgatgaggagcagaaggtttgggatgaagaaattgatgatgatgatgatgataattgcaataatgatgaagatgaagttcgagtgatagaatttaagaaaaaacatgaagaggtttctcaatttaaagaggaaggtgatgcaagtgaggactccccactgagcagtgccagttcccaagctgtgacacctgatgagcagccaaccttagggaagaagagtgatatctccagaaatgcttattccagatacaatacaatatcctatcggaaaatcagaaagggaaataccaagcaaagaattgatgaattcgagtctatgatgcatttataaactaactggaactgagaaattctcatgcccactaaaggaaaagctaattctattgccccagggtgcatatttctatgccttatttgagttatcacttggagggaggtggaagttgactctctttttcactgtagaataatgtggaaataaccctagataaaaattcagtctgataacctcaaatcaaaaagctttaaataaattcttgggcatttatcttttaaaacttcactaatatagcattgtgtgataagcactaagcagtcagtcccctgggggaatctggcataattcggctataaatgtagcaatgcttggaaaggtagtcatcaaatgagactatttgaggggactatttgaaatgattctggtatttcttttggtatctttcttcctgtacattggagtgatggaaagtctggtattaaaacctctcttacttttaaacttgattttgcagactctggcaataagccttccaaaattctgtgccttttctattatcaccaaacaatatgttaagtggctttccttggcatctacagagaaaacattctatagccctccttcctaggtgttaccattcactgaatcttctctcagagggagatgagcaattgtcagtcaggataattctgtttgctaaatgttgcctttatgctttcaaactgaattaaacccattgtgaggttgacactgggaggggctagaagattggtgggcagcagactaaagagttatgttggatagttttatttctgtggctgaaaataaaatcttgtctagcacagttaaagtcattaaaaataaaaatgacagctttagcacaattttaagaaaatgcccctctctattaccacattttctcttattaacagtatctcagaataattttctttccttagaaacctgagagaatgctagtcataactgtactagttactatgaaaatggaaataattatcttagaatattttcaaagtagagcgtgagcatgtatttttagtgggagagctctgatagttgttgggaatatataatttactggacctcagcccaaatcaagatgcttaaaattgtacttgtggagcttcactcaaaccaatgtgtcaaataacgtattgaatatttatgaaaagagagactatatttatattcttagatagtttgttccacaatttttcatttcatgcttccatatatattaccctgaactttctatcaccacagataaagattttgttttgccctgcaaataaaaagacaattccttattgtctgaatgtaatacagtcttcattgtactattcaaccctttgtttctttctttttcattttgtgaaaaactccatgttagtcctcttagatgactgcttatttatgtgtaacataaatcccacatattctaatgacaacttctttaatccttccgggtcatatattatatttccatagtatcacatactattatttagttgtttacaagactccaatttgaattcaggattacagtgctcctttcattctttcaaacagataacataaaagttctgttaccctcattctatacaacctatggatttcatgtgttacaatatcagtttccagaataaagtgagggaaatcaggtctttattgataaagttagggagaagattgatgcaataggacaatttccaatttaatttagatcctctaatctttctacatggacaagctgttttcttttctaggttactgataacccctacaattttcgacttaacttcaaaacacagtattgtgttatctatcacataacaggaccatgtttttaacctaccatcaagagcctgtattttgagttattccaacagagatgatggattcctgtagaactagaggtgggtgacctatggttatgtggcacggcaaagcaagtacctcttaagggactctaatatatgctaacgctggtcctcttagctctgtgctctcaccagacaatgaatgaactatgaaagatttagtcaacagaaactattttagggtatgtttagttggtaaatgcttcatgttcatggatgacacaatgtttttgcaaaaaaaccctgaaactattctttggcattggtgtccatggccctataccgccatcttacacgaaagccacagagttgaaagccacagagttgaaagccacagagttaagtgacctcaggtaacataatggtgatggttggccatttgagtctttgtaacctaggaaagacaaaggtctgattcagattgcatgggggatttttaacatatttgaaactcagggggaacatgattaagaacacaaactggtagctacacatgaaggtttacttgagcttttgtgattcaaagttcaggggtggtaaggactctggtaccagggaagagggagaattaatttattgtgcaaatgctggtatttcttacatgattttttgttttcctctgttgctagataaatagaaactaataatagctctatttctctgccaatataaaatctacctttcatataatgctacattgaaggcacagaatttgctaccatctctctctccccctacctaccaaactatccacaatttaaataaagaactgctgtgtctgacttactctcaataaaagtgtgtgtctttaaaaaaaaaaaaaaaa

SEQ ID NO: 53201 - DNA, 3784 bp, Homo sapiens
attcaacaggaggaacccgcgggagaggagccccactcccccagcgccgcagccaccgcagccaccgcagcccgtgcgccccgcgccctcgagcgccatggccaaggaaggcgtggagaaggcggaggagacggagcaaatgatcgagaaggaggcaggcaaggagccggcggagggcggcggcggcgacggctcgcaccgcctcggggacgcccaggagatgcgcgcggtggtgctggctggcttcggggggctcaacaagctgcggctcttcaggaaggccatgcccgagcctcaggacggcgagctcaagatccgcgtcaaagcctgtggattaaacttcattgacttgatggtgcgacaagggaatattgacaaccctcccaagactcccctggtgccaggatttgagtgttctgggattgttgaagctctgggggacagcgtgaaaggatatgagattggagaccgtgtcatggcatttgtcaattacaatgcctgggcagaggtggtctgcacaccagtggagtttgtctacaagatcccggatgacatgagcttctcggaggctgctgcattccccatgaacttcgtcacagcctatgtgatgctgtttgaagttgccaacctccgggaagggatgtctgtgctcgtgcactcagctggtgggggcgtgggtcaagctgtggctcagctgtgttccactgtccccaacgtgactgtctttggaacagcctctactttcaagcatgaagcaatcaaagactctgtgacccacctctttgacagaaatgcagactacgtgcaagaagttaaaagaatctctgctgaaggtgtggacatcgttttggattgcctctgtggggacaacactggaaaaggtctcagtcttctcaaacccctgggaacctacattttatatggctcatccaacatggtaactggagagaccaagagcttcttcagctttgcaaaatcatggtggcaggtggagaaggtgaaccccatcaagctgtatgaggagaacaaagtcatcgcggggttttcccttttaaatctgctcttcaaacaaggccgggcgggcctcattcggggagtggtggaaaaactcatagggctctacaaccagaagaagatcaagcctgtggtggactccttgtgggctctggaggaggtgaaggaggccatgcagcggattcacgaccgagggaacattggcaagttaattctggatgtagaaaagaccccaactccactgatggccaatgacagcacagagaccagtgaagcaggggaagaggaggaggaccacgagggagacagcgagaacaaggagcggatgccctttatccagtaactgaggacccaggtgggagaatgtgaaggatggtttggaagatgaggacccggctgagaaaactcttctgtgccccagtgaacaaatgctgtagtccagtgcgtgtcgtgtttgtctgcagtcagctgagctaaaaagctgttgatcactgttgttttttgaagtgccaatcccatgccatgcagtattatgtccctctcctatctgtgtattacacattcccctctcccctgtatcaaaaccatccatctgtgggttcttcttgacagttctagaacagccttgcaaattaatacaagtcccaggcccaatgcctaagagaccagacgtgggcaaagacaagtttggatggaaaggtgttatcacagagccctgtccagctcctagaattcctcaggccagtgacacttttttgctgctggccacccatgcctctgatgagaacacttgccaatttggccagcagaaagagagtaggccggatgttttcatgagcccacaaatttagaaactctcctagtagtactttttctctctccatttaagagacaactacggtcaaaagtttgagccattctcttctaccccttcagtgtctgaccctttcactggctcttatctgtaaacacagggaggcaggtatggatttttcacagtagacaatgggtcaacagcatgagtttgaggacctgctgtgaagatttctcctccaaaatacatctcatgggcaggattcttcctgctccatatctgtttcaattttaagaaagcaccacatacaagacacattcagaagtcattcctgagcattgctggtgtttgcacacttgccacctgcattaccaattctgtaaatttcaattcctggtggaaagtgaccactttgaccatggatttcccaaagaagagttcctttgcagaccataggtggaaaagtcaatgagcatctccttccttgccaaagcatgtcccaacatgtaacaaactctagggatacaaaaggtttatattcagcatctgatgtcagatgtacagttcctcccctcccatatataaaccccggtgtagaatctgcagcgccctgctcttcggaaaccaaggaacaagccacctgctcacacaccttgttcaacttttcagctcctaaggaaccccacccccatgcaatttgactgtgcttgagaggtgaatacagttaccttcgagaaacagagggagctcctcaccccgtccttccagtccttttggctaaaatgcttaactatcactcacaaacaaatgtggagataccaggagctcatttgattcataccccaactttgtgttctgaaaaacatcagagggattttacattgcccagtttctccaccaacaagccttagggtggacccaaccctttccgcaagtggtaggaacgaatgcatcttagcaattacctgatttccaaagtccttttgtagcaaatgtcacctcattcgtggtctttttacctatcctaagcttatgatgatgagttatgtatgccaaatatttatctgaagagtttctcctcattgtgaatgtgtatgtaaaatatgaagacaagaaagggtgctttcatctgaggaaccaaggggtgagagtatcccaaaggaggacaccagcatcatcttttcttcgtactccaggacccaccaatattccagttctgggtcatttagagagataatggggcgtttattcccctattacctttgctaagtgctatattattggctgtttctcccgtaaccatgctgaaaagggggtcttagggagaactgtcatccaagtggcattcctagtaagttgggtagaaatgacattttccagagctgaaggagtgaagagcccttggccatactagggctctccttcccccggggagtgggaattcagccacattcagaattcacatcgcctttgttatgtccagaggagaggcataaaaaggcactctcccccaccacccctaccgaatctgggtttggtttggttttatttaactagcaaagttaatccagtaatcgcaaattactccagatggttaaagaaaaccctttcagaatacagaacgagaaaactagagtttgaccaataagaccaatttctgccatgaagaaccgggggacgcaagttaattgtttaacgtactctcattttaagcaccttctttcctgtctcttgattgttttttctgaaggaagtgtaaagaatgtctcagtctgccttaaaggaactgtgaaggcttctctgtaatttaagcttgattgaagtgaactgaaacattgtctaatgtctttgtggctttagagcttttgttatattgtgcctataaagcaaattatgtttacataaaaatataaataaagtattcagcatagcaaaaccccaaaaaaaaaaaaaaaa

SEQ ID NO: 53202 - DNA, 8382 bp, Homo sapiens
cagaaagccagccctcccttcccttcttggggcgcagaggctcagccagctcagagcgcagcctggagccgacccagaagggcgaagaaagcccagcggacgagcctcctttctctgctgcctgcccgggctggggcgtcccatcccccgccctgaactccgatctctcccaccccacccctctctgggtttcacccggacagagccgggagctgggtgtcgcccccgtttggaatccacgtttcagcactttggacagcgccccggacgccccggcccctttgggttggcgatggcgagcgttcagcaaggcgagaagcagctttttgagaagttctggcgaggaaccttcaaagcggtggccaccccccgtcccgagagcatcattgtcgccagtatcacggcccgcaagccgctgccaaggacagagccccagaataaccccgttgtcccagctcaggatggaccctcagaaaagctgggtcagcatctggccaccgagcccttgggcaccaacagttgggagagagacaagacctgtcgggaactgggtgccaccagaggacacagtgcctctcatgacaaagacttgacaccaccaccttcctccaggggaaagaagaaaaagaagaaatccactcggaagaagagaaggaggtcctcatcctatagcccatcgcctgtcaagaaaaagaagaagaaaagttccaagaaacacaagcgacgcaggtcattctccaagaagagaaggcacagctcctctagcccaaaaagcaaaagaagagatgagaagaggcacaagaaacaatctcgaagccggccccgaaagtctcaccgccaccgccatcaccgctgcccctcgcggtcccagagctcggagtcccgcccctcaagctgtgagagcaggcaccgcggccggtcccctgaggaagggcagaagtcccgccgaaggcactcccgccgctgctccaagaccctctgcaaggacagccctgaggcccagtccagtcgcccgcccagtcaacccctccagatgcttggctacctgtcagccaggggtgtaatcactgggtcggggtctgctgctgacctctttaccaaaacagccagcccgctcaccacctcgcgaggacgttcccaggagtacgactcaggaaatgacacgtcctcgccaccctccacgcaaaccagctcagccaggtctcggggccaggagaaggggagccccagtgggggcttgagcaagagccgggagctcaacagtggcaacacctctgattcagggaactccttcaccacctcctcaccccagaacaagggggccatgttggagaatctctcccccaccagcaggggcagagagtcaaggggatttcagtcaccgtgtctggaatgtgccgaagtgaagaagtccagtttggtcccatccacagcccggagctcacccatgaaagggtgttcccgcagctcctcctatgccagcacccgatcctccagtcactcgtcccgatccccaaatcccagggcttcccccaggtacacccaaagccgatccacctcttctgaaaaaaggtcctactcccgctctcccagctattcctccaagtctggcaagaggagcccgcccagcagaagctctaggtcccgccgcagccctagctactcccgctacagccccagcagggagcgggatcccaaatacagtgagaaggactcgcagcagcgggagcgcgagcgagcgcgtcggagacgtcggtcctactcgcctatgagaaagcgccggagagactccccgagccacctggaggcccggaggataaccagtgcccggaaacgccccatcccctactatcggcccagcccctcctcatccggcagcctcagcagcacctcctcctggtacagcagcagcagtagccgctcggccagccgcagctactcccggagccggagtcggagccggagccggagacggagccggacccgcacgagcagcagctctagctcccgcagccctagtccgggctcccgcagccggagccggagcaggagccggagccggagccggagcaggagccagagccggagctacagctcagcagacagctactccagcacgaggcgctaagtgcccctgagccagctgcccgtgggggccccttcgcgctgccagcctcccccaaccacctgccctccccgccttcttggtgacaaatagtgagggctcctataccttgtccttcctgcttgcctaggggaagaggagaagagggtaagggggcttcactctctagatcagcctgctaggagcctctaccagcatcatcctggggcccagctcaggcctgggcatatggaaagaaccatcatcttgtggcacaaaaaaagaagaaagaaaagaaaacttcaaggttttgtgagaagcaatgggtctgtgactcaaaaattgagccctggccaggaaaatgtggagacagttcttctcctccactgctcacaggaggcccgtggtaattctccccacctccccggatgccccactagtccaacttcatggctgcacgtggatggacccccatgtctgagaggggtgaaagaggagaccaatggcagttcaggttcaagataacggggtcaggcctttaacttcctcaaacaggcccaagcaaaggctggaagacatttgggtcctagaagaagggatatccttgaataccagatggggacgtttgacttggtgggaggtgtcaggagataggagttggttaagatgatagatagaaaaacggaagggttcagctgctgctcccaatacctcagcatggtaaggggacagagcccagcagatcccagctgtgaagaggccactgcatggctgacacaaaacacctcttggccattcacaggggccctgcaacctcacgagaaaggagatagtggaagagtcaggacaggttggtctccagccccacttcccaaatatgcctcagccccactagctggcaccaacttaattccacgggaccatctgctgaacattccccagtgccatggccagttgccaggccccagcgccagccagtctggccttaccctccggttggcgcctgccagccccctcccctctgcccaggctgccacgccctggatgccacccagtgcagcctggcacctacccacccacccttcagcttaagccactccccttgcctctcaggaattttgccaggatggggcacagcagctcaggtttgggggaaaagacccgaatccagagtgcaggggagaggggcttggatatgccatgtcttgggctcctgctggcttctgaggtttcttgtcagcttgggaaagacccacctttatttttgccctcaccccaagtcccccctggctggggctgggcagagagggtaagctgatctccgatccacaaataccaccagctgcttcatccacagaaggcgctaagaacggggaggtgaggaataagatccttaaaataaactcttgggcatccccctcaccagctgactggctttccggaggcttgtgggtgagtttcaagtttgtggtggcaacagcagcaggacagggcacggagggagcgagggagagaggaccggtcccagcttttggatattttgggttatggggaagcaagggccaaacattctttatccctcccaccccagggaaaacatttggaaaatagtcctttttcttggaagcagtgacgtctccctacccaatctttcccatcctatcaacccatggggctagagactgccatgcaaccaccaccacgacagcccttcctccatcagaagacaggagtgagggccccgggcagcagtggacgacccagcctccccataccgggcctctggcccagacctaagccctgcccacaaagactaatggatgccagtgctgtcactgcagaaggccagatggcaggtgcctgggacaggggcaggtgccccggggagggcaagtacagccactgtaaataaccctcgtccctgcccaggaacccagactggacttcagtctccctccatggagacaaaggcttcccagagccaccaaaaaccttcttagcaggacagctgtgagaggcatcagaacctcacgttcggactgccttcatcaagacaactctaggggaccattttgcctggggctcctagcaaacctttttatttattttatttatttatctatttatttatttgatgactgtctctctttctcgccattagcagtattgaattatttatttatacagaggttttgtgtgtgtgtgtgtgtgtgtgtgtgtgtgtgtgtgtgtgtgtgtgtgtgttggggggatctcctaaattatttctgtgcatctcctttttttttctgctgttttttatggatgggatttgagaggccaaaggtgagtgggctattggccttctccctgaaggctctaagcctggaacaccctggggttggcccagaaggaggcacatcagtcccaaaattcatcacttaacccagcgtccaggagggtcaggcctgtaccccagcctcctgtcccccaggaacctcacaggggtatcaaaaagatgtaaacagcccagaggcttatgagctacagtgatgaattgacacagtggagttgcaacttaggtgggggttggagtcgaaagttggcaaatggggccaaggctgcacaaagtcgaaatcccttgtgaatgtcccttagggaggcaccagattggagacagatgtgctatctcctaacagagtgatgaggcttcagttgagtacttgctgaagtagttgccttgtattttgagggccatggtggatgaaaatgatgtctggtttagtactggaattgcacttggggttgacaaggtgctcacaccatgagaatggaggcaggaattgagctgactgagggaagatgcaccttgatctcaccctcactccaaggcacatagcaggatcactccctagcttctctgagcacacctagttggtttcatgtatgttacacatgcttccactccacagtacctaatttctctctgtcccctgagatctgaaggctaccttgggaagaggcatcagccatcttgcttgagaaccaccaagccaaaagcaaaagcttttatctatgatctcttgctgtttcatcaggggaaagcacaaagctatttctgaaattaggaaaaaaaaaaaaaaggtggaaggagcagccagatgttccacaggaccccaccaagaaggtcatttccaaacccatcctggaagggcccaggatccaaaggtcatcagtcctgcttatctgaccaactggcagtgtcttctggctgctggccggagacagctcttgccctttccaaagtcactgtccactgccttgcaattgccagcttgtctggtccagctttgggtttggtgagacttttgcaacatccctggttgtttccctggcaatgtgactatccagccctaacccaaagcaagggagtgcccctttcctgggtgaagtttacaagaaggctgcttaaatgcctgcttcggggaaatctctgcctctctctctctctgtctctctctctgtctctctctctgtctctctctctctctctctctctctctctctctcagtgtatttctctactttcttttacatttcctttttttctatccaaaaacaatgtgcttgttgaggcactggtaaccctgattaaccagaacctcccattcccagtatcgctgttcctacgcccatttcaccctcattaccttctgcttccaaggaatatgacagatcaccaggatgctgctcgtcgtgaggatttatctcaaaaaccaacatccaaaatgggagggagatgtggcttgaggtcaagcgccatgcatcccaagcctttgaccttcccgctatggaagtgcactggatgacagaaactgaatacattgctccctttccctagggcaaagttcgacctctgttaagtggagggatttgtgagataaaaattcaaaatgttggcctgaggcctgagagtgtcaccaaagacagagggagcttcactgagactcagagggaaaaggaaaagagcctcaaacatttttaggaggttgtccatcatgaaagtaaaaacgaaaagcaagatttgatctcccttcagttaattaggcaaggctaagtaactcaaagccccctattagtaacattctggttcactgaggtttgatcatattcctatctgcattccttcccttctttgaaggacagctgatctttcagaagcagaataaaattaagatgttagaacaaaggtctcagtctcagagaaccgcatcacttcatttgctcagacccatcctcttttgcaaaagggtctgcttggagaggccaaaattcagggtgctctcaaaggcaaagaaagcacattgttttccttctccagtccaactttcatcttttcttctgctgttttcttttcccctcttctttttcacaaatgttcaaaatggtctcatgcgcatgtgtcttgccccactttcccctttagctgaacagaaaattttgtctcagtaaaacgaagtcaaaaaacaggattcctccaaacatgcctcctcccgcactggccagccgagtccagctgagaaacttatgctagattcaatgtcattgagcaatgctttattgaagtctcgttcttctcacttctgcaccagtgagccaatgatactgacagaaatgtcatctctcttctatctgtggttgctgtttttggagtaaaagtttctgtgtgtgtttttttagttcttttgatggctgttgttttgcattgtaaataccatgatgggggacccccatcagaacatggcttatttaataatttatttcgtatttattgagtaatattgggaaaagagaaggaccacctctttccctgaattgctattgagaattggtccatctcccagctccaggtgctgctgtctgcagcaagggcattactgcccaggtaaggagtgctagaatcaccaagcaaattgaaattggcagaaatggaggcttcagtcacacaaattagactcaaatggaactaaaacactggttatctccaggaaaacctcatttagatggaaattaatggaagaataaaatgcctacacatgaaccaacttctattaaaaagtcacaactccttgaaaaaaaaaataaagaaaaattgtaaactcttttttttttctggccaaggaaagctatgcctcatcttctaacgagccaagccaaaaagactgcaatggtattcctatgtgtttctttggcctgtgtatcagtctgaatgaaatggaatgggtctctagcctcagtcttgtcatctgtaaaatggggcttgtcctatatattatctgcaagacgtgggaaatgggggctcaagccctgatgctatggactccatactgttggatatattgtctcttgtgtcttctgctgactgcagattaaagggtgtcaaccaaggaaggaaacaaaaaagtagggcctggacttcatttgcagaatgaggtcatagtcgttgagtcccacagtcatatatgggagacctcaagttgctgtcaccttgataactcttgtatcctgggttaaagccctctgtatttagtttgaacttctctctaagccccgtggtccaaagtcatcacgggagagaccaagatgggcttaccttgccctgctctggatttaaccattgttcattgtcaggctatatttttgtacaatcattcaaataacccagtgacataggtcatattgccacttttcagaggagaaaactgaggctcaggagggggagttgacatgcccaagctcccttgagctcagatcagcttgactcaatgtccaacattcccttggtagctttttctccggggtcctgtgctataagaacttctctctgcactgtatttttttttctcccaattcttagctatttcctcaagcaatgattggccaaggacctagcataatccaccacattggccaaggggacgtggtgcaccccaaggccatttctctgcattggaggctgcgaatctcctctggaaaattcccaacccgaggacccaccatgagcccagctcagcctgaccagacagcctctgcctggagcattcacatcagatggaaagaagctgctgtgtcctccagcatcctgggaccctgtcctctgcccagtgacacagcagccatggctagcttgatttctggtctccaaagctaagcataaccttcccggggtttctggtttttcagcctgtacgaaacatgtctctgttctaattaaagttcccatggtatggtgttctcat

SEQ ID NO: 53203 - DNA, 3575 bp, Homo sapiens
agattgcgcgagggggagcgagcgagcgggcgctgccaggagcccgcagccctggcgcccgccgccgcccggagccccgcaatatgccgccgcggccctctggctctaggccatggcgaggctctgccggcgtgtcccctgcaccctgcttctcggcctggccgtggtgctgctgaaagcgcggctggtccccgcggccgccagagcggaactcagccgctccgacctcagcctcatccaacagcagcagcagcagcagcagcagcaacaacaacaacaacagcaaaagcagctggaggaggctgaggaggagaggacagaggtgcctggggcaacctccaccttgacggttccagtgtctgtatttatgttgaaagtccaggtgaatgacatcatcagtcgtcagtacctgagccaagcagttgtagaagtgtttgtaaactacacgaagacaaattccacagtaactaaaagcaatggagcagtgctgataaaagtaccctacaaattaggacttagtttaactattattgcttacaaagatggctacgtgttgacccctctgccttggaaaaccagaagaatgccaatatattcatcagttacactttcactgttcccgcaaagccaagcaaatatatggctatttgaagacactgttttaattactggaaaattagctgatgccaagtctcaaccaagtgttcagttttcaaaagccttaattaaacttcctgacaaccatcatattagcaacgttactggctatcttacagttctacaacagtttttgaaagtggacaattttctgcatacaactggaattactctcaataaaccaggttttgaaaacattgaattgactcctcttgctgcaatatgtgtgaaaatatattctggaggaaaagaactaaaggtcaatggctctattcaagtttctcttcctcttctacgtctgaatgatataagtgcaggggatcgcatacctgcttggacatttgatatgaacacaggtgcttggataaatcatggtcggggaatggtcaaggaacataacaatcatttaatctggacatatgatgcaccacatttggggtactggatagcagctccacttccaggaactagaggttcaggtataaatgaagattccaaggacataactgcctaccacacagtgtttcttacagccatattaggaggaacaatagtcattgtcattggattttttgctgtactactttgttattgcagggacaagtgtggtactccacagaaaagagaaagaaatatcactaaacttgaggtcctcaagagagaccagacaacttcaacaacacacataaatcatatcagtacagttaaagttgcattaaaagctgaggacaagtcgcagttattcaatgccaaaaactcctcatatagtcctcagaaaaaggaaccatcaaaggcagaaacagaagaaagagtttccatggtaaaaactcgggacgattttaaaatctacaatgaagatgtttcatttctatcagtcaatcaaaataattactcaagaaacccaacacagtctttggagcccaatgtagggtccaaacaacctaaacatattaacaacaatctatcttcatctctaggtgatgctcaagatgaaaagaggtatctcacaggtaatgaggaggcgtatgggcgttcccatattcctgaacagcttatgcatatttacagccaacccattgccatccttcaaacatctgaccttttctccacaccggaacaattacatactgctaagtcagctactttgccaagaaagggacagttagtctatggccaattgatggaaccagtaaatcgagagaactttacgcagaccttgcccaaaatgccaattcattcccatgcacagcccccagatgccagggaagaggatatcatacttgaaggtcaacagagcctgccatcccaggcttcagattggagccgatactcaagcagcttactggaatccgtctctgttcctggaacactaaatgaggctgttgtaatgactccattttcatcggaacttcaaggaatttcagaacagaccctcctggagctgtccaaaggaaagccctccccgcatcccagagcctggtttgtgtctcttgatggaaagccagttgcacaagtgaggcactcctttatagacctgaaaaagggcaagagaacccagagcaatgacaccagtctggactctggggtggacatgaatgagcttcactcaagtagaaagctcgagagggagaaaacattcatcaaaagcatgcatcagcccaagatcctttacttagaagatttagacctaagcagcagtgagagtggaaccaccgtctgttcccctgaagacccagctttaaggcacatcctagatggagggagtggagtgatcatggagcaccctggagaagagtcgccaggaaggaaaagcactgttgaagattttgaagctaatacatcccccactaaaagaaggggcagaccaccactagccaaaagagatagcaagactaacatctggaagaagcgagaggaacgcccactgattcccataaattaactccaatggggattgtgtgtctgctgtctcgtgctgtttattcttgcttcttgttgtaaattgcagtacgaacttaagaaaatgagactgagcaatctcatggttcttggacatgtctcaagcagagtaaatggtaattcagtaatcagagagaaagataccaaggaatgctttttctggcctattcatttatttttgggtgatgaatttacagtatctaagttttcaaaatgtaaaatagcttcaagatgttagttatctgaaaatgttgctcagccagccagtttggccttgactctcttaagaataacagtgaaatatatactcctcaagttgcctccaaaaatgttgcctctaccatggtgactaccccatggaacatttagaaacaaaactgacttcaggcatcatattattttaaatgttactattacgtcttcttctgcctatacttaaaaataacttgataaatgacttggactgatgttactctggagttatcacaaagaaaatgttgtttggtctttaaagagcatgtgtattgtatcatcccaaacgtaaatcctacatttatataagatgggcaagaagctacttggtcattagagagggagacaccagctctttggttgtttttggatataactttacaaaataagtaagatgttaatttagaaatttgagaaattaatgctctaatactgagtttttatttaaaaattattttttcttcccctcaacaatgaagcaagcttagctgtcaagggaaactttttacaaatctgaaaaaaacaatctatgactttggtttaaggctcactgatacttttaggctaaattggttttaatatatttcttctattctaaaaacctgaactcagtcacttaaaggctatgaaatttaaaaaaaaagtcgatgtgaaagtttcttttgaacactaaaataaaatatgtgcagataaaaaaaaaaaaaaaa

SEQ ID NO: 53204 - DNA, 8843 bp, Homo sapiens
agccggcgagcggcagcagctccgggctcgagagcccgcgcccatgccagtgcccatgcggggccgccgccagtgacgccggagaggtgttccccccacactggggctcccactactgcgaggagtgacccacgaaggccacagagatggccggggcttcggtgaaggtggcggtgcgggtccgccccttcaattcccgggaaatgagccgtgactccaagtgcatcattcagatgtctggaagcaccaccaccattgttaaccccaaacagcccaaggagacgcccaaaagcttcagctttgactactcctactggtcgcacacctcacctgaggacatcaactacgcgtcgcagaagcaggtgtaccgggacatcggcgaggagatgctgcagcatgcctttgagggatacaacgtgtgcatcttcgcctatgggcagacgggtgccggcaagtcctacaccatgatgggcaagcaggagaaggaccagcagggcatcatcccacagctctgcgaggacctcttctctcggatcaacgacacgaccaacgacaacatgtcctactccgtggaggtcagctacatggagatttactgtgagcgcgtccgtgacctcctgaaccccaagaacaagggcaaccttcgcgtgagggagcacccactgctggggccctacgtggaggacctctccaagctggctgtcacctcctacaatgacatccaggacctcatggactcagggaacaaggccaggaccgtggcggccaccaacatgaatgagaccagcagtcgctcccacgccgtcttcaacatcatcttcacccagaagcgccatgacgcagagaccaatatcaccacggagaaggtgagcaaaatcagcctggtggacctggctgggagcgagcgggctgactccacgggagccaagggcacgcgcctcaaggagggggccaacatcaacaagtcgctgaccaccctgggcaaggtcatctccgccctggctgaaatggactccggacccaacaagaacaagaaaaagaagaagacagatttcattccgtaccgagattccgtgttgacctggctcctccgggaaaacctgggcggtaactcaaggacagctatggtggcagccttgagtcctgcagacatcaactacgatgagacccttagcacgctgaggtatgctgaccgggccaagcagatccgctgcaatgctgtcatcaatgaggaccccaacaacaagctgatccgcgagctgaaggatgaggtgacccggctgcgggaccttctgtacgcccagggtcttggcgacatcactgacatgaccaatgccctggtgggtatgagcccctcatcctcgctctcagccctgtccagccgcgcggcctccgtgtccagcctccacgagcgcatcttgtttgccccgggcagcgaggaggccattgaaagactgaaggaaacagagaagatcatagctgagctcaatgagacctgggaggagaagctgcggcggacagaagccatccggatggagagggaagccctgctggccgagatgggtgtggccatgagggaggatggcggcaccttgggcgtattctctcccaaaaagacaccacacctcgtcaacctgaacgaggacccgctgatgtctgagtgcctgctctactacatcaaggatgggatcaccagagtgggcagggaggatggcgagaggcggcaggacattgttctgagtgggcacttcatcaaggaggagcactgcgtcttccggagcgactccaggggaggcagcgaagctgtggtgaccttggagccctgtgagggggcagacacctacgtcaatggcaagaaagtcacagagcccagcatcctgcgttcaggaaaccgcatcatcatgggtaagagccatgtgttccggttcaaccaccccgagcaggcccggcaggagcgtgagcgcacgccttgtgcggagacgccagctgagcctgtggactgggccttcgcccagcgtgagctgctggagaagcagggcatcgacatgaagcaggagatggagcagaggctccaggaactggaggaccagtaccgccgcgagcgggaggaggccacctacctgctggagcagcagcggctggactatgagagcaagctggaggctctgcagaagcagatggactccaggtactacccggaggtgaacgaggaggaggaggagcccgaggatgaagtccagtggacagagcgggagtgtgagctggcgctctgggccttccggaagtggaagtggtaccagttcacgtctctgcgggacctgctgtggggcaacgccatcttcctcaaggaggccaatgccatcagcgtggagctgaaaaagaaggtacaattccagtttgtcctcctgacggacacactctactcccctctgccacccgacctgctgcccccagaggccgccaaagaccgagagacgcggcccttcccccgcaccattgtggccgtggaggtccaggaccagaagaacggggccacccactactggacgctggagaagctcaggcagcgtctggacctgatgcgggagatgtacgaccgcgctgcagaggtgccctccagtgtcatcgaggactgtgacaacgtggtgaccggcggagaccccttctatgaccgcttcccctggttccggctggtgggcagggccttcgtgtacctgagcaacctgctgtaccccgttcccctggtacaccgtgtggcaatcgtcagcgagaagggcgaggtgaagggcttcctccgcgtggccgtccaggccatctcagccgatgaagaggcccctgattatggctctggcgtccgccagtcgggaactgctaaaatctcctttgatgaccagcattttgaaaagttccagtccgagtcttgccccgtggtggggatgtcccgctcgggaacctcccaggaagagcttcgcatcgtggagggccagggccagggtgcagacgtggggccctcagccgatgaagtcaacaacaacacctgttcagcagtgcccccagaaggcctcctcctagacagctctgagaaagccgccctggatgggcccctggatgctgccctggaccacctccgcctgggcaacaccttcaccttccgtgtgacagtcctgcaggcgtccagcatctctgccgaatatgccgacatcttctgccagttcaacttcatccaccgccacgacgaggccttctccacagagcccctgaagaacacaggcagaggccccccacttggcttctaccacgtccagaacatcgcagtggaggtgaccaagtccttcattgagtacatcaagagccagcccattgttttcgaggtctttggccactaccagcagcacccgttcccgcccctctgcaaggacgtgctcagccccctgaggccctcgcgccgccacttccctcgggtcatgccactgtccaagccagtgcccgccaccaagctcagcacactgacgcggccctgtccgggaccctgccactgcaagtacgacctgctggtctacttcgagatctgtgagctggaggccaacggcgattacatcccggccgtggtggaccaccgtgggggcatgccatgcatggggaccttcctcctccaccagggcatccagcgacggattacggtgacactactgcatgagacaggcagccatatccgctggaaggaagtgcgcgagctggtcgtgggccgcatccgaaacactccagagaccgacgagtccctgatcgaccccaacatcttgtctctcaacatcctctcttccggatacatccacccagcccaagatgaccggaccttttaccaatttgaggctgcgtgggacagctccatgcacaactctctcctgctgaaccgggtcaccccttatcgagagaaaatctacatgacactctccgcttatatcgagatggagaactgcacccagccggctgttgtcaccaaggacttctgcatggtcttctattcccgtgatgccaagctgccagcctcgcgctccatccgcaacctctttggcagtgggagccttcgggcctcagagagtaaccgtgtgactggtgtgtacgagctcagcctgtgccacgtggctgacgcgggcagcccagggatgcagcgccggcgccgacgagtcctggacacatctgtggcctatgtccggggcgaggagaacctggcaggctggaggccccggagtgacagtctcattctggaccaccagtgggagctggagaagctgagcctcctgcaggaggtggagaagactaggcactacctgctcctgcgggagaagctggagaccgcccagcggcctgtcccggaggcactgtccccggccttcagcgaggactctgagtcccatggctcctccagcgcctcctccccgctctcggctgagggccgcccatcacccctggaggctcccaacgagaggcagcgggagctggccgtcaagtgcttgcgcctgctcacgcacacattcaacagagagtacacacacagccacgtctgcgtcagtgccagcgagagcaagctctccgagatgtctgtcaccctgctccgggacccgtcgatgtcccctctaggggtggccactctcaccccctcctccacttgcccctctctggttgaagggcggtacggtgccactgacctgaggaccccgcagccctgctcccggccagccagcccagagcccgagctgctgccagaggccgactccaagaagctcccttcccctgcccgggcaacagagacagacaaggagccccagcgcctgctggtccctgacatccaggagatccgagtcagcccgatcgtttccaagaaggggtacctgcacttcctggagccgcacacgtcaggctgggccaggcgcttcgtggtggtgcggcgcccctatgcctacatgtacaacagcgacaaggacaccgtggagcggttcgtgctcaacctggccactgcccaggtggagtacagtgaggaccagcaggctatgctcaagacacccaacacattcgcggtgtgcacggaacaccgcggcatcctgctgcaggccgccagcgacaaggacatgcatgactggctgtacgccttcaaccccctcctggccgggaccatacggtccaagctctccagaaggaggtctgcccagatgcgggtctgaacctgagccctcccgtgacagccggcaggcccagcccatcccctccctcatcctcgtctgtcctgtcacctgccgcccagcccctctcctgccagacagcccacgaccgggtcgaccccccaggggacgcccatgccaggcccggggacctgtgccacacgaccagctgtgctcccagcagaggctgtgcgtgtcagttcttcttgcagaatgtgctctggtggaacaagttgggagaggctgggggggccaagggcacaggttacgggggttcttgctgccgttctaatatttttttaagcatagacagacttataattaatatacgttagttagtgacattgaaacagtcaactcggaaattaactataagacttgttctatttataagtatttatttctaatgcctccacatagccctgtaatattcagatggaacccccaaccacctccaccctgtttgttcccacatgtgtctcccaagcctgctagggacaggcagggcagggacagccaccttggaaggccgcagtgaggagctgtctggaccagtggggcaccttggggctagcacacgggtgtatcgcctgggccccaggcttctccatggccacatgggtcctgggtgtatgtgtgggagagtgggggggtgtctttggtgcctgaagtctgcgcggcatggagggtggtgtgagttcctctggtgggagggagaacgcacatctcttctgggcggccacctgaggagtgactccaagaagagttccggcagctttccccaggaaagggtgaggggtgacactcggctctggctctgagatgaggcagacggcacccaggctgtgatctgtcctgggcggggaccaggagggagcggggtcgggatcacctgccagtgtgcagactctgggactgcgtgctgtctccggaccatcagggtagggtggtgggttgagaccaggaagtcagggaagatcggaattcagggcgacggtctaggtgtcgagggctgtggcgcagcctcttcagctgcggcgagaaatggagtgagtcaaggtagcttctgggaagaaatgctgccattagcaggtttcttgcaaagactttcctctctttgttcccagggcagagagtttctgtgagtcccactgagaaaatcccatggggtgggggtatcctggtcggtcggcaatggagggtggctggcttggtggttattgtcttcaaggagctcttcgctgctgcatctgcggtgtccctttgttcttgtcccatttcaccccctctgcagacaccaatgtccgagggccacccaggacaggacgggggtcagccccaagctgagagtctggtcataggagtcatgtccagaggcctagggaggttttagggccctccccacccacacccacaggtcgatttggtctctttttagctcaaggaaagacagtagccaagcaacagagcccctctcccgccgtggcccgtgggagcagttacatcgggtctggtgctccagacctagggcccagcactttcatcagatcctgcctcctggagtgggggaaacgcagcaccccactggttctgaggcccctaccctcccaggctgtcccacgtgatgctgacatgagcctcagagaccccaatcccatgcctgggggagagacagcggctcaggagtgggggagcacgggccttctacaccacatgggaaggctctggcatgaggttttcctttgggaaggttgtttgggcccctgaagttccatctccgagagtggtgtgcagggcaggccagggcccatgctggctgcagtctctgtggctgcctgcctgggccagcctgtttgggagctgggactgtgggctcgccttttcgtacctgggctcaggtgcggtgtggccaccgccaccctcatcccctgcctgggaggctctcccaggggctgatgggggggttctgtgagggagaatcagggctcgggaagccacgcctgggaaggcaggacacaggacacagcagctttctttggaaatctcccaggtgaggattcacatcccaaaataaaattcagaagccaggtggcctgtgctccccatgggtgacctctggaggcagtggaccaagatgcagcaaggagaggatgcagaacagcttcttgcagaagcacctgctccggcatccagcgctgcctggaggcaggaaggagaggcagggcaggacacgctggtctgagatgagggggagccccacgggccccaggcaggctagaggaggcacaggccctgccacggccaactcaggtcagccagcctgaggctgtggcctccaaagggtctgggcgcaccccccaggtcgcaggtgtctgaggccagccaacctgcagagcactcgcggcgtgggtgggctgagtggaggtgcctgggagctgcctaaattcagaagcctccactgccatggagactgcctggctgtgtcctctcagccaggtgccgtgttggccttggctaggacccagagccacactgcagcctccgccgactccctccttccgggcctgctctagtgaggagtgcctaagccaggacccagaaactcagagttgatggtgagaggaggccgcctgagtcaggacacctggcttcttgaaaagttcgctctgccagaaaccacctagggaccacgttagctgccttccttgagctccccaggagtcggtttccacatctgtgaggtggagggctggtgtggaggtgctcatggggtgcggtgcttgggagacagccaggcccagggtggctgctgcttcctgctaagtgggggaggtgagacagatctggaaagccgtctccctcagatggtttcatttaatgctttatactgccgagtctgggggcttgttttggtttgggggcagccatcctccaccagaaagggggagctccttccgctgcggctccagatagatggggatgccgggctccaggccgaccagcacttgggatctgatgggacacggccagtgcctaggggtgccaagtccaaggcctcccactgggagtcatcgctgagaagatgccaatgtttcatccaccggctgcacaggcacaaactcccccacccaggacggctgtgatgaggtggccctccctgtcaaccctggtccctggagtccccagcacctggggccctggtggggctgatgtcacaggtgtttactgtgctgctgcactggtcctatgccagcctcacccatgtggggaccacggaaggcacactcccttacccccggtgccgggccgtgcggtcccccagacggacagcagctgtggcgacctgcgtttctccctgggcctgtgcttcctgtagttagtccgtcccctggttcccctgtggctcagaggccgcgtccctggcttgtacatatgtgattgctgtgggcacaccccagaccccatgtcatagctgccgtcccgacgtcacgacgcctgtcccgatgtcttacacccgagtgttagccctaggctcctgtactgtgcgtgcacttgaggctctgtccaattaagaaataaatgtggctcttactcaacacaaaaaaaaaaaaaaaaaaaaaaaaaaaa

SEQ ID NO: 53205 - DNA, 5401 bp, Homo sapiens
tcactctcgctgccgctgctccgccccatccccttctgtttttctctctcattctccagtggcggcggcggggaaggcggaggcagaggcagcagcagccgcgctggctgcaatgaatgatcccccagcttggggggaggactccaggtgagcctctgccctcgggaggcccgggacccccggccgcccacgaccggcagcccacgctatggatccctagaggaaggaggagaagacagctcgccgcccacccccatcccattttcctcttcctttatctcattgttgccgaagctgtttacggcagcgctccctctgctccagcatggggcgggctccgggcacggctgctcggcaggcgctgctcccgcggcgactgggggattctgcctaattcacctcccagccggtgcagagaggaccggagagcggtggaggcccggactgcagcagcgttggggccacctcccagcgtccccaccctaggaggctgcatgcggattgaagagctgcgcctgggggctgggccggccccgctgatcccgacctagcgagcaggatagcaggaccgcccaggctgcggaggggctcgggggcaggaaggtcagagcagcaagatggccagtaagaccaaggccagcgaggccctcaaggtggtggcccggtgccgccccctcagcaggaaggaggaggctgctggtcacgagcagatcctgaccatggacgtgaaactgggccaggtgaccctgcggaacccccgcgccgccccgggggagctgcccaagaccttcacctttgacgccgtgtatgatgccagctccaagcaggccgacctgtatgacgaaaccgtgaggcccctgatagactccgtgctccagggtttcaatggcacggtgtttgcctatggccagacgggcactggcaagacctataccatgcaggggacctgggtggagcccgagctgcgcggggtcatcccgaatgcctttgagcacatcttcacccacatctcccgctcccagaaccaacagtacctggtccgggcctcctatttggagatctaccaggaagagattcgagacctgctctccaaggagccgggcaagaggctagagctgaaagagaaccccgagactggcgtctacatcaaggacctctcctccttcgtcaccaagaatgtcaaggagattgagcatgtgatgaacctggggaaccagacccgggctgtgggcagcacccacatgaatgaggtcagctcccgctcccatgccatcttcatcatcactgtggagtgcagcgaacgtggctctgatggccaggaccacatccgagtgggcaagctcaacctcgtggacctggctggcagcgagaggcagaacaaggcaggccccaacacagcgggaggggcagccacaccatcctcgggtggcggtggtggcggtggaggcagtggtggtggtgctggtggagagaggcctaaggaagcctccaaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccgggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggagaaggcagccatccaggatgaccgcagcctggtgagcgaggagaagcagaagctgctggaggagaaggagaagatgctggaggacctgcggcgggaacagcaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcagcaggaggtggaggtcaaaaccaagaaactcaagaagctctacgccaagctgcaggcggtgaaggcggagatccaggaccagcatgatgagtatatccgcgtgcggcaggacctggaggaggcgcagaacgagcagacccgcgaactcaagctcaagtacctaatcatcgagaacttcatcccgccggaggagaagaacaagatcatgaaccggcttttcctggactgtgaggaggagcagtggaagttccagccactggtgccagccggcgtcagtagcagccagatgaagaagcggccaacatctgcagtgggctacaagaggcctatcagccagtatgctcgggttgccatggcaatggggtcccaccccaggtacagggctgaaaacataatgtttctggagttggatgtgtcccctccagctgtctttgagatggaattctctcacgaccaagaacaagaccctcgtgcgctacacatggagaggctcatgcgattggacagctttctggaaagaccttccacgtctaaagtccgaaagtccagatcctggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctctgttcgtgttggggagatgccctcgcctgagccgtctgggcctaccgtggtcactgcgtagcctctttttcttctgacttgagagctcccccagtcagatctcaggcttgtccccctgtcagctgcctccagaagggaaggtagccagtgcctgagaagacagtcccttttctacccaccgcactccataacctccatcttctcccacactgatggcgagcagcccctgagcactttctgggactgggagactgcttggtgttccctgaggacaagagacatcctgacagtgttgggcatctgctccccgtggacacagccccactctccactttctgagcctcagacaacctcattcagcctcttgggctccttttcaaggacattaataacctcaccaacatagctcatgcccttcagctttgacaagaactcacggcttcccaaactctgctttctgcccaccttggatgggaactgtggaccaagcaattaccatcgccttggaacctgcaggaaatggaacagcaattgagacaacttgaacagtcatcaacggaagtccctccactggattcctttgtttctgtcccctccgaggagtcattttggtcgacaggctctcaaggcaactccccattttcaagaggctgctcctgcctgcttcgatcatttctccctgcagctgcctagaccccgttcacagtgggaggagtcaatgtcattctacccctcgctaaacgaagatattaacatctattgctttttcccttcatctgtcacaggaaacagaagcccaggcacaatcttttccagctttgcctgttacccctgtttctgaattgcatctttaaggtattattttgttgacaatagatcctttattcactagttacgcaaattggttcctagggggatactccttaccttcctttgtgatggcccaaaatgtctctaggtatctcaagtgataagtaaatttctacaaaaaaaaatggttaatgttcattgactggctttttaagtgtatattttggaggacgggtgaagaggtcataacgaaagcaagcgagtgaattaggatttcaaagtgccctaatagtgtgagtctccagttcctagaatatgaagagtgctgtcgttggggtgaaaccatgagactgacagatctgcctgaaatggggggtgtgggaggtggtggcgggggttattctctttccttcaggaaatgaacccttcttacatcattcaagttctgctctgaggatcaagcttgggtctgatttaactcagcgacactgtcatttctgcttcattactggactagagggttgagccacccacttgccatttgctcctgtccttccaggaaatcacaattttcatcagagcccaagagattatttgagactcaggattcagatcagaggttcgactgtggctgggacaggagttgtgtgtagaaattcaccaggtggcctgagcgcagggggacctccagggctgcgttgagcagcctctcccactgacctctttctcgtttgtggacaaagcagcacgtatcacctcattcatcacttggacacatcgcctttgcattgtcttgtcacacctccctcacagtcttatagcacaatatacccaaatcagcccccccagtccgagggctgggcccaaggtatggtcggaggaggagctcctgcctgcggttttgtgtatgtgtgtatgtgtgtgcgtgtttgtgtgcgtgtttacctccacaggggacactctacactcagtgtaagatctgctgggaacagggccaccaggagtggctggatctcagtctctctgtctctctttctctccttttccttttggtgtatcaaatatttgattgacaaagtaagggccttgattaggaccaaattctcgtgtgttgctatggtctttatttaggacaacaattaacaatgcagtggcccattcttgtcactctacacatatgactatacgggacatatgtaatatataaatatatatataaaacattcccctctgtccccttggcttcggatggaggcctttctgttgagctgaaatgcacctgcagctgggtgctgccagcagcttgcaggccccagccctgttccaatcaatgcagttgacaataaaggaatgagtatcgtcacggaaaaaaaaaaaaaaaaaaaaaaa

SEQ ID NO: 53206 - DNA, 3897 bp, Homo sapiens
acgcccaggtcgcccgcatcccgctgccgcaggagagagacagcgcgccccggccctgctccccaggcttcgcccgggcgccctcaactctgtccccagagactgagcacctgtcctccgcctcggcctctgctgagagccctctcctctggagcacacaccacccctgcagcccaagaagagtcccagccccacgccggctaccaccatggcggagaccaacaacgaatgtagcatcaaggtgctctgccgattccggcccctgaaccaggctgagattctgcggggagacaagttcatccccattttccaaggggacgacagcgtcgttattggggggaagccatatgtttttgaccgtgtattccccccaaacacgactcaagagcaagtttatcatgcatgtgccatgcagattgtcaaagatgtccttgctggctacaatggcaccatttttgcttatggacagacatcctcagggaaaacacataccatggagggaaagctgcacgaccctcagctgatgggaatcattcctcgaattgcccgagacatcttcaaccacatctactccatggatgagaaccttgagttccacatcaaggtttcttactttgaaatttacctggacaaaattcgtgaccttctggatgtgaccaagacaaatctgtccgtgcacgaggacaagaaccgggtgccatttgtcaagggttgtactgaacgctttgtgtccagcccggaggagattctggatgtgattgatgaagggaaatcaaatcgtcatgtggctgtcaccaacatgaatgaacacagctctcggagccacagcatcttcctcatcaacatcaagcaggagaacatggaaacggagcagaagctcagtgggaagctgtatctggtggacctggcagggagtgagaaggtcagcaagactggagcagagggagccgtgctggacgaggcaaagaatatcaacaagtcactgtcagctctgggcaatgtgatctccgcactggctgagggcactaaaagctatgttccatatcgtgacagcaaaatgacaaggattctccaggactctctcgggggaaactgccggacgactatgttcatctgttgctcaccatccagttataatgatgcagagaccaagtccaccctgatgtttgggcagcgggcaaagaccattaagaacactgcctcagtaaatttggagttgactgctgagcagtggaagaagaaatatgagaaggagaaggagaagacaaaggcccagaaggagacgattgcgaagctggaggctgagctgagccggtggcgcaatggagagaatgtgcctgagacagagcgcctggctggggaggaggcagccctgggagccgagctctgtgaggagacccctgtgaatgacaactcatccatcgtggtgcgcatcgcgcccgaggagcggcagaaatacgaggaggagatccgccgtctctataagcagcttgacgacaaggatgatgaaatcaaccaacaaagccaactcatagagaagctcaagcagcaaatgctggaccaggaagagctgctggtgtccacccgaggagacaacgagaaggtccagcgggagctgagccacctgcaatcagagaacgatgccgctaaggatgaggtgaaggaagtgctgcaggccctggaggagctggctgtgaactatgaccagaagtcccaggaggtggaggagaagagccagcagaaccagcttctggtggatgagctgtctcagaaggtggccaccatgctgtccctggagtctgagttgcagcggctacaggaggtcagtggacaccagcgaaaacgaattgctgaggtgctgaacgggctgatgaaggatctgagcgagttcagtgtcattgtgggcaacggggagattaagctgccagtggagatcagtggggccatcgaggaggagttcactgtggcccgactctacatcagcaaaatcaaatcagaagtcaagtctgtggtcaagcggtgccggcagctggagaacctccaggtggagtgtcaccgcaagatggaagtgaccgggcgggagctctcatcctgccagctcctcatctctcagcatgaggccaagatccgctcgcttacggaatacatgcagagcgtggagctaaagaagcggcacctggaagagtcctatgactccttgagcgatgagctggccaagctccaggcccaggaaactgtgcatgaagtggccctgaaggacaaggagcctgacactcaggatgcagatgaagtgaagaaggctctggagctgcagatggagagtcaccgggaggcccatcaccggcagctggcccggctccgggacgagatcaacgagaagcagaagaccattgatgagctcaaagacctaaatcagaagctccagttagagctagagaagcttcaggctgactacgagaagctgaagagcgaagaacacgagaagagcaccaagctgcaggagctgacatttctgtacgagcgacatgagcagtccaagcaggacctcaagggtctggaggagacagttgcccgggaactccagaccctccacaaccttcgcaagctgttcgttcaagacgtcacgactcgagtcaagaaaagtgcagaaatggagcccgaagacagtggggggattcactcccaaaagcagaagatttcctttcttgagaacaacctggaacagcttacaaaggttcacaaacagctggtacgtgacaatgcagatctgcgttgtgagcttcctaaattggaaaaacgacttagggctacggctgagagagttaaggccctggagggtgcactgaaggaggccaaggagggcgccatgaaggacaagcgccggtaccagcaggaggtggaccgcatcaaggaggccgttcgctacaagagctcgggcaaacggggccattctgcccagattgccaaacccgtccggcctggccactacccagcatcctcacccaccaacccctatggcacccggagccctgagtgcatcagttacaccaacagcctcttccagaactaccagaatctctacctgcaggccacacccagctccacctcagatatgtactttgcaaactcctgtaccagcagtggagccacatcttctggcggccccttggcttcctaccagaaggccaacatggacaatggaaatgccacagatatcaatgacaataggagtgacctgccgtgtggctatgaggctgaggaccaggccaagcttttccctctccaccaagagacagcagccagctaatctcccacacccacggctgcatacctgcactttcagtttctaagagggactgaggcctcttctcagcatgctgcaaacctgtggtctctgatactaactccctccccaacccctgttgttggactgtactatgtttgatgtcttctcttacttactctgtatctctttgtactctgtatctatatatcaaaagctgctgctatgtctctcttctgtcttattctcaagtatctactgatgtatttagcaatttcaaagcatagtctaccttccttatttggggcaatagggaggagggtgaatgtttcttctttctcatctactcgtctcacactgagtggtgttagtcactgagtagaggtcacagagatgacaaaaggaaaaatgggagctagagggttgtgacccttcatacacacacgcacgcacgcacacaaacatgcacacacgcatgcacacacacaaagccttaagcagaagaatgtcttagcatcatgagacagagaaatagactcttcctccctcctctttcacatatagcacaggggaaggtaaaatggaagggctgctaattgagacatataattttc

SEQ ID NO: 53207 - DNA, 2416 bp, Homo sapiens
gactgcagagccggggctgggctaggcgcgcgcttggagagcattgcgcgcggctgggcccgcggccggcggctcctcctcccactctgctcctcctcttttttctcctcctccacctcctcctccgcctcctcctcctcctcttcctcctcctcttcaattctcccggtggctcgactcggctcgcaggcttcggagaaacccctactccagtcgccgactcagcgcccaagagggtcgccttgggctgggggcgcaccccagggaggggaggggtccaggcagctgggccgccgcggacacctagcggcttcagggtgaaccccgaccgcagccgtcgccgcctcgggcagagtttgcgcccttgctttgcgccccgggcgctgaagccgggcgggcgatgcccgcggcgtgaaagcgcccgcggcgggcgccgacctctgtcctagtctcctgctccccccgccccgcttgtcccgtgcccttgtgaccctggctttggcgccgtcgcccaggcgccccgcaatgtagctgcccctgcgcctcggcgggaggcgtcctgccccgcgagcgcccggggcccggagcccggcctgggggctcagccgagctcgggcggggccggggccgcggtggcgatgcaccgggcccgttagcgccaggagcgccaggcagctgaggcggggggcaagccctccctcggaggagccgcgcccccggccccgccggtcccgccgcgatgctgttccacagtctgtcgggccccgaggtgcacggggtcatcgacgagatggaccgcagggccaagagcgaggctcccgccatcagctccgccatcgaccgcggcgacaccgagacgaccatgccgtccatcagcagtgaccgcgccgcgctgtgcgccggctgcgggggcaagatctcggaccgctactacctgctggcggtggacaagcagtggcacatgcgctgcctcaagtgctgcgagtgcaagctcaacctggagtcggagctcacctgtttcagcaaggacggtagcatctactgcaaggaagactactacaggcgcttctctgtgcagcgctgcgcccgctgccacctgggcatctcggcctcggagatggtgatgcgcgctcgggacttggtttatcacctcaactgcttcacgtgcaccacgtgtaacaagatgctgaccacgggcgaccacttcggcatgaaggacagcctggtctactgccgcttgcacttcgaggcgctgctgcagggcgagtaccccgcacacttcaaccatgccgacgtggcagcggcggccgctgcagccgcggcggccaagagcgcggggctgggcgcagcaggggccaaccctctgggtcttccctactacaatggcgtgggcactgtgcagaaggggcggccgaggaaacgtaagagcccgggccccggtgcggatctggcggcctacaacgctgcgctaagctgcaacgaaaacgacgcagagcacctggaccgtgaccagccatacccgagcagccagaagaccaagcgcatgcgcacgtccttcaagcaccaccagcttcggaccatgaagtcttactttgccattaaccacaaccccgacgccaaggacttgaagcagctcgcgcaaaagacgggcctcaccaagcgggtcctccaggtctggttccagaacgcccgagccaagttcaggcgcaacctcttacggcaggaaaacacgggcgtggacaagtcgacagacgcggcgctgcagacagggacgccatcgggcccggcctcggagctctccaacgcctcgctcagcccctccagcacgcccaccaccctgacagacttgactagccccaccctgccaactgtgacgtccgtcttaacttctgtgcctggcaacctggagggccatgagcctcacagcccctcacaaacgactcttaccaaccttttctaatgactcgcaacccctcaccccacaatttctttaaaaaagaaattatctttagttgaattccaagtgtattttaaaatagaggctttgagcaactaactaaccacattttaggatctcgcctggaaacagaggtaaaaaaaagaagtgtgcgcccggctaatgcagcggtgtggaccgaggaacaacttggaagatctacctgcaacacaacatttgtgtcactgtacagttttgtggactgagcgaggaaaaacaacaaataatttaagttggctagagcttctgtattttcaaagactgccacgtgccttaggaatactgttttatctccatactttggatgacttgttcatttttctctccctctttttctctgtatatttatgaccagagcaaaaatgtaaaaaacaaaaaaaacaacaaaaaaagtttgttactttgaatagtcctaaaaag

SEQ ID NO: 53208 - DNA, 3913 bp, Homo sapiens
gaggggtctttagattctgggaaatgtctgattggcagatgttaaaagggattccttggtaatccagtgcatcaatgagctgcagaaattcagcccaggactgcaagaattcaggcatgaggacactctgtacaggaggctcacacaggcagacccaagatggacataaccttggaatctctgagacacatcattgcccaagtcttgcctcacagagatccggctctagtcttcaaagacttgaacgttgtgtcaatgttacaggaattttgggaaagcaagcagcagcagaaggctgcattcccaagtgaaggtgtggtggtctatgagtcactgccagctcctgggcctccctttgtgagttacgtgaccctcccagggggaagctgttttggcaactttcagtgctgcttaagtagagccgaggccaggcgggatgcagctaaagtggccctgatcaactccctcttcaatgagctgccctctcgcaggatcaccaaggaattcattatggaaagtgttcaggaagcagtagcctccaccagcggcaccttagatgatgcagatgaccccagcaccagtgttggggcctatcactacatgctggagtcaaacatggggaagactatgctggagtttcaggagctgatgaccattttccaactattgcactggaatggaagcctaaaagcccttcgtgaaacaaagtgttcccgacaggaagtcatctcctactattctcagtattctctagatgaaaagatgcgcagccacatggccctggactggatcatgaaggagcgggactcaccaggaattgtctctcaagagctacgaatggccctgaggcagttggaggaagccaggaaagcaggacaagaactacggttttacaaagaaaagaaagaaatattgagcttagccctgactcagatctgcagtgaccctgacacttcctcacccagtgatgatcagctgagccttacggccctgtgtggctatcactagcaaggccaagccccgggtaccctcagtgatggcagaggccagattaacattaggaatctcagtgcagaggtcctcagaggctccagcatctctagtactacctgaaggctctcctaaccctctccacacattccatttacagagtatgagagtcgtaggacccttacaagacccaacaagccactcgatgcatttttctatcacattctcaatagttccagctcaggatgaaaggatagacacaaaattgtttgaaaaacattttccaggcctggctccaacctaaagcctgactgtcacgtgccttgcttgattttatatatattgtttcaagaatagtccaatatagcattccccaaatgaacagcagccagaattaggtgaagtagcatgatagcagtgtttaaaaatacttaggattaaataaataatatggattgttttaaaaaatatccaaggatcagagtctctttctaagctttgtaagctaagcaatagtttatgtcctactagatacactgcaaactacagtggggattttatctggacatcccaccatcaaagatcttgaaatagtaatagtatgaaaatactagataaaattaatgtttaaaatgtttttgtaacaataatttttaaaacccacactcttccatatatggggataaatatcacctagaaaagtagcctcactcttattcctcaagaattaatatccaatgtttatgagtcttgcaatcaattttgttcatttttaatttgcaaatcgataacctgaactaatttgttcttattttttgccactgcaaacatatatctacagagagaaaaattaatggcattttaaaggttaaaacattttgaaaaattattagcatgtaacaaagaatgcttgcatttgattagtttcaccagcatttgagagaaggaccctttagctctgtttgttgttcaagaacataagcaaccagtagctcaaatgtagtatcattattaagtttaagtcactggaatcttctttaaaggaaggataagacattgccatctctatttaactcatccatatgggtcaatcaactgattagaaaatcaaaaaacaataaaaacttttttttttttttttttttagtagagacgggatttcatcatgttgcccaggctggtcttgaactcctgggctcaagccatctgcctgcctccacctcccaaaatgctgagattacaggtgtgagccaccatgcctggcctaaactaatttttagatagttcctggtcactcaaatttaagaatgtcagcaatgtcaattttaaatgctcataggtctttccatatctgtaacatgaaaatgattattctgcattttattcagtagtccaaattaaagaaaatgtttttctcaatttaaaataatttctttttcttttgtttatgcaagtgcatacatgcttcactgaaagcaaaaccattataattacattaaagtttataaaatatgatattttaacctcatatctaataagtatgtacaaaggtaaccatcactccttaaatccacatgaaaactactgtaactgatcatgtattttggaattagacttgataataaaagattatcatgtatcacatatctcacaccaggggaacaattagctacataattgtcataccttaatatcttttaaaggtaacagtaattttcaacacattttattttaaaatattattttaacaaaagttacattcctctccacaatgaggctaaatgtcacccacgaaagaactttattcccttatattcctgaaaagaaatcagaattaacatttttatgttgaataaattttaaaatttaggaaatgttctatttaaagttaatttctttcataaagccattactctttacattgtcatttccaaaaagccacaatttcccatgctggatgtgatgaaagttaggcacacctttactgcattagcagcctttgacaatgacttcctcaaactgacaccatcttaattagatgcagggacagggatcagatgggacaatatcaaatttactttgtgccctacaagttaaaaactgcacccattctgtaaattgaatatagaggttctcccttggccactgtcagcttttcttgactggccaaaactgcccattcttcctggaatggtatgaaagcttcagcaaaataaataaaagtcagaatctttgctggtccctttaatgctgatttgatagtaaatcaatttcagctgagacataagggctgtcagtctatcatataaacatctttaactatagcctagagaaaagagggttgaagagcaaagcagattttttttttccttttctatatcttgttctgaacaacacactgtgataaaggggactagagtggaagattccctatttaaacacatgaagctctgggtcctagccttttttggttataagccctttgagaatctgataaaagctgtggatcatctcctaggaaaatagaacaaaacatacatattcacattacacagttccagagtatgtggaccccccaaagtccagagattgccctaggggatctttagattcttgtttagaactgttgattttgaacacaacatacactgtcaaactttacatcagggatccaacataactcagacatagcccaggtagcctgtttctaacacaactgtcataatcctgaaatccaaaattgcactgtgtttgacatgagatagtttaagttccacaaaatccaaatttaccatattattgtttttaaaaaagcagtttagagcaaactgtcactaaacttggataaatgggtcagaaagtacagatttaataaagtcgtacctctaatgttcaaaaaaaaaaaaagaaaaaaaaaaaaaaa

SEQ ID NO: 53209 - DNA, 1923 bp, Homo sapiens
atggagggacagaccccaggaagcaggggccttccagaaaagcctcaccctgccacggctgctgccactctgtcctcgatgggcgctgtcttcatcctcatgaagtccgcgctgggagctggcctgctcaacttcccctgggccttctccaaagcgggcggagtggtccctgccttcctggtggagctggtctcgttggtcttcctgatcagcgggctggtcatcctgggctatgctgctgctgtcagtggccaggccacctaccagggtgtggtcagggggctgtgtggccctgccattgggaagctgtgtgaggcctgcttcctcctcaacctgctcatgatctccgtggccttcctcagggtgatcggggaccagctggagaagctgtgtgactccctcctgtctggcaccccgcccgccccgcagccgtggtacgcagaccagcgcttcaccctgcccctgctctccgtgctggtcatcctgcccctgtctgccccgcgggagatcgccttccagaaatacacaagcatcctaggcactctggctgcctgttacctggccctggtcatcaccgtgcagtactacctctggccccagggcctcgtgcgtgagtcccatccttcactgagccctgcctcctggacctctgtgttcagtgtcttccccaccatctgcttcgggtttcagtgtcacgaagctgccgtctccatctactgcagcatgcgcaaacggagcctctcccactgggccctggtgtctgtgctgtccttgctggcctgctgcctcatctattcactgacgggggtttatggcttcctgacttttgggacagaagtttctgctgacgtcttgatgtcctacccaggcaatgatatggtcatcattgtggcccgggtcctttttgctgtctccatcgtaactgtctaccccatcgtgctcttcctggggaggtcagtgatgcaggacttctggaggaggagctgcttggggggatgggggcccagcgccctggccgacccctcagggctgtgggtccggatgccgctgaccatcctgtgggtcaccgtgacgctcgccatggcgctgtttatgcctgacctcagcgagatcgtcagcatcatcggaggcatcagttccttcttcatcttcatcttcccagggctttcagaggtgaggggtgtggccacacagctgctcctgcatgctctgagcggagctttcattgatggggatgtggccacacgactcctccctcagttctgggccgggctttcagagggtggagctttcagagctctgggcgggcctttcagagatgagagtgtggtcacacagcccttccctcaggctctgggcggggctttcagggctgagggtgtggccacacggctcctcactcaggctctgggtggagcttctcagaggtttgtgcctcatctgtgcaatgggtgtcgagcctataggaccaagagtcaagtaagtgtccctaagatgaggtggcaccctgggtgtgccccggatcagagtaagaatgtttcaggggaccctgcagatcctatttctcatcctctgcatcctgcagatcttttccttaattacatctgcaaaacccagtttccagataagctggcaagcacaggttccaggtgctgcctggaggtctggggagtggtctctgtgctggtcggcaccttcatctttgggcagagcacggcggcagcgctggactcaaagagcctggaagccaagtggactgttggctctgcagttctccctggtggcctccccaattctgggacaaggggtcacactggcagcagagagcaagaggagacgaggtttgcttctagggcctggctcccagcaaccatgcagctgcgctcagtctctgggtttgcctgctacgggcatgccctctga

SEQ ID NO: 53210 - DNA, 4204 bp, Homo sapiens
agaggaagaggccggctcatgaggtcatcactagcaaaaatgtctgtgttctgtgatgtcatcacagggacaaagcctcgttcccatgaggtcatcacagaggaagaggccggcccgtgaggtcagcgctggaggccatgtccatgttctatggtgtcctcagaggcttccttcttgtggtataataacagagacgacgccttgttccatgacattccttcctgtggtgtcactgcagagacaatctcacctggatgatgtcatctctaactccaaggcctcttttggcatcatcgccatggggaagatattttctccctgtgtctttgcagcagagaagatgcctctgtcctatgatgtcatcattacagacaaagccatcttcctgggacacgtcgcaggggaaaatgcctcaccgattgtgtcctcactagacataaggtccccttttcacaacatcatcacagggaccctgcctccttcctgtgatgccatcaccagagaaggtgccttgccctatgacgtcatcagagggaccgtgcctcttcctgtgatgtcatcaccagagatgaccacccactctgggacctctccaggaggaggtcccttctgtgatgtcgcccagatgctatgtgctctgagatggcacaaagagatgcctccactgctgccaccatgttgtagaaggcagggcaggcccagagtccaggaccaccccagggaagatgccagagagcagagaggggccctgtcctgagatgttgtctgaaggaagcatcgctggggagccgcccatgtggagggcctcctccagagatgatggtctgtgtaggctgttggcagtgacacccctacccccaatgctgtgatggcatcaccagagcttcctcctcagaggcactgcccactctggaaggccatcggtattggtggtgtcaccagagttactgccttgtcccaccatgacttagcttggttgctccctccccagactccagggacatgtccagcaggatctctgccagaccctctgaggggaaatggggccttggatcccacatctgtgccatgactcctgggagacaggacctccagatggccttctgctcccaggaggccactctggatcaccaggatcctggagttctggcactcataggtgtcccatagcctggcctcacttttctttctgccatatctagagacaatcacctctgtcaacaaagtcctagccttctactggggggaggtgcttggggtacacctactcttgccctcactgacactgtcagcatcacacaacacccgccactcatgatggcaccacacccggggtcaagtgttacccatgtctgaggatggaatccttccccaggattacctatgacccacaactatggtatcatcttcttccaggatttaccatgactaatggtgtcaccatctgccaagactccccatagccaatggtgtcaccatcctccatgattcctcacaaccatggtgtcatcatctttcaggagccaccacagctgacggtgtcatcatctcctagattccaccatgaccagtgatgacattaccttccagaatccactacacctgacagagacatcctctactgaaatccactaggactgatgattccaccatttcccataatccctcatgattttggtgtcatcacctcccaagacccatgatgcccaatagtgtcatcatcatttgcagggatgcatggtgtcatcatctccagggatccacttcaaccatgtgccaccacctcccaggatttcattcaaacatgtgccactacctcccagtatccacttcaactatggtgttatcacctgccaggatccacgagagccaatgctgtcaccatccactaggatccaccataaccctggtgtcatcatctcctgtgatccatgaggtccagtgctgtcaccatccactaggatccaccatgaccctggtgtcatcatctcctgtgatccatgaggtccagtgctgtcaccatccactaggatccaccataaccctggtgtcatcatctcccaggatccatgaggtccagtgctgtctgtcaccatccactagtatccaccataaccctggtgtcatcttctcccaggatccatgaggtccagtgctgtcaccatccactaggatccgccataaccctggtgtcatcatccgtgatccatgaggtccagtgctgtcaccatccactaggatccaccataaccctggtgtcatcatctcccaggatccatgaggtccagtgttgtcaccatctactaggatccaccatgaccctggtgttatcatctcccaggatccatgaggtccagtgttgtcaccatctattaggatccaccatgaccctggtgttatcatctcccaggatccatgaggtccagtgctgtcaccacccactaggatccaccataaccctggtgtcatcccagagtccactgtaaccatgtgccatcatcccccaagagccatcatcttaggagccaagtaccgtgacgggctgtatttcagttgtcctctggggccgcatggtacttacagttgttcacttaaggggaaccagcacaacaggccatattcccgtttccactaaaaggacaggggtggggccagctgtccccctctgaagacttcacccctactctggccctccttatgtcactgcctcactcctgaccgaggatgatgcctgcatcaatcccaccacagatgtggcctcagccaacctcaccttaccccccggtgaggcacccaggccccccctgacagcagcgctgtccctcacccagccatctgattggtgacagggtcaacccagcaacctctcattatcaccagagaggaagcatttcaaccctcaggtgacgccactgccccctgcccaatccctgtcacttgggcccctaccaggatcagcactccactggccccggccaaattctcctcagagatccctgacccccgcgggatgggtcaaagctggtgaccgactggggccttcagtgctgtcttctgctggcctcatcctgcagcagggacactggagagcaatggtccctgccagcacatctgcggggaccaggggtgctccttcacctccctccctaacaccttaacacccggggagcctccgggggtggcaggaagtccccagcacccaatgcacaatcttccctcaattctctttgtacatagccatgttgcgggggcggccattcccccactcttaaagggctacacgcccctcccccagcccctagggcgaggtggggggggcctcttcttcctcccctgggccgtccccctccctcttatgtctccccgcaaacactggcacctcacactccttcttgtcaggagcttggggcagacaactggcccttggttcccaccacactgaggaaatgggggttacccaaatccacctgggccctggtgccagtttttcaaccccacggcttctagctgctctgaggggctcctcccatcccttccagggcctccccagccccgcactgctcaggccaactgtgacttccccagaaaggagccagcttgagcacccaccccctcccagccccctcccctctgctcaacacctccgcggaacactcagctttctccagctgccgggatttgggggtctgggcctttcagcttttttatcccccctccactagctctagcccagcctggattccagggatcccacccctagccctgtccctattcagttggcacaggctgcctgaccctggggccttgatttgatctcaaataagccatagaggagagaggtcttgaggggtgggagcaggtgtgtactgacaattcccctccacatgtcttgagctgggacctcgtcatctgagacttccccatgccccaacaaatgcaaatgcacacaaacccatgcatacacaagcacacacacacaggcatctccccgtctggttgggggagcatgggagggggcacttcacagggagaagataaatagttccacacctgaagaccctccaacagcttctgcctccctcctcatcacttcctctctccaccccctctccaacactggccccttcccctaattaattccctggtgaggacagccagaggagctgcgacttggtattttttggaataaatagacattttcctg

SEQ ID NO: 53211 - DNA, 1571 bp, Homo sapiens
tgagtagctggaactacaggcaagtgccaccatggggatctggccatgttgcccaggtgggtcgtaaactcctggcctcaagcagccctcctgcttcagcctcctgagtagctgggactaccgctgcacaccagcaggccctgccaattgactgcttttacagtgagtgcacccagggcggccgcagatggcagtgtctctggggacagcagctgcgaatgagtccacgggccaatgctgagctgctcaggctgaggcggtgtgctcagcacagagcccccggaactggcatctgcagggcgtgagccaaggccgccgcgatgccgcacttcctggactggttcgtgccggtctacttggtcatctcggtcctcattctggtgggcttcggcgcctgcatctactacttcgagccgggcctgcaggaggcgcacaagtggcgcatgcagcgccccctggtggaccgcgacctccgcaagacgctaatggtgcgcgacaacctggccttcggcggcccggaggtctgagccgacttgcaaaggggataggcgggcggcaccgggcgccctcccccagcccgccccgcccgcccagcccggagacccccaaggcagagggaggccggcctgttggccctccacgctatccctctgcagcctgggccctcccgacagaggccccaggtgcgctggcagtggaggtggggcacttaggtgcctggctggcccagggcttgctctccgtgtcaagccgactcacccagagcccaccctcccaagctcaggggcatcctccgctgggccccagtgcctttgcgctgcgcagcactctgccctccactggactcaggcatgtctatggctgcctgtcctgaggctccggagccctcatttcttcgtgaagtccccagctcccctgcctccactcaatggcaccggccctgcaactttaggcaggtcgaagccaacccaaggaaagaacctaagaacctcgtttggagggatgtcagcttgggccagaccagccgcaccccgcggggctcaggcttggaactggtgagggtgtgtggtgggggtatgcagagggataagaccgtggtagaggagagggttggtgaggagagagagagagagagagagagagtctggggggagcgggcaagcatggggagatgagatgtgtatatgtgagagagagtgtgggggccccaggcagggcaggaggtggtggaaacggggtgaactccgtgggctgtgtgaggactgtccatagtgggtcccaaccccctccctctgctggagtttcctagcccttccccctccccaagactgtggcagcaggcaggagcccctgccctccctccctgtcctgtgccacacttctggggccaaacccagcccccttgagccaggccctgccagactccaagcccaccctagaaccctcctcctgtgtggagactctgttgccccactttggacacagattggcaacctgcctcaccccgccccccttcgctggggcttccatcttaatttattctcaataataaagacttcatgatgatctct

SEQ ID NO: 53212 - DNA, 1494 bp, Homo sapiens
ggactgccccctcctggcccactcagagcccctgggtgtgagaagctcgtctcccgtgggttgcattggctctgccctatctctgcctccagcacccagggcggccgcagatggcagtgtctctggggacagcagctgcgaatgagtccacgggccaatgctgagctgctcaggctgaggcggtgtgctcagcacagagcccccggaactggcatctgcagggcgtgagccaaggccgccgcgatgccgcacttcctggactggttcgtgccggtctacttggtcatctcggtcctcattctggtgggcttcggcgcctgcatctactacttcgagccgggcctgcaggaggcgcacaagtggcgcatgcagcgccccctggtggaccgcgacctccgcaagacgctaatggtgcgcgacaacctggccttcggcggcccggaggtctgagccgacttgcaaaggggataggcgggcggcaccgggcgccctcccccagcccgccccgcccgcccagcccggagacccccaaggcagagggaggccggcctgttggccctccacgctatccctctgcagcctgggccctcccgacagaggccccaggtgcgctggcagtggaggtggggcacttaggtgcctggctggcccagggcttgctctccgtgtcaagccgactcacccagagcccaccctcccaagctcaggggcatcctccgctgggccccagtgcctttgcgctgcgcagcactctgccctccactggactcaggcatgtctatggctgcctgtcctgaggctccggagccctcatttcttcgtgaagtccccagctcccctgcctccactcaatggcaccggccctgcaactttaggcaggtcgaagccaacccaaggaaagaacctaagaacctcgtttggagggatgtcagcttgggccagaccagccgcaccccgcggggctcaggcttggaactggtgagggtgtgtggtgggggtatgcagagggataagaccgtggtagaggagagggttggtgaggagagagagagagagagagagagagtctggggggagcgggcaagcatggggagatgagatgtgtatatgtgagagagagtgtgggggccccaggcagggcaggaggtggtggaaacggggtgaactccgtgggctgtgtgaggactgtccatagtgggtcccaaccccctccctctgctggagtttcctagcccttccccctccccaagactgtggcagcaggcaggagcccctgccctccctccctgtcctgtgccacacttctggggccaaacccagcccccttgagccaggccctgccagactccaagcccaccctagaaccctcctcctgtgtggagactctgttgccccactttggacacagattggcaacctgcctcaccccgccccccttcgctggggcttccatcttaatttattctcaataataaagacttcatgatgatctct

SEQ ID NO: 53213 - DNA, 1571 bp, Homo sapiens
tgagtagctggaactacaggcaagtgccaccatggggatctggccatgttgcccaggtgggtcgtaaactcctggcctcaagcagccctcctgcttcagcctcctgagtagctgggactaccgctgcacaccagcaggccctgccaattgactgcttttacagtgagtgcacccagggcggccgcagatggcagtgtctctggggacagcagctgcgaatgagtccacgggccaacgctgagctgctcaggctgaggcggtgtgctcagcacagagcccccggaactggcatctgcagggcgtgagccaaggccgccgcgatgccgcacttcctggactggttcgtgccggtctacttggtcatctcggtcctcattctggtgggcttcggcgcctgcatctactacttcgagccgggcctgcaggaggcgcacaagtggcgcatgcagcgccccctggtggaccgcgacctccgcaagacgctaatggtgcgcgacaacctggccttcggcggcccggaggtctgagccgacttgcaaaggggataggcgggcggcaccgggcgccctcccccagcccgccccgcccgcccagcccggagacccccaaggcagagggaggccggcctgttggccctccacgctatccctctgcagcctgggccctcccgacagaggccccaggtgcgctggcagtggaggtggggcacttaggtgcctggctggcccagggcttgctctccgtgtcaagccgactcacccagagcccaccctcccaagctcaggggcatcctccgctgggccccagtgcctttgcgctgcgcagcactctgccctccactggactcaggcatgtctatggctgcctgtcctgaggctccggagccctcatttcttcgtgaagtccccagctcccctgcctccactcaatggcaccggccctgcaactttaggcaggtcgaagccaacccaaggaaagaacctaagaacctcgtttggagggatgtcagcttgggccagaccagccgcaccccgcggggctcaggcttggaactggtgagggtgtgtggtgggggtatgcagagggataagaccgtggtagaggagagggttggtgaggagagagagagagagagagagagagtctggggggagcgggcaagcatggggagatgagatgtgtatatgtgagagagagtgtgggggccccaggcagggcaggaggtggtggaaacggggtgaactccgtgggctgtgtgaggactgtccatagtgggtcccaaccccctccctctgctggagtttcctagcccttccccctccccaagactgtggcagcaggcaggagcccctgccctccctccctgtcctgtgccacacttctggggccaaacccagcccccttgagccaggccctgccagactccaagcccaccctagaaccctcctcctgtgtggagactctgttgccccactttggacacagattggcaacctgcctcaccccgccccccttcgctggggcttccatcttaatttattctcaataataaagacttcatgatgatctct

SEQ ID NO: 53214 - DNA, 1494 bp, Homo sapiens
ggactgccccctcctggcccactcagagcccctgggtgtgagaagctcgtctcccgtgggttgcattggctctgccctatctctgcctccagcacccagggcggccgcagatggcagtgtctctggggacagcagctgcgaatgagtccacgggccaacgctgagctgctcaggctgaggcggtgtgctcagcacagagcccccggaactggcatctgcagggcgtgagccaaggccgccgcgatgccgcacttcctggactggttcgtgccggtctacttggtcatctcggtcctcattctggtgggcttcggcgcctgcatctactacttcgagccgggcctgcaggaggcgcacaagtggcgcatgcagcgccccctggtggaccgcgacctccgcaagacgctaatggtgcgcgacaacctggccttcggcggcccggaggtctgagccgacttgcaaaggggataggcgggcggcaccgggcgccctcccccagcccgccccgcccgcccagcccggagacccccaaggcagagggaggccggcctgttggccctccacgctatccctctgcagcctgggccctcccgacagaggccccaggtgcgctggcagtggaggtggggcacttaggtgcctggctggcccagggcttgctctccgtgtcaagccgactcacccagagcccaccctcccaagctcaggggcatcctccgctgggccccagtgcctttgcgctgcgcagcactctgccctccactggactcaggcatgtctatggctgcctgtcctgaggctccggagccctcatttcttcgtgaagtccccagctcccctgcctccactcaatggcaccggccctgcaactttaggcaggtcgaagccaacccaaggaaagaacctaagaacctcgtttggagggatgtcagcttgggccagaccagccgcaccccgcggggctcaggcttggaactggtgagggtgtgtggtgggggtatgcagagggataagaccgtggtagaggagagggttggtgaggagagagagagagagagagagagagtctggggggagcgggcaagcatggggagatgagatgtgtatatgtgagagagagtgtgggggccccaggcagggcaggaggtggtggaaacggggtgaactccgtgggctgtgtgaggactgtccatagtgggtcccaaccccctccctctgctggagtttcctagcccttccccctccccaagactgtggcagcaggcaggagcccctgccctccctccctgtcctgtgccacacttctggggccaaacccagcccccttgagccaggccctgccagactccaagcccaccctagaaccctcctcctgtgtggagactctgttgccccactttggacacagattggcaacctgcctcaccccgccccccttcgctggggcttccatcttaatttattctcaataataaagacttcatgatgatctct

SEQ ID NO: 53215 - DNA, 1241 bp, Homo sapiens
atggaacagcggaaccggctcggtgccctcggatacctgccgcctctgctgctgcatgccctgctgctcttcgtggccgacgctgcattcacagaagtccccaaagatgtgacagtacgggagggagacgacatcgaaatgccctgcgcgttccgggccagcggagccacctcgtattcgctggagattcagtggtggtacctcaaggagccaccccgggagctgctgcacgagctggcgctcagcgtgccgggcgcccggagcaaggtaacaaataaggatgcaactaaaatcagcaccgtacgcgtccagggcaatgacatctcacaccggcttcggctgtctgccgtgcggctgcaggacgagggcgtgtacgagtgccgcgtgtcggactacagcgacgacgacacgcaggagcacaaggcccaggcgatgctgcgcgtgctctcgcgcttcgcgccgcccaacatgcaggccgccgaggccgtgtcccacatccagagcagcggcccgcgtcgccacggcccagccagcgccgccaacgccaacaacgcgggcgccgcgagccgtaccacctccgagcccggccgcggcgacaagagcccgccgcccgggagccctcccgccgccatcgatcccgcagtccccgaggccgcggcagcctcggcggcccacacgcccaccaccacagtcgcggcagctgctgctgcctcgtcagcgtcgccgccatcgggacaggcggtcctgctgcgccagaggcacggctcgggcaccggccgtagctacaccacagacccactcttgtccctgctcctgttagctctgcataagttcctgcgcctgctcttgggacattgacagacaagaccaacccgagcatctcagaggccgcacatgacctgcccggggccctcggtgaggaccatgtcgctggatggacacagagagactgagagacgcatgaaaaagtccacatggaaaataaataaatcatatttttgggaaagttacacaaatgtagaacacctaaaataatgcatctagtttccaaataatttggagtttggcccatgcagtctgcatgggaatcaatgatttctctacttcaatgtagttttcttttctacactttccctccaagtcttcattttgcacgaactgttgagcagttatctttaggataatatgtacaaatgttggggtcaaagccttttgacaaagcaaaatatttttagtagatt

SEQ ID NO: 53216 - DNA, 1241 bp, Homo sapiens; identical to SEQ ID NO: 53215

SEQ ID NO: 53217 - DNA, 1411 bp, Homo sapiens
gggccgggcttcggcgcagaggcaggaagaggaagcggcacccgcttcggggacccagccggcggccaggccaccgcgcccacccggccgatggcaccgtgttcctgcgcctcgggagggaggaggctctgcgcgggactgcaggttctgccccgcatcggagtgatcgctgagcctgacgctctcgaaggctgggcctggggcccgcaatctactccggaggctttcccactgggcagggtcgctagcagggtgccacccgggtgcagtgaggacctggagcccctgccccaggctgtgaggagacttgaccagagctgcctgaatgctccacggagcaggaggaagcattcccatgtgaaagatgagctccctataaaagcaacgctcttatcatcgagaacagaaagttgaagccaagagagagctccacaagctgaccttgttaaactaacccttatcttcttagtcgcttctttacccaattaactaccctagccgaagcccctttgccttattacattttgcaacagtgttcgttgtccaattcagtatacaagtgagtgactctggatgctttttggggtcttcgtttccttatgagggcttctgtgccatgtaaaacttgtattaaataaatttgtatgcttttctcctgttaatctgtctatatcgattgaactttagggtccagtcagaacccaaagaggatggaggtggagttttggctcctctacagctatctgaataatcaaaattcaagatattccatgttctttctgagtttctttgaaattaaaaatgcagacaaccactcaactaatacgtcagcgagatacgttttctgtccttattgccttactgatgaaattgcctttattcataaaaaataaatgtgggagtcttgtttatttatttctaatgacattaacttgacattaaccttggtgctcttgggaaccataaatgggccctgtactacttgttacagagtataaattcccagaactacaagtacatcatattcctcaagttactgaagaatttcatgatccatgtgtcaggcctctgagcccaagctaagtcatcatatcccctgtgacctgcacgtatacatccagatggccggttcctgccttaactgatgacattccaccacaaaagaagtgaaaatggcctgttcctgccttaactgatgacattgtcttgtgaaattccttctcctggctcatcctggctcaaaagctcccccactgaataccttgtgacccccaactcctgcccgccagagagccacccccctttttcctttacctacccaagtcctataaaacagcgccacccctatctccctttgctgactctcttttcggactcagcccacttgcacccaggtgattaaaagctttat

SEQ ID NO: 53218 - DNA, 1411 bp, Homo sapiens; identical to SEQ ID NO: 53217

SEQ ID NO: 53219 - DNA, 1242 bp, Homo sapiens
aagcctactcagcaaccaggaaaaagcatgtgttcctgatgtctgtgagcaccagtctgagatgcgcggatgcttcagcatgcctccagaagcagagaaagaacaaaagcactggaaccggtctccggttgcctctagactcagagaagctgggtctaagtgtagtgttagctgcagatacctgctcagctggctaagcctttaacatggaaagaaggctcataaagaaggaaatgaaaaagctcttgggagattatattggcatcagacttcgggaaaatgaatttgacccaaaaggaagacggcaactcacctttctagatgatatggcacactatgacttggccatcagtgttgctttgcaatggctggatccctcagaagacttaacttggctggagtgggaggaactgaaaataccactccatggcagacccatatatccaaatcgtagagaacgagaagctatgattttatcatcttatgctggaatcttaatgaacagtatcccgattgaggaagtctttaaaatttatggggctgattcttctgccgattctggtaccatcaaggttccccgagtttcatctctctgcctctccttgcacccctttgccatgttaacagcacccaaagcagcagcatacgcccgcaaacagagtgtcaagtcaagaaaggtaacaacaaataaaaatgccaccagcatctctgcaaaggaagcaaatgccacagaatggaaatcatcacaaaggttttcagacacacagccaaagcacaaagtcacttagaaaattggaattgtaccatggaacttcataatagattctctgggagcagacgagaagcatcatcttaaaaccacagctcttgccagtacatttttctttacaactgtttttggtacaactgcactgaagtgttatttttgatgttgagctttcttcttttagaagcatattgcatggctacattttcttaaaaaaaaaaactgtgaccttatgctacttcattgtgactggaagactgctggagaattcagaaagtatatagtatttctgtgttagagcaagctggctttgtagcacattttacaaatgtgtggcattgaatattgcacagtgatggagtgggaggcagatttccaaagagttaatccaaaataaaattaatctgtcattgattgcctttactgtgttctcatatgaaaagaatgtttaaatcatttcaataaagcattaaaaa

SEQ ID NO: 53220 - DNA, 1123 bp, Homo sapiens
aagcctactcagcaaccaggaaaaagcatgtgttcctgatgtctgtgagcaccagtctgagatgcgcggatgcttcagcatgcctccagaagcagagaaagaacaaaagcactggaaccggtctccggttgcctctagactcagagaagctgggtctaagtgtagtgttagctgcagatacctgctcagctggctaagcctttaacatggaaagaaggctcataaagaaggaaatgaaaaagctcttgggagattatattggcatcagacttcgggaaaatgaatttgacccaaaaggaagacggcaactcacctttctagatgatatggcacactatgacttggccatcagtgttgctttgcaatggctggatccctcagaagacttaacttggctggagtgggaggaactgaaaataccactccatggcagacccatatatccaaatcgtagagaacgagaagctatgattttatcatcttatgctggaatcttaatgaacagtatcccgattgaggaagtctttaaaatttatggggctgattcttctgccgattctggtaccatcaaggttccccgagtttcatctctctgcctctccttgcacccctttgccatgttaacagcacccaaagcagcagcatacgcccgcaaacagagtcacttagaaaattggaattgtaccatggaacttcataatagattctctgggagcagacgagaagcatcatcttaaaaccacagctcttgccagtacatttttctttacaactgtttttggtacaactgcactgaagtgttatttttgatgttgagctttcttcttttagaagcatattgcatggctacattttcttaaaaaaaaaaactgtgaccttatgctacttcattgtgactggaagactgctggagaattcagaaagtatatagtatttctgtgttagagcaagctggctttgtagcacattttacaaatgtgtggcattgaatattgcacagtgatggagtgggaggcagatttccaaagagttaatccaaaataaaattaatctgtcattgattgcctttactgtgttctcatatgaaaagaatgtttaaatcatttcaataaagcattaaaaa

SEQ ID NO: 53221 - DNA, 1098 bp, Homo sapiens
aaaagcactggaaccggtctccggttggtgagcgattctcaaaggggaatttgttaagagcaggcacttaatagaacagcccgagagacctgtaccacgattgcagcctctagactcagagaagctgggtctaagtgtagtgttagctgcagatacctgctcagctggctaagcctttaacatggaaagaaggctcataaagaaggaaatgaaaaagctcttgggagattatattggcatcagacttcgggaaaatgaatttgacccaaaaggaagacggcaactcacctttctagatgatatggcacactatgacttggccatcagtgttgctttgcaatggctggatccctcagaagacttaacttggctggagtgggaggaactgaaaataccactccatggcagacccatatatccaaatcgtagagaacgagaagctatgattttatcatcttatgctggaatcttaatgaacagtatcccgattgaggaagtctttaaaatttatggggctgattcttctgccgattctggtaccatcaaggttccccgagtttcatctctctgcctctccttgcacccctttgccatgttaacagcacccaaagcagcagcatacgcccgcaaacagagtcacttagaaaattggaattgtaccatggaacttcataatagattctctgggagcagacgagaagcatcatcttaaaaccacagctcttgccagtacatttttctttacaactgtttttggtacaactgcactgaagtgttatttttgatgttgagctttcttcttttagaagcatattgcatggctacattttcttaaaaaaaaaaactgtgaccttatgctacttcattgtgactggaagactgctggagaattcagaaagtatatagtatttctgtgttagagcaagctggctttgtagcacattttacaaatgtgtggcattgaatattgcacagtgatggagtgggaggcagatttccaaagagttaatccaaaataaaattaatctgtcattgattgcctttactgtgttctcatatgaaaagaatgtttaaatcatttcaataaagcattaaaaa

SEQ ID NO: 53222 - DNA, 1242 bp, Homo sapiens
aagcctactcagcaaccaggaaaaagcatgtgttcctgatgtctgtgagcaccagtctgagatgcgcggatgcttcagcatgcctccagaagcagagaaagaacaaaagcactggaaccggtctccggttgcctctagactcagagaagctgggtctaagtgtagtgttagctgcagatacctgctcagctggctaagcctttaacatggaaagaaggctcataaagaaggaaatgaaaaagctcttgggagattatattggcatcagacttcgggaaaatgaatttgacccaaaaggaagacggcaactcacctttctagatgatatggcacactatgacttggccatcagtgttgctttgcaatggctggatccctcagaagacttaacttggctggagtgggaggaactgaaaataccactccatggcagacccatatatccaaatcgtagagaacgagaagctatgattttatcatcttatgctggaatcttaatgaacagtatcccgattgaggaagtctttaaaatttatggggctgattcttctgccgattctggtaccatcaaggttccccgagtttcatctctccgcctctccttgcacccctttgccatgttaacagcacccaaagcagcagcatacgcccgcaaacagggtgtcaagtcaagaaaggtaacaacaaataaaaatgccaccagcatctctgcaaaggaagcaaatgccacagaatggaaatcatcacaaaggttttcagacacacagccaaagcacaaagtcacttagaaaattggaattgtaccatggaacttcataatagattctctgggagcagacgagaagcatcatcttaaaaccacagctcttgccagtacatttttctttacaactgtttttggtacaactgcactgaagtgttatttttgatgttgagctttcttcttttagaagcatattgcatggctacattttcttaaaaaaaaaaactgtgaccttatgctacttcattgtgactggaagactgctggagaattcagaaagtatatagtatttctgtgttagagcaagctggctttgtagcacattttacaaatgtgtggcattgaatattgcacagtgatggagtgggaggcagatttccaaagagttaatccaaaataaaattaatctgtcattgattgcctttactgtgttctcatatgaaaagaatgtttaaatcatttcaataaagcattaaaaa

SEQ ID NO: 53223 - DNA, 1123 bp, Homo sapiens
aagcctactcagcaaccaggaaaaagcatgtgttcctgatgtctgtgagcaccagtctgagatgcgcggatgcttcagcatgcctccagaagcagagaaagaacaaaagcactggaaccggtctccggttgcctctagactcagagaagctgggtctaagtgtagtgttagctgcagatacctgctcagctggctaagcctttaacatggaaagaaggctcataaagaaggaaatgaaaaagctcttgggagattatattggcatcagacttcgggaaaatgaatttgacccaaaaggaagacggcaactcacctttctagatgatatggcacactatgacttggccatcagtgttgctttgcaatggctggatccctcagaagacttaacttggctggagtgggaggaactgaaaataccactccatggcagacccatatatccaaatcgtagagaacgagaagctatgattttatcatcttatgctggaatcttaatgaacagtatcccgattgaggaagtctttaaaatttatggggctgattcttctgccgattctggtaccatcaaggttccccgagtttcatctctccgcctctccttgcacccctttgccatgttaacagcacccaaagcagcagcatacgcccgcaaacagggtcacttagaaaattggaattgtaccatggaacttcataatagattctctgggagcagacgagaagcatcatcttaaaaccacagctcttgccagtacatttttctttacaactgtttttggtacaactgcactgaagtgttatttttgatgttgagctttcttcttttagaagcatattgcatggctacattttcttaaaaaaaaaaactgtgaccttatgctacttcattgtgactggaagactgctggagaattcagaaagtatatagtatttctgtgttagagcaagctggctttgtagcacattttacaaatgtgtggcattgaatattgcacagtgatggagtgggaggcagatttccaaagagttaatccaaaataaaattaatctgtcattgattgcctttactgtgttctcatatgaaaagaatgtttaaatcatttcaataaagcattaaaaa

SEQ ID NO: 53224 - DNA, 1098 bp, Homo sapiens
aaaagcactggaaccggtctccggttggtgagcgattctcaaaggggaatttgttaagagcaggcacttaatagaacagcccgagagacctgtaccacgattgcagcctctagactcagagaagctgggtctaagtgtagtgttagctgcagatacctgctcagctggctaagcctttaacatggaaagaaggctcataaagaaggaaatgaaaaagctcttgggagattatattggcatcagacttcgggaaaatgaatttgacccaaaaggaagacggcaactcacctttctagatgatatggcacactatgacttggccatcagtgttgctttgcaatggctggatccctcagaagacttaacttggctggagtgggaggaactgaaaataccactccatggcagacccatatatccaaatcgtagagaacgagaagctatgattttatcatcttatgctggaatcttaatgaacagtatcccgattgaggaagtctttaaaatttatggggctgattcttctgccgattctggtaccatcaaggttccccgagtttcatctctccgcctctccttgcacccctttgccatgttaacagcacccaaagcagcagcatacgcccgcaaacagggtcacttagaaaattggaattgtaccatggaacttcataatagattctctgggagcagacgagaagcatcatcttaaaaccacagctcttgccagtacatttttctttacaactgtttttggtacaactgcactgaagtgttatttttgatgttgagctttcttcttttagaagcatattgcatggctacattttcttaaaaaaaaaaactgtgaccttatgctacttcattgtgactggaagactgctggagaattcagaaagtatatagtatttctgtgttagagcaagctggctttgtagcacattttacaaatgtgtggcattgaatattgcacagtgatggagtgggaggcagatttccaaagagttaatccaaaataaaattaatctgtcattgattgcctttactgtgttctcatatgaaaagaatgtttaaatcatttcaataaagcattaaaaa

SEQ ID NO: 53225 - DNA, 2355 bp, Homo sapiens
tgggcggcggcggcagcagcgcggctcggtctctggtccattcactccacgctttctgcagccgccactgcagccgcgcggcgggggctccctccttgcagccagccggcggtccagcctggtgcctctgcaaaggaaaggggagcgtggagacgtgttcgaggtggtatcggcgaggatctctcgggcgccgctcactccttggtcgccttgcttgccagcagttgctcccttagtccttggctcgctcgcacaccccctcccgctacagggagcagttttgggtggcgtgggctccgtcctcttcttggctggtaggaacggtgtgcccaagaggggaagcctagtgggcctggcccctcccagccccgcgccaatgagtgccagggcgccgaaggagctgaggctggcgttgccgccgtgtctcctcaaccggacctttgcttcccccaacgccagcggcagcggcaacacgggtgcccgcggcccaggcgcagtaggcagcggcacctgcatcacgcaggtgggacagcagctcttccagtccttctcctccacgctggtgctgattgtcctggttaccgtcatcttctgcctcatcgtgctgtccctctccactttccacatccacaagcgtaggatgaagaagcggaagatgcagagggctcaggaggaatatgagcgggatcactgcagcggcagccgcggtggcggggggctgccccgacctggcaggcaggccccaacccacgcaaaggaaacccggctggagaggcagccccgggactctcccttctgcgccccttccaacgcctcgtcgttgtcctcttcgtcccctggcctcccgtgccagggtccctgtgctcctccgcctccaccgccagcctccagtccccaaggagcacacgcagcttcctcctgtttggacacagctggcgagggccttttgcaaacggtggtactgtcctgatcgtctagcccctctcgttccccgtcctcgtttccagcatctttgccacccttgcttttttccttcttccttccttttccattttcctctggcccctctttcctcttcctggtttccttacctgccctccccttactcttgtttctcctccgccgaggcactgtgcggtatttgtaaatattgggcgaggaaagtctcggaagaagaaataacgctgataataatactttattaatatttatagtaattattataatactaataacacaatccaagcgcatgacaaatcacataatttctaactgtcaatggaggatgcatcttccctttccaccccgcgctcacctcaattaggaggagaaaccgcacaagctaccaaatatataaaaggcattgattcccggagcaaagggaggggagggggcccggtaatgtacatagctgtcaagttaagatttagtttccttccttcccctctgacccctaagctttcacttttcctttagcttccctttcctccccattcccaccctcagccgggctcaggcaatagtatattataaagaaaatgtctacattaagcaccaggactgcaagaggccatagagaatagtccccggaaagtgtttatgacaggtacccctcgccagtcggcccatttctcaccctttggttaaccattacattttccaggacagagcatttaatttactttttaaaatgaccctcgctggccgagcataagtacgttaaaatctttaaatgagttttttttaaaaagctaacgctttcattccctgccccgcccccacccgtacacctttgacttgtgacattttcaggatttacaaaggatctgggagctgtccagccaggtctggtgctgaagtcgcctcaccgttctgattacttcctctagttgtgaaggcagaggaggggctgttttggaaagtgactattctggcttttggttgggttctttcttctttttctacaatcgagttagcgtgtactattggttttcttattattaaacattgcataagttaccttttttgtaaaaaaaaaaaagtattaggtgatgtgcagtactgaaagtgcagtatctaaccaactagaacgtttgttttatttttagaacaagtgcacctttgttatatatttagtatattggtaccaaatacagaaaaaaactatagttctgtactatgtcctccaaactgtatattattgttcttaatttccagctgttgatataatggttaccactggatgagaaattcagtggtgcagacctggcttctgctgtttccagaagtgttcttttgtaccttattctgtagtagactgttataaaaagatgacacacaaaaaaaaaaaaaaaa

SEQ ID NO: 53226 - DNA, 2520 bp, Homo sapiens
atgagaaatgagaaattcactatcagaagtcttacctggattgtctctgctcctgcgcgccaggcagcgctccacttccgcggcttcgcccttgacagcgccctgtggatcttccgattcggtaccccgaacccctgtagacgtggcctagggagccccggaccgccggcccctgcggctcccaaagccgaagaacttcttcaaggtggtgagttcttctcagacccccaaccactggctcctgagccgcgtctgcgatctagcccagaatccgcgatcccgcctggtccacccttcagcagcgacactggcggcctccgacctctcagacctagtgagcctcgcaaagccgcccggctcccggaagccgcaggtgcaggcgccgctgggctcgcgggttctcctgggctggccagggctgccccaggaccacggacggaaaatcgcaggcgcgcggcccaccccgccttaaggggagggcccgcctggccgtgtagcccgccccgctcctccttccgaagagagatctggtgctggcatgggcaccccgcggccaccggagtggcttcccggatgagcctggcttcggcgctgacgctctggccctgggggctgcctggctggtgtcaggtagcggaagacgcctggagagtcactcgctccttcccccacccgcccccaccgctgctcgtgccaggacgcgcagtttgcagttgcagctctggcactggcgcgggatggcggagcttcccttggatggcgtcagggtcactgagtgcacagcctacctggtctgagggtctgctcctcctggacacctctccggatcctgatccctggcgctgggcaatccacaggatgagactcatcggctgctggcgaagccgaccgcctgactttgctgcctgggcggctggccccgggatccgcgctgctggggacgcgggcctggtctgcggtgtccagccacttgctgcgggcgcgccacgtctaggctggtggctgcagccgcagctccgcgcctgcgggggctagtgggcctggtacctgatgtcctcagggtcaagtgcatcgctcccccacctgagggtctgctctgccttgacctcctccaagagcgcaggggccaccggggaggcaatttaggaatgcctaaatggaaggaactatcctttctctgtctttaagaaataagtggcttttgttgttgtttttgtgatacccagctacagcagaaagcaaaggggatgcagaggtgaaggtccacagccagttcctctactgattccctccaggcataaatgttcaatctaacggctttggttggcactttcacctcagcacttacctatgcctacaggtttgttcaatggcaactcttggattttgaattaatacccaattatttcatattttaatacccaaactattttaatagtttaccatatctgcaatcctgaattaattttttctttgtttataaaacaatcactatagtaagataaaaatcacaaaacacttccacatttcattgggctaaaaaagcattaaaacattatacgtaaaagataaaaaatatattgtttcatcataaaaattatggctttgcaaattttttttacctttagctacattcttacgattctttaacttttcactgttattttatacatttttaaaacaatgcataccagtgtttaaaaaacaaatgcagcatttcatctaggactgaacatataacgctggtcagctctttcagcatggtgcaggtgtgggcctcaggctgctttctgtttacatgtatcaaatgacatgaccatcttaactgcacagataccatcttctcggcttctttcttctcccccaaaactatttaatgttgctttaatggcaacatcaatttaactagttttgtaatttctgtatttaattgtcacataacattatatccgttctttttttttttaaaaaaaaaggaaagcatacaatcttagttgctaggccagttcttctgaatcaatttgaaatcaccttttttctctttcataataactacttattttaatcaacaagtcaactattattagatattaacttattttttctagttaaaattttgctatctttcaaataattccaactcttacacacacatttaatgtacataactgtaacatatacatacataagcacaggttaagccagatctaacatgaatttagatatgccaagaaagccacatgaccattatttacataaatatgaccagtgttcacatttatcaaggccaatgaatattaaggtgattgcttcaataagaaattaggtgaagaattatttgttgaatattgtcaaacactttttttaacctgttaaagttatttaagcctgacccaaataatttttaaactttttattctatcatgcctatagacagcttcatatattaaccatttctgctttcgtggtcctttgagaatggtatcttagtatgtaagtgcaataaataaacaactttta

SEQ ID NO: 53227 - DNA, 3093 bp, Homo sapiens; identical to SEQ ID NO: 5435

SEQ ID NO: 53228 - DNA, 7029 bp, Homo sapiens
tggcattggtgacctttggaaggagtgtttacatggtcatgctctttgttgatgttgatgctattgctttctgtttgttaattttctttctaacagtcaggcccttcttctgctggtctgctggagttttctgggggtccactccataccctgtttgcatgggtatcaccagcagaggctgcagaacagcaaagattgctgcctcctcctacttctggaagctgtgtcccagaggggcacctgccagatgctagccagagctctcctgtatgaagtgtctgtcgacccctgttgggagatgtctccccatcaggaggcatgggggtcagggacccacttgtggaagcagtctgtcccttagcggagctccagtgctgtgctaggagatctgctgctctcttcagagctggcaggtgggaatgtttaagtctgctgaagctgcgctcacagctgccccttcccccaggtgctctgtccccaggagatgggagttttatctataagcccctgactagggctactggctttctttcagagatgccctgcccagagaggaggaatctagagaggcagtctggcttcagtggctttgcagcgctgcagtgggctccactcagactgaacttcctggcagctttgtttacactgtgaggggaaaactgcctactcaagcctcagtaatggcagatacctctcccccaaccaagcttgagcatcccaggtctacttcagactgctgtgctggaagtaagaatttcaatccagtggatcttagctttctgggctccatgggggtgggatctactgatcaagaccacttggctccctggtttcagccccctttccaggggagtgaatggttctgtctctctggcattccagacaactctggggtacgaaaaaaactcctacagctagctcagtgtctgcccaaatggccactcagttttgtgcttgaaatccagggcccttgtggtgtaggcacccaagggatctccttgtctgtggattgcgaagaccatgggaaaagcgtagtatctggaccggagtgcacccccactcacggcatggtccctcatggcttcccttggctaggggagggagttccccaaccccttgcacttcccaggtgaggcaatgccccaccctgcttctgcttgccctccgtgggctgcacccactgtctaaccagtcccagtgagatgaaccgagtacctcagttggaaatgcagaaatcacccactttctgtgttggtcttgctgggagctgcagacagctgttcctattcggccatcttgcctgggaatctgtaattatattttattgcatattcttcctaggctgggtgtgtgtgtgtgaaagagagagagaaacagaaacagagacaaggagacagagacagtgaaacagaaacagagtcatcttccaggttctacttattaagcaatatcccatgaagtagctgaaaagtgttatattctcctaatacctagtgtttgcaaatctggcagctgtcactgatgatttaaacaagattgggtgacttatttatgtacacacacatccacaatcaaacttcaacagtcgagtgtacccttttctaaataatcacgttgctaaaatgtgccacatggcccatttctttaaacaataaatggtaaattattattttggggagtgaaagctaaaagaaataatatgtctaatacgatgtggcattttctctatacagtacagttttagcattgaaaaggacctcagcaattccatttgccccgttttcagatgaggagattgaggctggtagttacagtggttttgcttcatgtcccatcccactggggctgctatgcaagctctcagtctagtcttctttcctctgcacttggtggccatcagctgtaacaagtcctgactagacaagggctttgttgttgactacaattcaatgccttttttgcctgcgtttgtttggaccctgctaatcaaggctacagggcagctgcagaaagacacctgctattggcttacctgctcctcgccttccctctgcttgggtctgagcatcagaaagccaccttccagtgggtctttgcctagcttttgtcttgtctttgctttttattcatctttgcttttgtcttctcagggcaaataggaaatcctagacctcagatcactgttctttgcttcccaaaagacagaacagctcagtcctggctgccaccttctttctttactcttggtttaaatgtaatcccacatgccctagacaagcctcctgatgatttttcatcaaacatgaaaatagcttacttttaactgctgggtgtcagtctcttctaaaaattttgttcctaaggaattgattttgcaaatcagtgctaaagtcactttttaactgcctcacatactatcatttctttgacaattctttttaaaggggattgctcttttctccttctggtttctcaaatctacttttaacttcaaatagcaggcatgcaatgtagttttataagataatatactaggaccatctatcagatatgaaaccaagcataatcattgcaattatttctactgtattcagataatgataatacaaataagagtacgacatacgtaaatgttgattagctttctggttccttcatcaaaacttgcgttgtgttgtgcagccttttctttgcattgtccaggggttttgttattacaaaccataatatttaacccatttcttctactaatatcttttaatatttatgctattatatagctttttatttttgacatgtatctaaaccagaaaaaaatattccttgtacatgatatttttaggcaaaacataatgtctggagcaccaagtgaaataactgtggagaatggaatgttggacaatttgtgtggcatgcttagcttaatttgtttctatggcacaagcaaagctcattaattccatttattattttaagccacttgtttggtgttatggattttaagaatcagttggtgttagaatttttaataacacagagaaagccattgaatatggaactcaaattatctaaggtttacccagaagtcaaaatcacctggccctctgtaaatttctctttgtgttcctaggcccacaaagtctttggtctgaagactcagagcttaaattgcattggtcctgttaatctttgtcaaaaaggaagtttgggcggcagtttcagggtagtgttgagaagataactcctggtcccattttattctttcctcatttgttcagtgctcatggccatctacaaccttccttgattctattctgcctaagcctcttatttccacatctataagtatagtgctacataataattacaacctttaagaaaatggagagttttcattaaagggcccctgcaaatctatgatgctagatgacagattctaccagaaggccagagtattaatagcacccgtgataactgtaataagaatatgtctcgttttcttttaaagacatagatattccattttaatcctgtataactcaaagaaaatttgggtgttaacactttgaaatacctttacctcctttgggggaaatccaaactgaaaggaattaatatccacatcagttcctaaagcaaaatgcctgacacagactaacaaagctctttctcatcctgtggtaggaacttaggagtgataactcacattgagaacttgtgatctgaaagcactaaggaatttctgccattgcaggtaggaaaaaaaaagacaaaaatggtattctcaggtgagcttacctttcaaatttttctgagacttcctaaatgtgacaagaactctgctgtgtggcaaccttatgtatccacaacagaactaaggaccgaaaaaaaaaaaaaaaagatctctatcccaatagattttataaaatccatactctaaaactcctgagttttacatgtaccctaaaacttaaagtatagtaaaaaaaagaaaagaaagaaaaactctttaaccctttgtttaaatcctattaactcttaacgatacacagttcgaattatctaaatgaaataattttcaagcacataacagattagaaacagagaatgagaaaggtatagtagatattatgtaaataagcagaaataatggcaataattaaacacactatctctacctaaaagaacagagatagaaaactcatataaaaatctaaactacagttttatggggatagttaaggtaagagcctgcaggcagcactgtattgctttacaaaacagcatttcatttgtattatgatgatttcagactatcaatttaaaaattcattagtataaattaagaacaggtaccattttctccagatacttccccttcatctgtcctgaaattattaattattgacttctacttaaataagatcttattttcatctgctggaaaactttttctgataaccatacatatcttcaatgtctacaatttgaatggagagccctttcaatgtggcgtttctgtttcttccataacctcacaacgatatgtggtggccccgcagtcattatggtcttgttaaataattagatttgtgtaaactatattttagagtcttccaaaacgcctctccttccaaaatggctaaaagggcaaagcgtcagtaattctgtagacatgcttcatgcatgttctgaataggagctatggtataatgagatgctatctctggaaaaaaatgaatagattttcaagattgtgagtcctgacatgagttctctagaattttcccctttgataaattttcctttacctagctgttgccaaattgtctcttctagaagaatgcccagattttttttcagttccaaagttatcaaaatcccaggaatatttcacagaaaagagaagcatttatagcaagcatgggtgtggcatgctttctctgtgggaagttgtcatcctccacaagatcttgcccacactcaaaacaaacttgcttcccatcacattcttggtttgtcagcactctgtaaaaggaaatctcatctcctgtctgttgatagtagagcttatatcaaactgggacatgtttcttcttcattcatgaataagtctaattttctctccggtgtgtaaaactgacaatacccacaagatactactgacttggaagtttcactgcaggtagctaccataccagcatttggtaaactagctccctaggtgagacagcattagatgacctccttcgtgccacactacttgccagtatccactgggagacaaattatgattgttgcgtccttctttgaaaacacccctgctgagtacctactgtatgtgagtcactgtgcaggcactagaaatataaagcaaaaaaaacagattctacccaccgggagctcctagtccagtggtgaagaggtgtattaaccctcaaggccctaagaaaatccccaatagggctctgcacaagccgggctctgataggaggtgccagtgcttttcttcttccagtttcagagccccagcgatcccaggatgaaggagagcccatttgcaaccctcttctgtctccctaagcattcaacaaacacttagtgaccatctgtcttgtgcaaaaagcttggggagtgataaaaacaaatcaaattcacattttaatttagggagtttaggagatacatcctagtgtggatttcacatggtcaatgatttgctttccttgaatttgccctctgcaaccaacacctgttcgtgctatgagactgaagtcctcctagaccgccccattcatctgagtagttagggctctggatgaaggagcaaatggacaaaataagccccctcttgctcaggacctgactaacatttcagaactgcggtcacccattttatacaaaccaaagcacttctgacagacctctgaatttgcattaaaaagagcacgtctacagctcctaacaatcaaaaacaactatgaacactgcttgcttcagtgatacaaacagacattttcttgttacatgtgtggtgatctgagaatggtgactttggacccagtttgactggttagcgtttaaataaaacttaacagactaggcaactaaaggaactcagtaaaagatcaaaagcaatgctcaaagggagtgcctgggtaaccatgatgtaattgcagattgacacatctttgggtttttcattattgtttctaaaaactagatattattgctttattattatgttgatgatgattattgaaagcacgatagcaatgtttaagtggtgagaatgactctaagcctctttttgttgctgtgactgacagaactaaagggagtttgctctcacattcacaataccaactctgccatcttatggaaaatattggaagtacctagggcatttcattatatttcaaaggcacaggttgctggtaagagggacagaaagacaagaacatagtaccttctatttctactacatgtttttaatctttaacatttttaccagcagaaatcattttttttttaaatctctcaatcttcaaataattcttagattgcttgccagcaaagatgtctcttgatcttgacactggaattcaatgtaaaaatcttgaatgatattttgtactgatatgaatttctactgtcccataacactgtgtagtgacttcactgtatattaacttcttttctacagatgtttgacttatgagatgaattaattgaaaaagtcaaagcctatcaggagctatcttatatgatgttggtagcctgtgaaaaaataaatgtcttttttcttatacaaactgataacaagacttgctttcacaattactatttacatttttgtgcatataatgcctgtatattatactcatatttgaaagtgatcagaaagtgttatttaacagaaactacatacattttttatgtctctctggaccctttgattctaagtaaatttacagtaagttagcagtaatagactattcttttcaactatgaataaaaatgtacact

SEQ ID NO: 53229 - DNA, 1281 bp, Homo sapiens
atgaaagcagctttccataagacacgctcaccagtgcgccatgacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaaatcgaggcacctccaccaacagcccacgctgctggtagatgagcacgcgcagctggagccggtgagcctgcggccgtgcttcggagactacagtgacgagagtgactcggccatcgtctatgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcttctttactgcctattacgccatcgaagtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtgtcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaagatatctacctggagtag

SEQ ID NO: 53230 - DNA, 1827 bp, Homo sapiens
cgagcacgagcgggaggtgctgcacaaggcgctggaggagaataacaacttcagccgccaggcggaggagaagctcaactacaaatggagctcagcaaggagatccgcgaggcgcacctggccgcactgcgcgagcggctgcgcgaggagctgcacgcggccgaggtgcgcaggaacaaggagcagcgagaggagatgtcgggctaagggcccgggacgggcggcgcccatcctgcgagagaacacgttcgggttttggttttgtttcgttcacctctgtctagatgcaacttttgttcctcctcccccacccccgcccccagcttcatgcttctcttccgcactcagccgccctgccctgtcctcgtggtgagtcgctgaccacggcttcccctgcaggagccgccgggcgtgagacgcggtccctcggtgcagacaccaggccgggcgcggctgggtcccccgggggccctgtgagagaggtggcggtgaccgtggtaaacccagggcggtggcgtgggatcgcgggtccttacgctgggctgtctggtcagcacgtgcaggtcagggcaggtcctctgagccggcgcccctggccagcaggcgaggctacagtacctgctgtctttccaggaggaaggggctccccatgagggaggggcaacgggggaggcgggtgatggtgtctgggagcctgcgtgtgcagccggagcttgttgaactggcagggggtgggtgggggctgcagctttccttaatgtggttgcacaggggtcctctgagaccacccggcctgaggtggacaccctgggccttcctggaagcctgcagttggggacctgccctgagtctgctggggagtgggcattctctgccagggacccatgagcaggctgcatggtctagaggttgtgggcagcatggacagtcccccactcagaagtgcaagagttccaaagagcctctggcccaggcgcctccggctttgcagatgtccttgaaagacccaccctagagccctttggagtgctggcccctcctgtgtcctctgccctggtggaagtggcagccacaagtcctcctcagggagccccaagggggattttgtgggaccgctgcccacagatccaggtgttggaagggcagtgggtaaggttcccaagccagcccccacacccttcccacttggcacccagagggggctgtgggtcgaggcctgactctaggcctctcctgcccacaccctctgggctgagttccttctttcccttgaatgcccagtgctggccttggaggatggtcagctggaggacggcggtgggggaggctgtctttgtaccactgcagcatcccccacttctccacagaagccccatcccaaagctgctgcccgaccccttgctgtaaaatgtgaagggggtggctgagttctcttaggacccagagccagggccctcagcttccatcctgcgggaggccttggccgggcactgccagcgtcttccagagccacaccagggaccacgggaggatcctgacccctgcagggctcaggggtcagcacggacccactgccccatctccctctccccaccaagacagccccagaaggagcagccagctgggatgggaacccaaggctgcccacatgtggcttttgtgggactcagaaagggaagcagaaccgagggctgggatattactcatggtggcagctctcatagtgcaagcctactgtaatatgcacccatctcatccatgtagtaaagtgaacttaaaaattaaatgaacaattaaataaacacctgtgtgtttaagacatgaaaa

SEQ ID NO: 53231 - DNA, 1858 bp, Homo sapiens
cgagcacgagcgggaggtgctgcacaaggcgctggaggagaataacaacttcagccgccaggcggaggagaagctcaactacaaatggagctcagcaaggagatccgcgaggcgcacctggccgcactgcgcgagcggctgcgcgaggagctgcacgcggccgaggtgcgcaggaacaaggagcagcgagaggagatgtcgggctaagggcccgggacgggcggcgcccatcctgcgagagaacacgttcgggttttggttttgtttcgttcacctctgtctagatgcaacttttgttcctcctcccccacccccgcccccagcttcatgcttctcttccgcactcagccgccctgccctgtcctcgtggtgagtcgctgaccacggcttcccctgcaggagccgccgggcgtgagacgcggtccctcggtgcagacaccaggccgggcgcggctgggtcccccgggggccctgtgagagaggtggcggtgaccgtggtaaacccagggcggtggcgtgggatcgcgggtccttacgctgggctgtctggtcagcacgtgcaggtcagggcaggtcctctgagccggcgcccctggccagcaggcgaggctacagtacctgctgtctttccaggaggaaggggctccccatgagggaggggcaacgggggaggcgggtgatggtgtctgggagcctgcgtgtgcagccggagcttgttgaactggcagggggtgggtgggggctgcagctttccttaatgtggttgcacaggggtcctctgagaccacccggcctgaggtggacaccctgggccttcctggaagcctgcagttggggacctgccctgagtctgctggggagtgggcattctctgccagggacccatgagcaggctgcatggtctagaggttgtgggcagcatggacagtcccccactcagaagtgcaagagttccaaagagcctctggcccaggcgcctccgtgggacagccccgccgcccctccccaccagggctttgcagatgtccttgaaagacccaccctagagccctttggagtgctggcccctcctgtgtcctctgccctggtggaagtggcagccacaagtcctcctcagggagccccaagggggattttgtgggaccgctgcccacagatccaggtgttggaagggcagtgggtaaggttcccaagccagcccccacacccttcccacttggcacccagagggggctgtgggtcgaggcctgactctaggcctctcctgcccacaccctctgggctgagttccttctttcccttgaatgcccagtgctggccttggaggatggtcagctggaggacggcggtgggggaggctgtctttgtaccactgcagcatcccccacttctccacagaagccccatcccaaagctgctgcccgaccccttgctgtaaaatgtgaagggggtggctgagttctcttaggacccagagccagggccctcagcttccatcctgcgggaggccttggccgggcactgccagcgtcttccagagccacaccagggaccacgggaggatcctgacccctgcagggctcaggggtcagcacggacccactgccccatctccctctccccaccaagacagccccagaaggagcagccagctgggatgggaacccaaggctgcccacatgtggcttttgtgggactcagaaagggaagcagaaccgagggctgggatattactcatggtggcagctctcatagtgcaagcctactgtaatatgcacccatctcatccatgtagtaaagtgaacttaaaaattaaatgaacaattaaataaacacctgtgtgtttaagacatgaaaa

SEQ ID NO: 53232 - DNA, 1272 bp, Homo sapiens
atgctgcagatggacctgatcgacgcgacgggggacactcccggggccgaggaggacgacgacgaggagcgcgcggcccggcggccgggagcggggccgcccaaggccgagtccggccaggagccggcgtcccgcggccagggccagagccaaggccagagccagggcccgggcagcggggacacgtaccggcccaagcggcccaccacgctcaacctctttccgcaggtgcagttgtctcaggacacactgaataataattctctgggcaaaaaatcgaggcacctccaccaacagcccacgctgctggagctggtgagcctgcggccgtgcttcagagactacagtgacgagagtgactcggccatcgtctacgacaactgtgcctccgtctcctcgccctatgagtcagccatcggagaggaatatgaggaggcctcccggccccagcctcctgcctgcctctccaaggactccacgcctgacgaacccgacgtccatttctccaagaagttcctgaacatcttcatgagtggccgctcccgctcctccagtgccgagtccttcgggctgttctcctgcatcatcaaccgggaggagcaggagcagacccaccggaccatattcaggtttgtgcctcgacacgaagacgaacctgagctggaagtggatgaccctctgctagtggagctccaggctgaagactactggtacgaggcctacaacatgcgcactggtgcccggggcatctttactgcctattacgccatcgaggtcaccaaggagcccgagcacatggcagccctggctaaaaacagtgactgggtggaccagttccgggtgaagttcctgggctcagtccaggttccctatcacaagggcgatgtcgtcctctctgccgctatgcaaaagattgccaccacccgccggctaaccgtgcactttaacccgccctccagctgtgtcctggagatcagcgtgcggggtgtgaagataggtatcaaggccgatgactcccaggaggccaaggggaataaatgtagccactttttccagttaaaaaacatctctttccgcggatatcatccaaagaacaacaagtactttgggttcatcaccaagcacctcgccgaccaccggtttgcctgccacgtctttgtgtctgaagactccaccaaagccctggcagagtccgtggggagagcattccagcagtttcacaagcagtttgtggagtacacctgccccacagaaaatatctacctggagtag

SEQ ID NO: 53233 - DNA, 3546 bp, Homo sapiens
cactgcgctctgcctgccggtggtgtctggatttctataggaatcccaggagggtcttactggagggttgagagccacctgattgaaggcgtttgcagtcagagtaaagacggctgccgcagcatgaacccctgagctgatgagtcttattatagcccggctggcggaagacagagtgctgctattcacctctgcgtgggcgtcggtggtgcagggggaagcagcaggccatccagcggctcacaccctacgcggctgcagctgccaagggcctggcccctgcctccctcgggccatggtgagctgtggcggggctagaggaaccgggacccaggactgacaggcggcgcacccaggggctcctctctccccagagcgacagggcccggagagccgtgggcctcaccatgctggcgccgggcagcagccctgggcagaggggcaggctcgccctgcagtggaggcaagtctcctggatcacctgctggatcgccctgtatgctgtggaggccctccccacctgccctttctcctgcaagtgtgacagccgcagcctggaggtggactgcagtggccttggcctcaccacggtgcccccagacgtgcccgcagccacccgaaccctcttgctcttgaacaataagctgagtgccctgccaagctgggctttcgccaacctctccagcctgcagcggttggacctgtccaacaacttcctggaccggctgccccgctccattttcggggacctgacgaatctgactgagcttcagctgcgcaataacagcatcaggaccctggacagggacctgctgcggcactcgccgctgctccgccacctggacctgtccatcaacggcctggcccagttgccccctggtcttttcgacgggctcctggctctgcgctccctctcgcttcgctccaaccgtctgcagaatctggaccggctgacatttgaacccctagcaaacctgcagctgctgcaggtcggggataacccctgggagtgtgactgtaacctgcgtgagttcaaacactggatggagtggttctcctaccgagggggacgcttggaccagcttgcctgcaccctgcccaaggagctgagggggaaggacatgcggatggtccccatggagatgttcaactactgctcccagctggaggacgagaatagctcagctgggctggatattcctgggccaccctgcaccaaggccagtccagagcctgctaagcccaagcccggggctgagccggagccggagcccagcacagcctgcccacagaagcagaggcaccggccggcgagcgtgaggcgagccatgggcacggtgatcattgcaggggtcgtgtgcggcgtcgtctgcatcatgatggtggtggccgctgcctatggctgcatctacgcctccctcatggccaagtaccaccgggagctcaaaaagcgccagcccctgatgggggaccccgagggcgagcacgaggaccagaagcagatctcttctgtggcctgagcgcccatccccacccggccaggtaggaagggcggggagagcacacggcattgctcagccacagctcccaccttgacccggcgctggccactgcctccccgagtccaccctcctccccgccctccagcagacaagccacaccgggttctctccctgcactttcgaggctccctgaaagccaccgtgctgggggctcctgctgatgctcctgtctgggccagtaaatctttggaacatgtgggggatctccctaagctctggccacagcaaagcaaggaggtgtgtgcaagaggaggcttccggactgggcattcccctgtcgcccttcctgccctggggtggccatagctggtgactcttcctaccttgctggtcccacctcacctgcattgaggggacggggagggagggatctgagggatgaaggtagatttctgagactctctcctaagccagaaagacgttcttaacacccctgcagtgtgaaagctggtccagctctacaactgttggtaccaatgtgcaaacacaccagccctgccatctggacccagcactcagaaacaccatacacccctggccgacgccatcatgcccctggatctgctataggccacactgaccacatgctcctggattcgctaattcactcacacacccattgcatcaccagtgcggtcacatggattgaaagaattaatacacacacacacacacacacactcacacggtcacacggagaccgaggctatgagcgctcgaacagcagagacatgctcttccccaggggtctccctgagaccacagagcctctcgcgtgctcactgcaatcttctcaagtcaacagcaggaaggaactcaaccagtaacaccaggatcctttgagatcctctaaagtgggccaaagtggtgcccctggaggagccctcctgtcaccatggtaaccctctcacacctctcctgctgggctttcccgggataccacccaggggcctggagcggctgcatgtgtgcatggcggcctcctgaggacccagccacacaccactggtgttgcctcggtcctgcccacgcatctcacagcaccaggccctgtggggcccccactgattcctccacagcctgcagcctggcaccgtgactctgtgcctctcgccctccatcttcagtactcctggcctgtgacttcagggctgggacttggtggtgctttgccattggtggcaccctctggggaaagcaggtggcaggcagagaacacggtggctcccctgaggctcattgcctgccagcttattgcagacagagcccaggagcaggagcgggtggccacgtgctgcccagaggctcccaggatggggcctctgttcccgggctttgtctgctcagtgtggctccctagagcacccagccggggccaaaccagagagtgggtggggagcctgtctgggacagagccacctgctgccaaggcagtgcaagttttccaggttacctgtccccctccctagctctgcccctcctcagagtgtgaagatggtgggtacctaggtgtcatgctcacaggctcaggaggcatcaggctcgtccctggctctgggatggaatctcgatgggggctcaggaagaggccagcaagaaccctgaagccaagggtctgagcagagggagttggcaggcctagctcctgtgccccactccgaccctccctgctcatgcggcagtgggtgggtgaggtgggctgggggcctggaggagtgcctttgaggaggtcagtcctggcaggtggacagaggacgcctggcatgggctgcttactgggaccccaggcggccctggccatggccacagtcttccttcttttggcgtgtgggctggtaccagatctggggattttctaaagggactggggggaggggagggcattgtcaatggtggtatctttagcctgagacagaagatttttaaaggcaaaattatatttctggtttgttgtttcagaagaccaataaagactgtattttcc

SEQ ID NO: 53234 - DNA, 3967 bp, Homo sapiens
gcagctaattgagatagaccttcttattttacagctaagaaaactaaaactcataagtaattaaataaattaaataattttcacaagatgacacagccaggattcaaccgtgggtcttcccagcagggaaatgaggctgcatccctgtcagcacccagctttgcatccccaggcagcactgatacgtgttcctgggatgtgaggtttgctgcaggccaccgaggtgtcagccgcacaggggaactaggccgggtgtcttcagaccctcctctcctgtggtcgccgggaactgaattcccagcacaaaaatgcatgccatgagaatgtgcagttttcagactttttcaatagcggagttgctttcaacattgcatttcttaaaaacaaaatcctggaatatttccatcggcatcccagggaaagattgatgcctattgtatgaggagacttgcggcagatgggctgcagagggagctgccagtgacggagtggctgcagcccgcatcttttcggcagggggtctagtgcctgcatccagatttcactggaagctgaaagagggccagaatccaactttcacttcctaggggaggtctagacagattattgtcctcaaccaccttctctctcaccccagccctgtcctgcatctgtgtctccctctgtccaagccagcctccaccatcatcatgaagacatcctggcgagcccgtgcgcccaggtacccacacctcctcatcaacaccagcctcctctccttggcctcgtgtgcctccaggattccccctccagatgcctttgtacttacagggctgtggttggggcaccgatggggccattggattgctcctaaggaggagaaggagaacattcctgcccaactcttttcctctttacgccaggaagggagctgcccattcttaggcaaccaaaaggtcttgcgtggaggggcagcggcaggggcagtgggttttgactgctgtcctttgagtgagaggtaagaaccctagaaggataagatgctgtgttgagaacggtatcctgggctcacagacaggtgatgagcaggcagattcgggggcagagagtgtggcagggacgctcagctctctaatgacagccctttcctgggaacctccccatgttagcactgccttactctgtgggtccgtttggcctgggagaggacaggccggatggaagtggctgcgtgcttctctataaaatgggaataaagacaatatccatttcacatggcttctgcgaggatgaaatggcacgatatacgtaactcactgtggacttggctcaatcaatgctgttttccctcctccgcttcctcttctatagatggtgattccaggattgactacattgctgataaaaactaccttctggggcttccgttttggggagctggggatggggagagggagtgcaagttctagatgcctggtcagcccctctttttctcttctgcatgtagggggacgcttggaccagcttgcctgcaccctgcccaaggagctgagggggaaggacatgcggatggtccccatggagatgttcaactactgctcccagctggaggacgagaatagctcagctgggctggatattcctgggccaccctgcaccaaggccagtccagagcctgctaagcccaagcccggggctgagccggagccggagcccagcacagcctgcccacagaagcagaggcaccggccggcgagcgtgaggcgagccatgggcacggtgatcattgcaggggtcgtgtgcggcgtcgtctgcatcatgatggtggtggccgctgcctatggctgcatctacgcctccctcatggccaagtaccaccgggagctcaaaaagcgccagcccctgatgggggaccccgagggcgagcacgaggaccagaagcagatctcttctgtggcctgagcgcccatccccacccggccaggtaggaagggcggggagagcacacggcattgctcagccacagctcccaccttgacccggcgctggccactgcctccccgagtccaccctcctccccgccctccagcagacaagccacaccgggttctctccctgcactttcgaggctccctgaaagccaccgtgctgggggctcctgctgatgctcctgtctgggccagtaaatctttggaacatgtgggggatctccctaagctctggccacagcaaagcaaggaggtgtgtgcaagaggaggcttccggactgggcattcccctgtcgcccttcctgccctggggtggccatagctggtgactcttcctaccttgctggtcccacctcacctgcattgaggggacggggagggagggatctgagggatgaaggtagatttctgagactctctcctaagccagaaagacgttcttaacacccctgcagtgtgaaagctggtccagctctacaactgttggtaccaatgtgcaaacacaccagccctgccatctggacccagcactcagaaacaccatacacccctggccgacgccatcatgcccctggatctgctataggccacactgaccacatgctcctggattcgctaattcactcacacacccattgcatcaccagtgcggtcacatggattgaaagaattaatacacacacacacacacacacactcacacggtcacacggagaccgaggctatgagcgctcgaacagcagagacatgctcttccccaggggtctccctgagaccacagagcctctcgcgtgctcactgcaatcttctcaagtcaacagcaggaaggaactcaaccagtaacaccaggatcctttgagatcctctaaagtgggccaaagtggtgcccctggaggagccctcctgtcaccatggtaaccctctcacacctctcctgctgggctttcccgggataccacccaggggcctggagcggctgcatgtgtgcatggcggcctcctgaggacccagccacacaccactggtgttgcctcggtcctgcccacgcatctcacagcaccaggccctgtggggcccccactgattcctccacagcctgcagcctggcaccgtgactctgtgcctctcgccctccatcttcagtactcctggcctgtgacttcagggctgggacttggtggtgctttgccattggtggcaccctctggggaaagcaggtggcaggcagagaacacggtggctcccctgaggctcattgcctgccagcttattgcagacagagcccaggagcaggagcgggtggccacgtgctgcccagaggctcccaggatggggcctctgttcccgggctttgtctgctcagtgtggctccctagagcacccagccggggccaaaccagagagtgggtggggagcctgtctgggacagagccacctgctgccaaggcagtgcaagttttccaggttacctgtccccctccctagctctgcccctcctcagagtgtgaagatggtgggtacctaggtgtcatgctcacaggctcaggaggcatcaggctcgtccctggctctgggatggaatctcgatgggggctcaggaagaggccagcaagaaccctgaagccaagggtctgagcagagggagttggcaggcctagctcctgtgccccactccgaccctccctgctcatgcggcagtgggtgggtgaggtgggctgggggcctggaggagtgcctttgaggaggtcagtcctggcaggtggacagaggacgcctggcatgggctgcttactgggaccccaggcggccctggccatggccacagtcttccttcttttggcgtgtgggctggtaccagatctggggattttctaaagggactggggggaggggagggcattgtcaatggtggtatctttagcctgagacagaagatttttaaaggcaaaattatatttctggtttgttgtttcagaagaccaataaagactgtattttcc

SEQ ID NO: 53235 - DNA, 2780 bp, Homo sapiens
tctcctccctcgcccctttcttccctctctcctctctctctctccctccatccctctctttccttctcagtttgtgactgacccagcagccccgtcccccgtctgccacaagcagtccacctcctggtgctgtgtgctgcgtgccagccgctgctcccgctgagtggagactctggcaccagtgcccactgcgctctgcctgccggtggtgtctggatttctataggaatcccaggagggtcttactggagggttgagagccacctgattgaaggcgtttgcagtcagagtaaagacggggggacgcttggaccagcttgcctgcaccctgcccaaggagctgagggggaaggacatgcggatggtccccatggagatgttcaactactgctcccagctggaggacgagaatagctcagctgggctggatattcctgggccaccctgcaccaaggccagtccagagcctgctaagcccaagcccggggctgagccggagccggagcccagcacagcctgcccacagaagcagaggcaccggccggcgagcgtgaggcgagccatgggcacggtgatcattgcaggggtcgtgtgcggcgtcgtctgcatcatgatggtggtggccgctgcctatggctgcatctacgcctccctcatggccaagtaccaccgggagctcaaaaagcgccagcccctgatgggggaccccgagggcgagcacgaggaccagaagcagatctcttctgtggcctgagcgcccatccccacccggccaggtaggaagggcggggagagcacacggcattgctcagccacagctcccaccttgacccggcgctggccactgcctccccgagtccaccctcctccccgccctccagcagacaagccacaccgggttctctccctgcactttcgaggctccctgaaagccaccgtgctgggggctcctgctgatgctcctgtctgggccagtaaatctttggaacatgtgggggatctccctaagctctggccacagcaaagcaaggaggtgtgtgcaagaggaggcttccggactgggcattcccctgtcgcccttcctgccctggggtggccatagctggtgactcttcctaccttgctggtcccacctcacctgcattgaggggacggggagggagggatctgagggatgaaggtagatttctgagactctctcctaagccagaaagacgttcttaacacccctgcagtgtgaaagctggtccagctctacaactgttggtaccaatgtgcaaacacaccagccctgccatctggacccagcactcagaaacaccatacacccctggccgacgccatcatgcccctggatctgctataggccacactgaccacatgctcctggattcgctaattcactcacacacccattgcatcaccagtgcggtcacatggattgaaagaattaatacacacacacacacacacacactcacacggtcacacggagaccgaggctatgagcgctcgaacagcagagacatgctcttccccaggggtctccctgagaccacagagcctctcgcgtgctcactgcaatcttctcaagtcaacagcaggaaggaactcaaccagtaacaccaggatcctttgagatcctctaaagtgggccaaagtggtgcccctggaggagccctcctgtcaccatggtaaccctctcacacctctcctgctgggctttcccgggataccacccaggggcctggagcggctgcatgtgtgcatggcggcctcctgaggacccagccacacaccactggtgttgcctcggtcctgcccacgcatctcacagcaccaggccctgtggggcccccactgattcctccacagcctgcagcctggcaccgtgactctgtgcctctcgccctccatcttcagtactcctggcctgtgacttcagggctgggacttggtggtgctttgccattggtggcaccctctggggaaagcaggtggcaggcagagaacacggtggctcccctgaggctcattgcctgccagcttattgcagacagagcccaggagcaggagcgggtggccacgtgctgcccagaggctcccaggatggggcctctgttcccgggctttgtctgctcagtgtggctccctagagcacccagccggggccaaaccagagagtgggtggggagcctgtctgggacagagccacctgctgccaaggcagtgcaagttttccaggttacctgtccccctccctagctctgcccctcctcagagtgtgaagatggtgggtacctaggtgtcatgctcacaggctcaggaggcatcaggctcgtccctggctctgggatggaatctcgatgggggctcaggaagaggccagcaagaaccctgaagccaagggtctgagcagagggagttggcaggcctagctcctgtgccccactccgaccctccctgctcatgcggcagtgggtgggtgaggtgggctgggggcctggaggagtgcctttgaggaggtcagtcctggcaggtggacagaggacgcctggcatgggctgcttactgggaccccaggcggccctggccatggccacagtcttccttcttttggcgtgtgggctggtaccagatctggggattttctaaagggactggggggaggggagggcattgtcaatggtggtatctttagcctgagacagaagatttttaaaggcaaaattatatttctggtttgttgtttcagaagaccaataaagactgtattttcc

SEQ ID NO: 53236 - DNA, 3677 bp, Homo sapiens
cttccctctctcctctctctctctccctccatccctctctttccttctcagtttgtgactgacccagcagccccgtcccccgtctgccacaagcagtccacctcctggtgctgtgtgctgcgtgccagccgctgctcccgctgagtggagactctggcaccagtgcccactgcgctctgcctgccggtggtgtctggatttctataggaatcccaggagggtcttactggagggttgagagccacctgattgaaggcgtttgcagtcagagtaaagacggctgccgcagcatgaacccctgagctgatgagtcttattatagcccggctggcggaagacagagtgctgctattcacctctgcgtgggcgtcggtggtgcagggggaagcagcaggccatccagcggctcacaccctacgcggctgcagctgccaagggcctggcccctgcctccctcgggccatggactgacaggcggcgcacccaggggctcctctctccccagagcgacagggcccggagagccgtgggcctcaccatgctggcgccgggcagcagccctgggcagaggggcaggctcgccctgcagtggaggcaagtctcctggatcacctgctggatcgccctgtatgctgtggaggccctccccacctgccctttctcctgcaagtgtgacagccgcagcctggaggtggactgcagtggccttggcctcaccacggtgcccccagacgtgcccgcagccacccgaaccctcttgctcttgaacaataagctgagtgccctgccaagctgggctttcgccaacctctccagcctgcagcggttggacctgtccaacaacttcctggaccggctgccccgctccattttcggggacctgacgaatctgactgagcttcagctgcgcaataacagcatcaggaccctggacagggacctgctgcggcactcgccgctgctccgccacctggacctgtccatcaacggcctggcccagttgccccctggtcttttcgacgggctcctggctctgcgctccctctcgcttcgctccaaccgtctgcagaatctggaccggctgacatttgaacccctagcaaacctgcagctgctgcaggtcggggataacccctgggagtgtgactgtaacctgcgtgagttcaaacactggatggagtggttctcctaccgagggggacgcttggaccagcttgcctgcaccctgcccaaggagctgagggggaaggacatgcggatggtccccatggagatgttcaactactgctcccagctggaggacgagaatagctcagctgggctggatattcctgggccaccctgcaccaaggccagtccagagcctgctaagcccaagcccggggctgagccggagccggagcccagcacagcctgcccacagaagcagaggcaccggccggcgagcgtgaggcgagccatgggcacggtgatcattgcaggggtcgtgtgcggcgtcgtctgcatcatgatggtggtggccgctgcctatggctgcatctacgcctccctcatggccaagtaccaccgggagctcaaaaagcgccagcccctgatgggggaccccgagggcgagcacgaggaccagaagcagatctcttctgtggcctgagcgcccatccccacccggccaggtaggaagggcggggagagcacacggcattgctcagccacagctcccaccttgacccggcgctggccactgcctccccgagtccaccctcctccccgccctccagcagacaagccacaccgggttctctccctgcactttcgaggctccctgaaagccaccgtgctgggggctcctgctgatgctcctgtctgggccagtaaatctttggaacatgtgggggatctccctaagctctggccacagcaaagcaaggaggtgtgtgcaagaggaggcttccggactgggcattcccctgtcgcccttcctgccctggggtggccatagctggtgactcttcctaccttgctggtcccacctcacctgcattgaggggacggggagggagggatctgagggatgaaggtagatttctgagactctctcctaagccagaaagacgttcttaacacccctgcagtgtgaaagctggtccagctctacaactgttggtaccaatgtgcaaacacaccagccctgccatctggacccagcactcagaaacaccatacacccctggccgacgccatcatgcccctggatctgctataggccacactgaccacatgctcctggattcgctaattcactcacacacccattgcatcaccagtgcggtcacatggattgaaagaattaatacacacacacacacacacacactcacacggtcacacggagaccgaggctatgagcgctcgaacagcagagacatgctcttccccaggggtctccctgagaccacagagcctctcgcgtgctcactgcaatcttctcaagtcaacagcaggaaggaactcaaccagtaacaccaggatcctttgagatcctctaaagtgggccaaagtggtgcccctggaggagccctcctgtcaccatggtaaccctctcacacctctcctgctgggctttcccgggataccacccaggggcctggagcggctgcatgtgtgcatggcggcctcctgaggacccagccacacaccactggtgttgcctcggtcctgcccacgcatctcacagcaccaggccctgtggggcccccactgattcctccacagcctgcagcctggcaccgtgactctgtgcctctcgccctccatcttcagtactcctggcctgtgacttcagggctgggacttggtggtgctttgccattggtggcaccctctggggaaagcaggtggcaggcagagaacacggtggctcccctgaggctcattgcctgccagcttattgcagacagagcccaggagcaggagcgggtggccacgtgctgcccagaggctcccaggatggggcctctgttcccgggctttgtctgctcagtgtggctccctagagcacccagccggggccaaaccagagagtgggtggggagcctgtctgggacagagccacctgctgccaaggcagtgcaagttttccaggttacctgtccccctccctagctctgcccctcctcagagtgtgaagatggtgggtacctaggtgtcatgctcacaggctcaggaggcatcaggctcgtccctggctctgggatggaatctcgatgggggctcaggaagaggccagcaagaaccctgaagccaagggtctgagcagagggagttggcaggcctagctcctgtgccccactccgaccctccctgctcatgcggcagtgggtgggtgaggtgggctgggggcctggaggagtgcctttgaggaggtcagtcctggcaggtggacagaggacgcctggcatgggctgcttactgggaccccaggcggccctggccatggccacagtcttccttcttttggcgtgtgggctggtaccagatctggggattttctaaagggactggggggaggggagggcattgtcaatggtggtatctttagcctgagacagaagatttttaaaggcaaaattatatttctggtttgttgtttcagaagaccaataaagactgtattttcc

SEQ ID NO: 53237 - DNA, 1689 bp, Homo sapiens
atggccgggccccctgcgggaaccggctgtgacttatggggctgtcccgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcaccgcgtccgtgctgcagcgccggtcccccaatgaggagtacgtggaggtggggcgcctgggaccctctgactacttcggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgagcacagctcccgccctgcagccccagctccccagtgtggtggccgtgccctgctcgtctgtgtcgggggcccgggagccgctgtgtgaggtgtgggccgggtggggctgggtcccggcagcgtgaggactgccccttccccggactcactttttggaataaatgatcaccttgtgcatttccaaatcaaaggacaagcggacaaaatgcatcccaagatcaaggaagggacaggccagcttcctccccacacgcctccccggctgcctctgtgggcttctcctggggggcccaccccacccctgccagtctcctggagatgcttgaggatcggtcctccccagaaccaggccaggacgttgcccctggggcctggtgaccctgtgaggtcaggtcccccagattgaggtctgagtgtgggcaagtgtgtcaaaaggggctgccccccaggggagatgaggctgagagcagggagttgaggccgaagaagtcaaggcccctcccgcaaatgtgtacccctgcccgcgccactgcaccccgccgcacccccacctcccccgggggccctgctgcggatgccggagtgggagagtctctgagctgtgagattgatcttgcccctaattggagaggaagccgggcgccaagacacacggggctcctgccttgggagccagggccgcggccgcaggtagaccccagtagggggggccgggctcgaagttcctttgggaggggctggcgggactccagcaggccgtcctcacctttcttagaaagtccacccagggcaagttgatgttgggggaaagcagaagtcaagccagccgcgggccccacacgccccgacccgctcaaccgacttgtcccttaaatgtgtcttggatcccgcagtgatgacgtgagccagccaggcccgaaagggtgaggccagtgcagagaagcttcccaggggattcctgggttcccccgaaagacaagcgaggtcattgcagttcacctgatgttgctcctgtcccgtgcgtcccggggaggctgtccttggtccgaggctgctcgttgcagcccctcccctgctggcggttacgatgcgtggggtccccctccccacccagccccggccacgtcgccgtgtcccgcctgtgcctgtgacgtccctgtggacctgtgagccatccccccccttatctctgctctgaatactgcatgaagcattaaacgtgcaatg

SEQ ID NO: 53238 - DNA, 2918 bp, Homo sapiens
tctttcttgtgggtgtccacctagcctaaaagccaagtgaagaagaacataaaaaagcagaagaggaaaaatgaagaaaagaggaaaaagagggtggggccagagaaataaagagtaggattagtaagtgaaagaaaaagttgctttgttgtgtggggggggtgttcttgcttgctatactcaattttgctttcccgtgtctgctgtacacaaaacacctgatctctgcaatgtattgctcctttctttcattcacctgtgatgcataagactagattattttcggcatatctactgtttgcaaagtgttactactgaaaaatatccctgaaactgagctctttgggtggataagcaaaggaaaaatagaaaataattaaggtaagggaaaggctaaaggataagcctgtgtataaatgggaaatggataagctcaaatgcattatctggtttcaatgtaacacccaagatttaacaaactcagtgctagaagacttgaaaataagtgtaatttaccaccatctattgagcagctattatgagccaggcactgtgctagggctggggatacataagtgaataatgcacagtcccagaactcagattatttggttttgttttaccaaatccaaatgcagtacctgcatttctcttttccaaactgagatggctatcaaacatgtctttcagaaagtgtttgcaggtgagaagatgcgcaaggtgaaggaaagttttcctgacccagatcttagaaggaaaggagaggatacattttgctttgtggcatatttattgtgggcaaaaagctactattgcctaagggaagtacggctgaccttagcccatccctggggcatatcttgtgcgtgtggtggggagacaaatcaggtagggaacaattccttctcgccttacctctctagcttccatgttcttttatggaacaaatcagattaatactaatgttaaggagagctttaaaggagaaagagaatcaataaatcacagcctgaaagttgtgtatgttgtgtgcaagctcagaggggcagtcttcttcaatttgccttgtgctggtgaattgcttgaatgaacttcggtatttcttaacaccaggtactggagcccaccttctttctctccctctggtttcctctttaaatcacagcctgaccccagtctttatagtccattgtaagtggaagttatagctctattcttcacccacaccttgctccctatcattgatacttagaagaaagtaacaatttgcagtactggctgaactcctttgggaaagtttctggagtgtatcaaataagaattcatcatagtaacatggtcgttactggctgaacaaaattctttttgagactattgtacttagtcattaaataattgtttactaaggcaattttcatgtttctggaattcagtgtaatagttaacagctgtatatgtctcacaaaagaaactacttaggttggaaacaatggaaggttgtgtataattaattcaatcaggtcatgaatatttatgtaacatatggcattttaatttatatgttcccattctcatacttcattactatacagcagcaacaagataaatttcaggttttttgtttttttattaagtgggccatgtctaaaagttgtcacattcctggttgaatattatggacaaaatttccccattaaagtagttttgtctttctcaaggattatcctttagggttgggtggattaaaaacattacattagtgcttcttgagcatacaagtcactagggatcttgtgaaaatacagattccttttagtaggtttgggatgaggaatgaaggtcttcatctctcaaatctcccaggtgatgtggatgctgccagtccatcgaccacactttgagttgggagattctacatcttttgagaaatatccacactgaagcctatactcttaaactttcaaagactctgtgttcatgtctgtgttctgcaagaattttttcttttaagaaataaactgcataaagtaaaatcagaaaaccataacactggttttccaaatttgccacaaatactgtaatactctgtagagtaaaatgcaaagattattcctgttacaagttttctctgtatcaagtgcaggaaaggaacatgggtagagtcatgtaccattcttatcagtcaggagatgacacgtggtaaatttctcttcttgattttcctcttgattatactcacataagggagctccatttggtaacaaagatgaaattctgttcacagttaacaagaatttagcaacttcttgcttggcaaaatctgagacaaccttacaaaaacatcctacattaaattcagaattttgggtagctgcataagctgaagattatggaaaacctgagctgaaaatggcacctggatctgtaacttcttgtcttgaactcttttttgagctttattctgtgagagatcttcccctacagtgattttttctgtttctcctcagtcgctggggtctcagtaaggggtggaggattggtgtaaatgagacagtcacataaattgtctaatttgagcatgccaagtgatttttgtcagcctcttttggtcataaaattttggtatagctattgtgaaatatagtgtcataaatttgtcataagccattaatgaaggaagagaagcagaaatttatttctgtgggaatgcactcaaatatcaagcagatggtgttctacaacatttatttgggaaaatgtgtatctgttacataatctgaaatatgtctttttcacatttaaaaatatttgggtcatgatttagagtttttattggattgttttttaaactgagaggaagaagaaaggtaattgtattttaaaacatttgacatgttactaataaaattttatttctg

SEQ ID NO: 53239 - DNA, 1417 bp, Homo sapiens
aggcggcgagctgagcggctctgacaggacgggtcgcagggggtcgcctggccggagctgggctccgagaatcccgggtgccagcaccagagcagcggctctccgcactaactctcctctcctggtcagctgtaacccctgccgcagagcccggcaactttcagctgtcgcccgcggagccccgagggccactcgcctcacctgtgcgtgcagcgcctcgcgcgccctgtccggctgcggagatgagcgagcttaataccaaaacatccccagcaaccaaccaggcagctggccaagaggaaaaaggaaaagctggcaatgtcaagaaggcggaggaggaggaggagattgacattgatctgacagcaccagaaacagagaaggctgcccttgctattcagggcaagttccggcgatttcagaaaaggaaaaaggatcccagctcctgaatggccaggcttgcccttcaccttcaccttcatgctggtcccttctctccccttctccacacccatgtatctttatcccttgtccctctagcctttccttgaggcaagttcaacctttatatactcttgtatctggccccctcaagccatcacagaagtagaggcacaagagaggtggagaagatgaagacttcaatcagcagtcactagtctaagggtggaacaatttcttcttggtataaggttctttgatcagtagctatgcctgccctgtagggctaaacaagaggcttcgaggctgagagatctccccaaagaacaatgtgggaaggaggggaaggctttcagagtagggtgcctgagggtgggacatatgcactgttctgctagttacggcattcacactttaggtaacattttttttccccttcagatccttctgcaccaactccaacttcccctcccaggatctaagccacagtggggactggagcctcgttttccccctaggcagacctaaatcaagcagcttaccacaatagtgcatgctgagtagattagttccaaggaagggagactggaatgctggtgtcaaggaaaagcctccctcatcatctagtctaagaccataacgggcagaagcataagaggttccagggccataggagaatgagaagtagggcacatatagggaggaaagaaaagtgaagaagggggaaatctctgaatttttttactgctgggaaaagtgtactacatgaaggatgcttggggctttgctaacctgctcaccgctaaccctccaagtctaaccatccccagaggccacacaaaccaagtgactcctgtagttcccatttgccccactatggagtcagggcaaaagtggaatagccactccatgtgattttagcatgtttaatcattttaacaataaaccaccccacaaatggggtcatttaacctct

SEQ ID NO: 53240 - DNA, 3039 bp, Homo sapiens
ctctgtcaccaaaaaaaaaaaaaaattcagtggctggcatagagtcaagaaactctatgaacagaagataactgacttagcagcagcagagtaagcctccaaaaagaagcaagatctttgaaagtggctgggagagctcccaactgaataggcttcagcctcccactgtcagtacttaaggttcaaatgcctcaggctgcgggaggggacggggtggagactggccatgtcggaggtgacctggagtctgctgcagctctggggcgccagttttaggagaggcgccaacttcgacttttggggccagccggtggaggcgatagatgagtatcagatattagcaagacatctacaaaaagaggcccaagctcaacacaataattctgaattcacagaagaacaaaagaaaaccataggcaaaattgcaacatgcttagaattgtgaagtgcagctttacagtccacacagtctcaagaagaatttaaactggaggacctgaagaagctagaaccaatcctaaagaatattcttacatataataaagaattcccatttgatattcagcctgtcccattaagaagaattttggcacctggtaaagaagagaatttggaatttgaagaagaagaagagggtggtgctggagcaggatctcctgattcttttcctgctagagttcccgatgctttagataccagggttgccattggaaccaggaatgacattactcactatcagaattgagaaaattggtttgaaagatgctgggcagtgcatcgatccctatattacagttagagtaaaggatctgaatggcatagacttaactcctgtgcaagatactcctgtggcttcaagaaaagaagatacatatgttcattttaatgtggacattgagctccagaagcatgttgaaaaattaatcaaaggtgcagctatcttctttgaattcaaacactacaagcctaaaaaaaggtttaccagcaccaagtgttttgctttcatggagatggatgaaattaaacctgggccaattgtaatagaactatacaagaaacccactgactttaaaagaaagaaattgcaattgttgaccaagaaaacactttatcttcgtctacatcaaactttgcacaaggaatgatactgacatgatgaacctggaacttctgtgaattttaccagtcagtagaaaccatcatagctctgtgtagcgtattcacccttcaacaggcaggaagcaagccgtacccagaccagtaggccggaaggagtccagtgcaaagctgtaccacagaattcagagtccagcacatcactgacgtataggactcctttggatacaggtttattgtagatttggaaacatgtttttacttttctattaattgggcaattaatagtctattttctaatttaccactactcctaccctgcttcctggaacaatactgttgtgggtaggatgtgctcatcttcaaacttaatacagcaataagaatgtcctagagtttacacatctgttcacttttgctccaatatgctcttttgacttaacttcaagctttgggttgatgtgggtagggtagtgtcaaactgttttaagaggaattggaccagttctgctgcctaagaaggtctgtctggatgtttataggcagctcctctgaagtggcctaaattcaccctgatctgatagttttcctgcctagaaagtgtgccttggccagatcagtatcccacatgggagtgttccctaggttgtagcgtgattgtttccagatgaccagattgtttttctgaaaatgagcatatttttagtcatgttgattagctgttcttctacatcacattgttactctttctgatgatgattctagggttaacattggaaccatctcaaaataattacaaatttttagatgggtttacaatgtcttctaaacaatataatctaaaaataattgagtcagatgctaacgagatactgaaggcataactgctgtttttctggcaactgattatgaaaccttaaaacctgcatacctcttcttatagtgaggaatattcaaaatctggaaagatattctatttttttatataggtagataggatcaccatttatttcctatttagatatactgacattcatccatatgaaaatatgcaggtcattagcttactataattttactatttacttttgacttaatggggcataaataaaactttcttagtacacatgaggtggatatttgatacacagaacatttgtggtgggctttctgtgggttagatgtaaagcccacgtattttaatattcactattttaaatgagcaatgcatgaggggaatgcagtgtcagtacctggcctatttttaaactagtgtaatcaccctagtcataccattcagtatgtttgctttttaaaataagtaaccacaattaagttgttgtagcccttgcacttcaagagatttagtccttcctttcagttgtctgttaggtccattctgtttactagacggatgttaataaaaactatgtgagcctgaacgtattctcggccaaatttagtcttgtctctcatcttgattggattaattctaaagtctaaaatgattcagtccacaatagctctaggggatgaagaatttgccttactttgttgttcgctcagttcctaagactgtgagttgtcaaatccctagactgtaagctcttcaaggagcaagaagcacattttctccgtgtcatgtaatttttctaaggtgcttggcagcactctgtaccctgtggagtactcagtaccttttgtttgatgttgctgacaagacctaaaaaacaatcccttaaaaaaaaaaaccattaaaaggtagcaaaaccgatgtattattttttctcttttctcataaaccgcaagatatgtatatcaaagtgataatttgtatgaagcatctgctatccttcacgtgagtatggtttatatgaactacaaatacctttcatcaacattaaagaagcttaaattgaaaaa

SEQ ID NO: 53241 - DNA, 974 bp, Homo sapiens
ggagacccccaaggcagagggaggccggcctgttggccctccacgctatccctctgcagcctgggccctcccgacagaggccccaggtgcgctggcagtggaggtggggcacttaggtgcctggctggcccagggcttgctctccgtgtcaagccgactcacccagagcccaccctcccaagctcaggggcatcctccgctgggccccagtgcctttgcgctgcgcagcactctgccctccactggactcaggcatgtctatggctgcctgtcctgaggctccggagccctcatttcttcgtgaagtccccagctcccctgcctccactcaatggcaccggccctgcaactttaggcaggtcgaagccaacccaaggaaagaacctaagaacctcgtttggagggatgtcagcttgggccagaccagccgcaccccgcggggctcaggcttggaactggtgagggtgtgtggtgggggtatgcagagggataagaccgtggtagaggagagggttggtgaggagagagagagagagagagagagagtctggggggagcgggcaagcatggggagatgagatgtgtatatgtgagagagagtgtgggggccccaggcagggcaggaggtggtggaaacggggtgaactccgtgggctgtgtgaggactgtccatagtgggtcccaaccccctccctctgctggagtttcctagcccttccccctccccaagactgtggcagcaggcaggagcccctgccctccctccctgtcctgtgccacacttctggggccaaacccagcccccttgagccaggccctgccagactccaagcccaccctagaaccctcctcctgtgtggagactctgttgccccactttggacacagattggcaacctgcctcaccccgccccccttcgctggggcttccatcttaatttattctcaataataaagacttcatgatgatctct

SEQ ID NO: 53242 - DNA, 1514 bp, Homo sapiens
atgagttgtaagcggcagagcccgggactccacagccagggttttctgactcggagacgcggagctctgtctcccatgtcaaagagaaccagtcagaaacgcacggcccgcatcctccgatggatgttccgaaaccgccaggtgtgggatctgcgccccgacagccccaccttggccatcggccgcctgaggacggccagccatcggggcgattccccccacacattccagcccctagcgcagacggcggagagcagagagggagcgcgccttggctcgctggccttggcggcggctcctcaggagagctggggcgcccacgagaggatccctcacccgggtctctcctcagggatgacatcatccgtccacctccttgtcttcaaggaccacctcctctccatgctgagctgctgccaaggggcctgctgcccatctacacctcacgagggcactaggagcacggtttcctggatcccaccaacatacaaagcagccactcactgacccccaggaccaggatggcaaaggatgaagaggaccggaactgaccagccagctgtccctcttacctaaagacttaaaccaatgccctagtgagggggcattgggcattaagccctgacctttgctatgctcatactttgactctatgagtactttcctataagtctttgcttgtgttcacctgctagcaaactggagtgtttccctccccaagggggtgtcagtctttgtcgactgactctgtcatcacccttatgatgtcctgaatggaaggatccctttgggaaattctcaggagggggacctgggccaagggcttggccagcatcctgctggcaactccaaggccctgggtgggcttctggaatgagcatgctactgaatcaccaaaggcacgcccgacctctctgaagatcttcctatccttttctgggggaatggggtcgatgagagcaacctcctagggttgttgtgagaattaaatgagataaaagaggcctcaggcaggatctggcatagaggaggtgatcagcaaatgtttgttgaaaaggtttgacaggtcagtcccttcccacccctcttgcttgtcttacttgtcttatttattctccaacagcactccaggcagcccttgtccacgggctctccttgcatcagcccctctccagctcgaaatccctccacagccacggggacaccctgcacctattcccacgggacaggctggacccagagactctggacccggggcctccccttgagtagagacccgccctctgactgatggacgccgctgacctggggtcagacccgtgggctggacccctgcccaccccgcaggaaccctgaggcctaggggagctgttgagccttcagtgtctgcatgtgggaagtgggctccttcacctacctcacagggctgttgtgaggggcgctgtgatgcggttccaaagcacagggcttggcgcaccccactgtgctctcaataaatgtgtttcctgtcttaa

SEQ ID NO: 53243 - DNA, 3546 bp, Homo sapiens; identical to SEQ ID NO: 53233

SEQ ID NO: 53244 - DNA, 3967 bp, Homo sapiens
gcagctaattgagatagaccttcttattttacagctaagaaaactaaaactcataagtaattaaataaattaaataattttcacaagatgacacagccaggattcaaccgtgggtcttcccagcagggaaatgaggctgcatccctgtcagcacccagctttgcatccccaggcagcactgatacgtgttcctgggatgtgaggtttgctgcaggccaccgaggtgtcagccgcacaggggaactaggccgggtgtcttcagaccctcctctcctgtggtcgccgggaactgaattcccagcacaaaaatgcatgccatgagaatgtgcagttttcagactttttcaatagcggagttgctttcaacattgcatttcttaaaaacaaaatcctggaatatttccatcggcatcccagggaaagattgatgcctattgtatgaggagacttgcggcagatgggctgcagagggagctgccagtgacggagtggctgcagcccgcatcttttcggcagggggtctagtgcctgcatccagatttcactggaagctgaaagagggccagaatccaactttcacttcctaggggaggtctagacagattattgtcctcaaccaccttctctctcaccccagccctgtcctgcatctgtgtctccctctgtccaagccagcctccaccatcatcatgaagacatcctggcgagcccgtgcgcccaggtacccacacctcctcatcaacaccagcctcctctccttggcctcgtgtgcctccaggattccccctccagatgcctttgtactcacagggctgtggttggggcaccgatggggccattggattgctcctaaggaggagaaggagaacattcctgcccaactcttttcctctctacgccaggaagggagctgcccattcttaggcaaccaaaaggtcttgcgtggaggggcagcggcaggggcagtgggttttgactgctgtcctttgagtgagaggtaagaaccctagaaggataagatgctgtgttgagaacggtatcctgggctcacagacaggtgatgagcaggcagattcgggggcagagagtgtggcagggacgctcagctctctaatgacagccctttcctgggaacctccccatgttagcactgccttactctgtgggtccgtttggcctgggagaggacaggccggatggaagtggctgcgtgcttctctataaaatgggaataaagacaatatccatttcacatggcttctgcgaggatgaaatggcacgatatacgtaactcactgtggacttggctcaatcaatgctgttttccctcctccgcttcctcttctatagatggtgattccaggattgactacattgctgataaaaactaccttctggggcttccgttttggggagctggggatggggagagggagtgcaagttctagatgcctggtcagcccctctttttctcttctgcatgtagggggacgcttggaccagcttgcctgcaccctgcccaaggagctgagggggaaggacatgcggatggtccccatggagatgttcaactactgctcccagctggaggacgagaatagctcagctgggctggatattcctgggccaccctgcaccaaggccagtccagagcctgctaagcccaagcccggggctgagccggagccggagcccagcacagcctgcccacagaagcagaggcaccggccggcgagcgtgaggcgagccatgggcacggtgatcattgcaggggtcgtgtgcggcgtcgtctgcatcatgatggtggtggccgctgcctatggctgcatctacgcctccctcatggccaagtaccaccgggagctcaaaaagcgccagcccctgatgggggaccccgagggcgagcacgaggaccagaagcagatctcttctgtggcctgagcgcccatccccacccggccaggtaggaagggcggggagagcacacggcattgctcagccacagctcccaccttgacccggcgctggccactgcctccccgagtccaccctcctccccgccctccagcagacaagccacaccgggttctctccctgcactttcgaggctccctgaaagccaccgtgctgggggctcctgctgatgctcctgtctgggccagtaaatctttggaacatgtgggggatctccctaagctctggccacagcaaagcaaggaggtgtgtgcaagaggaggcttccggactgggcattcccctgtcgcccttcctgccctggggtggccatagctggtgactcttcctaccttgctggtcccacctcacctgcattgaggggacggggagggagggatctgagggatgaaggtagatttctgagactctctcctaagccagaaagacgttcttaacacccctgcagtgtgaaagctggtccagctctacaactgttggtaccaatgtgcaaacacaccagccctgccatctggacccagcactcagaaacaccatacacccctggccgacgccatcatgcccctggatctgctataggccacactgaccacatgctcctggattcgctaattcactcacacacccattgcatcaccagtgcggtcacatggattgaaagaattaatacacacacacacacacacacactcacacggtcacacggagaccgaggctatgagcgctcgaacagcagagacatgctcttccccaggggtctccctgagaccacagagcctctcgcgtgctcactgcaatcttctcaagtcaacagcaggaaggaactcaaccagtaacaccaggatcctttgagatcctctaaagtgggccaaagtggtgcccctggaggagccctcctgtcaccatggtaaccctctcacacctctcctgctgggctttcccgggataccacccaggggcctggagcggctgcatgtgtgcatggcggcctcctgaggacccagccacacaccactggtgttgcctcggtcctgcccacgcatctcacagcaccaggccctgtggggcccccactgattcctccacagcctgcagcctggcaccgtgactctgtgcctctcgccctccatcttcagtactcctggcctgtgacttcagggctgggacttggtggtgctttgccattggtggcaccctctggggaaagcaggtggcaggcagagaacacggtggctcccctgaggctcattgcctgccagcttattgcagacagagcccaggagcaggagcgggtggccacgtgctgcccagaggctcccaggatggggcctctgttcccgggctttgtctgctcagtgtggctccctagagcacccagccggggccaaaccagagagtgggtggggagcctgtctgggacagagccacctgctgccaaggcagtgcaagttttccaggttacctgtccccctccctagctctgcccctcctcagagtgtgaagatggtgggtacctaggtgtcatgctcacaggctcaggaggcatcaggctcgtccctggctctgggatggaatctcgatgggggctcaggaagaggccagcaagaaccctgaagccaagggtctgagcagagggagttggcaggcctagctcctgtgccccactccgaccctccctgctcatgcggcagtgggtgggtgaggtgggctgggggcctggaggagtgcctttgaggaggtcagtcctggcaggtggacagaggacgcctggcatgggctgcttactgggaccccaggcggccctggccatggccacagtcttccttcttttggcgtgtgggctggtaccagatctggggattttctaaagggactggggggaggggagggcattgtcaatggtggtatctttagcctgagacagaagatttttaaaggcaaaattatatttctggtttgttgtttcagaagaccaataaagactgtattttcc

SEQ ID NO: 53245 - DNA, 2780 bp, Homo sapiens; identical to SEQ ID NO: 53235

SEQ ID NO: 53246 - DNA, 3677 bp, Homo sapiens; identical to SEQ ID NO: 53236

SEQ ID NO: 53247 - DNA, 7029 bp, Homo sapiens
tggcattggtgacctttggaaggagtgtttacatggtcatgctctttgttgatgttgatgctattgctttctgtttgttaattttctttctaacagtcaggcccttcttctgctggtctgctggagttttctgggggtccactccataccctgtttgcatgggtatcaccagcagaggctgcagaacagcaaagattgctgcctcctcctacttctggaagctgtgtcccagaggggcacctgccagatgctagccagagctctcctgtatgaagtgtctgtcgacccctgttgggagatgtctccccatcaggaggcatgggggtcagggacccacttgtggaagcagtctgtcccttagcggagctccagtgctgtgctaggagatctgctgctctcttcagagctggcaggtgggaatgtttaagtctgctgaagctgcgctcacagctgccccttcccccaggtgctctgtccccaggagatgggagttttatctataagcccctgactagggctactggctttctttcagagatgccctgcccagagaggaggaatctagagaggcagtctggcttcagtggctttgcagcgctgcagtgggctccactcagactgaacttcctggcagctttgtttacactgtgaggggaaaactgcctactcaagcctcagtaatggcagatacctctcccccaaccaagcttgagcatcccaggtctacttcagactgctgtgctggaagtaagaatttcaatccagtggatcttagctttctgggctccatgggggtgggatctactgatcaagaccacttggctccctggtttcagccccctttccaggggagtgaatggttctgtctctctggcattccagacaactctggggtacgaaaaaaactcctacagctagctcagtgtctgcccaaatggccactcagttttgtgcttgaaatccagggcccttgtggtgtaggcacccaagggatctccttgtctgtggattgcgaagaccatgggaaaagcgtagtatctggaccggagtgcacccccactcacggcatggtccctcatggcttcccttggctaggggagggagttccccaaccccttgcacttcccaggtgaggcaatgccccaccctgcttctgcttgccctccgtgggctgcacccactgtctaaccagtcccagtgagatgaaccgagtacctcagttggaaatgcagaaatcacccactttctgtgttggtcttgctgggagctgcagacagctgttcctattcggccatcttgcctgggaatctgtaattatattttattgcatattcttcctaggctgggtgtgtgtgtgtgaaagagagagagaaacagaaacagagacaaggagacagagacagtgaaacagaaacagagtcatcttccaggttctacttattaagcaatatcccatgaagtcgctgaaaagtgttatattctcctaatacctagtgtttgcaaatctggcagctgtcactgatgatttaaacaagattgggtgacttatttatgtacacacacatccacaatcaaacttcaacagtcgagtgtacccttttctaaataatcacgttgctaaaatgtgccacatggcccatttctttaaacaataaatggtaaattattattttggggagtgaaagctaaaagaaataatatgtctaatacgatgtggcattttctctatacagtacagttttagcattgaaaaggacctcagcaattccatttgccccgttttcagatgaggagattgaggctggtagttacagtggttttgcttcatgtcccatcccactggggctgctatgcaagctctcagtctagtcttctttcctctgcacttggtggccatcagctgtaacaagtcctgactagacaagggctttgttgttgactacaattcaatgccttttttgcctgcgtttgtttggaccctgctaatcaaggctacagggcagctgcagaaagacacctgctattggcttacctgctcctcgccttccctctgcttgggtctgagcatcagaaagccaccttccagtgggtctttgcctagcttttgtcttgtctttgctttttattcatctttgcttttgtcttctcagggcaaataggaaatcctagacctcagatcactgttctttgcttcccaaaagacagaacagctcagtcctggctgccaccttctttctttactcttggtttaaatgtaatcccacatgccctagacaagcctcctgatgatttttcatcaaacatgaaaatagcttacttttaactgctgggtgtcagtctcttctaaaaattttgttcctaaggaattgattttgcaaatcagtgctaaagtcactttttaactgcctcacatactatcatttctttgacaattctttttaaaggggattgctcttttctccttctggtttctcaaatctacttttaacttcaaatagcaggcatgcaatgtagttttataagataatatactaggaccatctatcagatatgaaaccaagcataatcattgcaattatttctactgtattcagataatgataatacaaataagagtacgacatacgtaaatgttgattagctttctggttccttcatcaaaacttgcgttgtgttgtgcagccttttctttgcattgtccaggggttttgttattacaaaccataatatttaacccatttcttctactaatatcttttaatatttatgctattatatagctttttatttttgacatgtatctaaaccagaaaaaaatattccttgtacatgatatttttaggcaaaacataatgtctggagcaccaagtgaaataactgtggagaatggaatgttggacaatttgtgtggcatgcttagcttaatttgtttctatggcacaagcaaagctcattaattccatttattattttaagccacttgtttggtgttatggattttaagaatcagttggtgttagaatttttaataacacagagaaagccattgaatatggaactcaaattatctaaggtttacccagaagtcaaaatcacctggccctctgtaaatttctctttgtgttcctaggcccacaaagtctttggtctgaagactcagagcttaaattgcattggtcctgttaatctttgtcaaaaaggaagtttgggcggcagtttcagggtagtgttgagaagataactcctggtcccattttattctttcctcatttgttcagtgctcatggccatctacaaccttccttgattctattctgcctaagcctcttatttccacatctataagtatagtgctacataataattacaacctttaagaaaatggagagttttcattaaagggcccctgcaaatctatgatgctagatgacagattctaccagaaggccagagtattaatagcacccgtgataactgtaataagaatatgtctcgttttcttttaaagacatagatattccattttaatcctgtataactcaaagaaaatttgggtgttaacactttgaaatacctttacctcctttgggggaaatccaaactgaaaggaattaatatccacatcagttcctaaagcaaaatgcctgacacagactaacaaagctctttctcatcctgtggtaggaacttaggagtgataactcacattgagaacttgtgatctgaaagcactaaggaatttctgccattgcaggtaggaaaaaaaaagacaaaaatggtattctcaggtgagcttacctttcaaatttttctgagacttcctaaatgtgacaagaactctgctgtgtggcaaccttatgtatccacaacagaactaaggaccgaaaaaaaaaaaaaaaagatctctatcccaatagattttataaaatccatactctaaaactcctgagttttacatgtaccctaaaacttaaagtatagtaaaaaaaagaaaagaaagaaaaactctttaaccctttgtttaaatcctattaactcttaacgatacacagttcgaattatctaaatgaaataattttcaagcacataacagattagaaacagagaatgagaaaggtatagtagatattatgtaaataagcagaaataatggcaataattaaacacactatctctacctaaaagaacagagatagaaaactcatataaaaatctaaactacagttttatggggatagttaaggtaagagcctgcaggcagcactgtattgctttacaaaacagcatttcatttgtattatgatgatttcagactatcaatttaaaaattcattagtataaattaagaacaggtaccattttctccagatacttccccttcatctgtcctgaaattattaattattgacttctacttaaataagatcttattttcatctgctggaaaactttttctgataaccatacatatcttcaatgtctacaatttgaatggagagccctttcaatgtggcgtttctgtttcttccataacctcacaacgatatgtggtggccccgcagtcattatggtcttgttaaataattagatttgtgtaaactatattttagagtcttccaaaacgcctctccttccaaaatggctaaaagggcaaagcgtcagtaattctgtagacatgcttcatgcatgttctgaataggagctatggtataatgagatgctatctctggaaaaaaatgaatagattttcaagattgtgagtcctgacatgagttctctagaattttcccctttgataaattttcctttacctagctgttgccaaattgtctcttctagaagaatgcccagattttttttcagttccaaagttatcaaaatcccaggaatatttcacagaaaagagaagcatttatagcaagcatgggtgtggcatgctttctctgtgggaagttgtcatcctccacaagatcttgcccacactcaaaacaaacttgcttcccatcacattcttggtttgtcagcactctgtaaaaggaaatctcatctcctgtctgttgatagtagagcttatatcaaactgggacatgtttcttcttcattcatgaataagtctaattttctctccggtgtgtaaaactgacaatacccacaagatactactgacttggaagtttcactgcaggtagctaccataccagcatttggtaaactagctccctaggtgagacagcattagatgacctccttcgtgccacactacttgccagtatccactgggagacaaattatgattgttgcgtccttctttgaaaacacccctgctgagtacctactgtatgtgagtcactgtgcaggcactagaaatataaagcaaaaaaaacagattctacccaccgggagctcctagtccagtggtgaagaggtgtattaaccctcaaggccctaagaaaatccccaatagggctctgcacaagccgggctctgataggaggtgccagtgcttttcttcttccagtttcagagccccagcgatcccaggatgaaggagagcccatttgcaaccctcttctgtctccctaagcattcaacaaacacttagtgaccatctgtcttgtgcaaaaagcttggggagtgataaaaacaaatcaaattcacattttaatttagggagtttaggagatacatcctagtgtggatttcacatggtcaatgatttgctttccttgaatttgccctctgcaaccaacacctgttcgtgctatgagactgaagtcctcctagaccgccccattcatctgagtagttagggctctggatgaaggagcaaatggacaaaataagccccctcttgctcaggacctgactaacatttcagaactgcggtcacccattttatacaaaccaaagcacttctgacagacctctgaatttgcattaaaaagagcacgtctacagctcctaacaatcaaaaacaactatgaacactgcttgcttcagtgatacaaacagacattttcttgttacatgtgtggtgatctgagaatggtgactttggacccagtttgactggttagcgtttaaataaaacttaacagactaggcaactaaaggaactcagtaaaagatcaaaagcaatgctcaaagggagtgcctgggtaaccatgatgtaattgcagattgacacatctttgggtttttcattattgtttctaaaaactagatattattgctttattattatgttgatgatgattattgaaagcacgatagcaatgtttaagtggtgagaatgactctaagcctctttttgttgctgtgactgacagaactaaagggagtttgctctcacattcacaataccaactctgccatcttatggaaaatattggaagtacctagggcatttcattatatttcaaaggcacaggttgctggtaagagggacagaaagacaagaacatagtaccttctatttctactacatgtttttaatctttaacatttttaccagcagaaatcattttttttttaaatctctcaatcttcaaataattcttagattgcttgccagcaaagatgtctcttgatcttgacactggaattcaatgtaaaaatcttgaatgatattttgtactgatatgaatttctactgtcccataacactgtgtagtgacttcactgtatattaacttcttttctacagatgtttgacttatgagatgaattaattgaaaaagtcaaagcctatcaggagctatcttatatgatgttggtagcctgtgaaaaaataaatgtcttttttcttatacaaactgataacaagacttgctttcacaattactatttacatttttgtgcatataatgcctgtatattatactcatatttgaaagtgatcagaaagtgttatttaacagaaactacatacattttttatgtctctctggaccctttgattctaagtaaatttacagtaagttagcagtaatagactattcttttcaactatgaataaaaatgtacact

SEQ ID NO: 53248 - DNA, 2918 bp, Homo sapiens; identical to SEQ ID NO: 53238

SEQ ID NO: 53249 - DNA, 2223 bp, Homo sapiens
atggagggacagaccccaggaagcaggggccttccagaaaagcctcaccctgccacggctgctgccactctgtcctcgatgggcgctgtcttcatcctcatgaagtccgcgctgggagctggcctgctcaacttcccctgggccttctccaaagcgggcggagtggtccctgccttcctggtggagctggtctcgttggtcttcctgatcagcgggctggtcatcctgggctatgctgctgctgtcagtggccaggccacctaccagggtgtggtcagggggctgtgtggccctgccattgggaagctgtgtgaggcctgcttcctcctcaacctgctcatgatctccgtggccttcctcagggtgatcggggaccagctggagaagctgtgtgactccctcctgtctggcaccccgcccgccccgcagccgtggtacgcagaccagcgcttcaccctgcccctgctctccgtgctggtcatcctgcccctgtctgccccgcgggagatcgccttccagaaatacacaagcatcctaggcactctggctgcctgttacctggccctggtcatcaccgtgcagtactacctctggccccagggcctcgtgcgtgagtcccatccttcactgagccctgcctcctggacctctgtgttcagtgtcttccccaccatctgcttcgggtttcagtgtcacgaagctgccgtctccatctactgcagcatgcgcaaacggagcctctcccactgggccctggtgtctgtgctgtccttgctggcctgctgcctcatctattcactgacgggggtttatggcttcctgacttttgggacagaagtttctgctgacgtcttgatgtcctacccaggcaatgatatggtcatcattgtggcccgggtcctttttgctgtctccatcgtaactgtctaccccatcgtgctcttcctggggaggtcagtgatgcaggacttctggaggaggagctgcttggggggatgggggcccagcgccctggccgacccctcagggctgtgggtccggatgccgctgaccatcctgtgggtcaccgtgacgctcgccatggcgctgtttatgcctgacctcagcgagatcgtcagcatcatcggaggcatcagttccttcttcatcttcatcttcccagatgcgaagaccgaggccctgaaccccccgccgggggcacagctagtatgcagcagggctgagggtcaatcatacagctctgtccatgctaccgctggccctggaggcaaacaccgtttctgcgaaggatggtttcttaggaaaccttcccaaacagcccaagcattatctgagaaggggaagccagcaagccgcgactggaaccatgccaaacagacatcgagcttggggacccttagccagggtggcgctttcacaggtgagggtgtggctatacagctcctccctcgactctgggcagggctttcagaggtgaggggtgtggccacacagctgctcctgcatgctctgagcggagctttcattgatggggatgtggccacacgactcctccctcagttctgggccgggctttcagagggtggagctttcagagctctgggcgggcctttcagagatgagagtgtggtcacacagcccttccctcaggctctgggcggggctttcagggctgagggtgtggccacacggctcctcactcaggctctgggtggagcttctcagaggtttgtgcctcatctgtgcaatgggtgtcgagcctataggaccaagagtcaagtaagtgtccctaagatgaggtggcaccctgggtgtgccccggatcagagtaagaatgtttcaggggaccctgcagatcctatttctcatcctctgcatcctgcagatcttttccttaattacatctgcaaaacccagtttccagataagctggcaagcacaggttccaggtgctgcctggaggtctggggagtggtctctgtgctggtcggcaccttcatctttgggcagagcacggcggcagcgctggactcaaagagcctggaagccaagtggactgttggctctgcagttctccctggtggcctccccaattctgggacaaggggtcacactggcagcagagagcaagaggagacgaggtttgcttctagggcctggctcccagcaaccatgcagctgcgctcagtctctgggtttgcctgctacgggcatgccctctga

SEQ ID NO: 53250 - DNA, 1827 bp, Homo sapiens; identical to SEQ ID NO: 53230

SEQ ID NO: 53251 - DNA, 1858 bp, Homo sapiens; identical to SEQ ID NO: 53231

SEQ ID NO: 53252 - DNA, 1417 bp, Homo sapiens; identical to SEQ ID NO: 53239

SEQ ID NO: 53253 - DNA, 3039 bp, Homo sapiens
ctctgtcaccaaaaaaaaaaaaaaattcagtggctggcatagagtcaagaaactctatgaacagaagataactgacttagcagcagcagagtaagcctccaaaaagaagcaagatctttgaaagtggctgggagagctcccaactgaataggcttcagcctcccactgtcagtacttaaggttcaaatgcctcaggctgcgggaggggacggggtggagactggccatgtcggaggtgacctggagtctgctgcagctctggggcgccagttttaggagaggcgccaacttcgacttttggggccagccggtggaggcgatagatgagtatcagatattagcaagacatctacaaaaagaggcccaagctcaacacaataattctgaattcacagaagaacaaaagaaaaccataggcaaaattgcaacatgcttagaattgtgaagtgcagctttacagtccacacagtctcaagaagaatttaaactggaggacctgaagaagctagaaccaatcctaaagaatattcttacatataataaagaattcccatttgatattcagcctgtcccattaagaagaattttggcacctggtaaagaagagaatttggaatttgaagaagaagaagagggtggtgctggagcaggatctcctgattcttttcctgctagagttcccgatgctttagataccaaggttgccattggaaccaggaatgacattactcactatcagaattgagaaaattggtttgaaagatgctgggcagtgcatcgatccctatattacagttagagtaaaggatctgaatggcatagacttaactcctgtgcaagatactcctgtggcttcaagaaaagaagatacatatgttcattttaatgtggacattgagctccagaagcatgttgaaaaattaatcaaaggtgcagctatcttctttgaattcaaacactacaagcctaaaaaaaggtttaccagcaccaagtgttttgctttcatggagatggatgaaattaaacctgggccaattgtaatagaactatacaagaaacccactgactttaaaagaaagaaattgcaattgttgaccaagaaaacactttatcttcgtctacatcaaactttgcacaaggaatgatactgacatgatgaacctggaacttctgtgaattttaccagtcagtagaaaccatcatagctctgtgtagcgtattcacccttcaacaggcaggaagcaagccgtacccagaccagtaggccggaaggagtccagtgcaaagctgtaccacagaattcagagtccagcacatcactgacgtataggactcctttggatacaggtttattgtagatttggaaacatgtttttacttttctattaattgggcaattaatagtctattttctaatttaccactactcctaccctgcttcctggaacaatactgttgtgggtaggatgtgctcatcttcaaacttaatacagcaataagaatgtcctagagtttacacatctgttcacttttgctccaatatgctcttttgacttaacttcaagctttgggttgatgtgggtagggtagtgtcaaactgttttaagaggaattggaccagttctgctgcctaagaaggtctgtctggatgtttataggcagctcctctgaagtggcctaaattcaccctgatctgatagttttcctgcctagaaagtgtgccttggccagatcagtatcccacatgggagtgttccctaggttgtagcgtgattgtttccagatgaccagattgtttttctgaaaatgagcatatttttagtcatgttgattagctgttcttctacatcacattgttactctttctgatgatgattctagggttaacattggaaccatctcaaaataattacaaatttttagatgggtttacaatgtcttctaaacaatataatctaaaaataattgagtcagatgctaacgagatactgaaggcataactgctgtttttctggcaactgattatgaaaccttaaaacctgcatacctcttcttatagtgaggaatattcaaaatctggaaagatattctatttttttatataggtagataggatcaccatttatttcctatttagatatactgacattcatccatatgaaaatatgcaggtcattagcttactataattttactatttacttttgacttaatggggcataaataaaactttcttagtacacatgaggtggatatttgatacacagaacatttgtggtgggctttctgtgggttagatgtaaagcccacgtattttaatattcactattttaaatgagcaatgcatgaggggaatgcagtgtcagtacctggcctatttttaaactagtgtaatcaccctagtcataccattcagtatgtttgctttttaaaataagtaaccacaattaagttgttgtagcccttgcacttcaagagatttagtccttcctttcagttgtctgttaggtccattctgtttactagacggatgttaataaaaactatgtgagcctgaacgtattctcggccaaatttagtcttgtctctcatcttgattggattaattctaaagtctaaaatgattcagtccacaatagctctaggggatgaagaatttgccttactttgttgttcgctcagttcctaagactgtgagttgtcaaatccctagactgtaagctcttcaaggagcaagaagcacattttctccgtgtcatgtaatttttctaaggtgcttggcagcactctgtaccctgtggagtactcagtaccttttgtttgatgttgctgacaagacctaaaaaacaatcccttaaaaaaaaaaaccattaaaaggtagcaaaaccgatgtattattttttctcttttctcataaaccgcaagatatgtatatcaaagtgataatttgtatgaagcatctgctatccttcacgtgagtatggtttatatgaactacaaatacctttcatcaacattaaagaagcttaaattgaaaaa

SEQ ID NO: 53254 - DNA, 974 bp, Homo sapiens; identical to SEQ ID NO: 53241

SEQ ID NO: 53255 - DNA, 2265 bp, Homo sapiens
cgatctagcccagaatccgcgatcccgcctggtccacccttcagcagcgacactggcggcctccgacctctcagacctagtgagcctcgcaaagccgcccggctcccggaagccgcaggtgcaggcgccgctgggctcgcgggttctcctgggctggccagggctgccccaggaccacggacggaaaatcgcaggcgcgcggcccaccccgccttaaggggagggcccgcctggccgtgtagcccgccccgctcctccttccgaagagagatctggtgctggcatgggcaccccgcggccaccggagtggcttcccggatgagcctggcttcggcgctgacgctctggccctgggggctgcctggctggtgtcacgtagcggaagacgcctggagagtcactcgctccttcccccacccgcccccaccgctgctcgtgccaggacgcgcagtttgcagttgcagctcaggcactggcgcgggatggcggagcttcccttggatggcgtcagggtcaccgagtgcacagcctacctggtctgagggtctgctcctcctggacacctctccggatcctgatccctggcgctgggcaatccacaggatgagactcatcggctgctggcgaagccgaccgcctgactttgctgcctgggcggctggccccgggatccgcgctgctggggacgcgggcctggtctgcggtgtccagccacttgctgcgggcgcgccacgtctaggctggtggctgcagccgcagctccgcgcctgcgggggctagtgggcctggtacctgatgtcctcagggtcaagtgcatcgctcacccacctgagggtctgctctgccttgacctcctccaagagcgcaggggccaccggggaggcaatttaggaatgcctaaatggaaggaactatcctttctctgtctttaagaaataagtggcttttgttgttgtttttgtgatacccagctacagcagaaagcaaaggggatgcagaggtgaaggtccacagccagttcctctactgattccctccaggcataaatgttcaatctaacggctttggttggcactttcacctcagcacttacctatgcctacaggtttgttcaatggcaactcttggattttgaattaatacccaattatttcatattttaatacccaaactattttaatagtttaccatatctgcaatcctgaattaattttttctttgtttataaaacaatcactatagtaagataaaaatcacaaaacacttccacatttcattgggctaaaaaagcattaaaacattatacgtaaaagataaaaaatacattgtttcatcataaaaattatggctttgcaaaatttttttacctttagctacattcttacgattctttaacttttcactgttattttatacatttttaaaacaatgcataccagtgtttaaaaaacaaatgcagcacttcatctaggactgaacatataacgctggtcagctctttcagcatggtgcaggtgtgggcctcaggctgctttctgtttacatgtatcaaatgacatgaccatcttaactgcacagataccatcttctcggcttctttcttctcccccaaaactatttaatgttgctttaatggcaacatcaatttaactagttttgtaatttctgtatttaattgtcacataacattatatccgttcttttttttttttaaaaaaaaggaaagcatacaatcttagttgctaggccagttcttctgaatcaatttgaaatcaccttttttctctttcataataactacttattttaatcaacaagtcaactattattagatattaacttattttttctagttaaaattttgctatctttcaaataattccaactcttacacacacatttaatgtacataactgtaacatatacatacataagcacaggttaagccagatctaacatgaatttagatatgccaagaaagccacatgaccattatttacataaatatgaccagtgttcacatttatcaaggccaatgaatattaaggtgattgcttcaataagaaattaggtgaagaattatttgttgaatattgtcaaacactttttttaacctgttaaagttatttaagcctgacccaaataatttttaaactttttattctatcatgcctatagacagcttcatatattaaccatttctgctttcgtggtcctttgagaatggtatcttagtatgtaagtgcaataaataaacaactttta

SEQ ID NO: 53256 - DNA, 870 bp, Homo sapiens
atgaaggccatgctcttctattctccagaggaagtggcccaggaagctgctgaagaaccactgattgagcccctgatggagccagaaggggagagttatgaggacccaccccaggaggaatatcaggagtatgagccagaggcgtaggggcccaggagagcccccaccagcagcacaattctgtccctgtccctgccccgccccccagagccagggctgtccttagactccttctccccaatcacgagatcttccttccgctctgaggcaaccccctcggagcctgtgttagtgtctgtccatctgtctgtcctacccgcccgcgtccaaccccggggcatggacagggccagggttgcggtcgcggctgggagcctcgcccctccagtgttgcctcctcccatccagcgtctgcgcggatgtagcatgttctatgtgtttttaaacgaagatccgagcgacggctcctccccgatccccgacagtggctctccaagcggcccccgggcagccccagagcaccccgcccgactcccattaacctcgagaacctttttttttttaaccaaaaccaggagccaggctgtgccatgtcccccgccccccatcccagccggcccggtccgaacgcgggcgtcgtgtgttgtgattgtggcatggagagtccccatcccccccatgtgagcgtgtcccgggcgggtgggcccggccgcccccgagagtccatgaataaagctaatctgtctgtagccagagccgcaccggcagggctgggctgggcgccgggtgggggcgacacgtggcggcgagtcttccaggtcccagcctacccctctgtgctctttggggtctggcacacacagcccaggt

SEQ ID NO: 53257 - DNA, 3540 bp, Homo sapiens
acccgcgctgcctccgccgctcctcggatggtgacggggccctgccgccgcagcccccccaagccccggctccgcaggcccacagcgccggagccccgcaggaatcatgcccaggtccttcctggtcaagaaggtcaaacttgacgcgttctcttcggccgacctggagagcgcctacggacgcgcccgcagcgacctcggcgcgccactgcacgataaagggtacctcagcgactacgtggggccctcgtccgtctacgatggcgacgccgaggctgcgctgctcaaagggccgtcgccggagcccatgtacgcagcagctgtgcgtggagagctgggtccggcggctgcagggtctgcgccgccgcccaccccgcgcccggagctggccaccgctgcgggcggctacatcaacggcgacgcggccgtcagcgagggctacgcggcggacgccttcttcatcaccgacgggcgctcgcggcgtaaggcttccaatgccggcgctgccgccgctccctccacagcctcggcggcggcccccgacggcgacgccggaggcgggggcggggcgggcgggcgcagcttgggatccgggccggggggccggggcggcacgcgcgcgggggcaggcaccgaggcgcgcgcggggccaggggccgcaggtgctggcggccggcacgcgtgcggcgagtgcggcaaaacatacgccacgtcgtcgaacctgagccgccacaagcagacgcaccgcagcctggacagccagctggcgcggcgctgcccgacgtgcggcaaggtgtacgtgtccatgccggccatggccatgcacctgctcacgcacgacctgcgccacaagtgcggcgtgtgcggcaaagccttctcgcggccctggctgctgcagggccacatgcgctcgcacaccggcgagaaacccttcggctgcgcgcactgcggcaaggccttcgccgaccgctccaacctgcgcgcgcacatgcagacgcattcggccttcaagcacttccagtgcaagcgctgcaagaagagcttcgcgctcaagtcctatctcaacaagcactacgagtcggcctgcttcaagggcggcgccggaggccccgcggctcctgcgccgccacagctcagccctgtgcaggcctagggcggcggggcctcccccagccaggtcggctctcagcaatacggccccccagggaagtcttcgctggcgtccgggtggaggggccggagggcgggcccctcctcacagcaatagggggaggggggcccggtcccaccccgccccgcccgccaggggccttgccggccccttcaagcaatagggtcccgaggggagacccaccccgagccccctcccctcccctccagggtgcccccggctttctcccagcaatagggtcgacgagacctagaaccgaacctcatctccgagttgggtctctgaagacgggggtgaggtgaggtagggagcgccctccttctcccgcctctgcgcccctggatcgcgtcgcagggactcaggtcttccccaccccttcccaagccttctagcgcagggcctgcggcccagacgtccagggagccggcccctccccggcagcaggccggggcggagcaggagcgggcgggcctgcagggacgcccctgcctagcagccttcgcggaactcccggcagtgttagacgcgttgtgggtcggggagaggggcggacggcggcaccccctccctcgggttgcttctggggcctcagtcggagccgccctcctaccctcgcctcgcatcctctgccaaatccgaattcttccagcccagcttcccgggctctgtcctccatatcgaataataatgacacatatcgaatcgcatggacttatccgacctcctcagaccccgcttccgccctgccccgggcccccacccccccccccgtaccccaggcattcgtgttggaggacggattcccggggccggcaggcaggcctgggcgctgccctctacacacctctgtcttcgctttgcgggtaaagccccctgggggggttgcggacgcgtcgggtttctttttctgtatttgtacgttttatttatgaacggattgcactcgggtcagggagggggcgctgaacccccatcttgcccgccgacgccgggggcctgggatgtccgggattactttccacgccccgaggcccgcccctagctgggagcctctagggagcctcaggccccgcctctccgaggcaggcccctcccctgagacccaggccccgcccccgagacccaggccccgcccccactcggttgccaactttcgcccgtctatgccaaagcctcggcggcgaccccgccccaagggcccgccccattggccgccgcctttgtgacgtcactgcatgcagccccacccctcctcccgatcctacccggggctgcccgctccccctccctcttaggtagtccgaagccgactatagagcaataatgcgcactgcatgcgaagctgccgccgcctctagagttactgagaatcaggtatcccctcgccctacccaccccataggcccctagatcagggacgctgcgcggggccggccgcgcagactttctccccacccctccccgacccccacggcagagcccggcggctgtaatggttccatgggcgggggtggggtggttgcccccaagacccctccttcaggcattaatcattcactgaccgttcattgagcacctactatgtgccaggccaattgctgagtccgccaggagcgcagccacctgctgggaggtgtgtttgcaggacaggggtccaaccggcttgggtgggccagggaagaacggcagatgcagagagaccaggtccctaggttcacatgccccctacactcctccccacctcaaccagtccctgctgggcacaactgggctctacctttgagttaggccttttgactccagctgagggggacagatccagggctcctgggcccccacacaggtggccacttctctgatcctctggccaacacacatctgccatgtccagccaggggcagagccatggctggagaagaaggtgccagctgtagcctatggtgtggccagcctcacccccagcagcaagcgtggctgcccccacaaggatgacccaccgctctgcacagcagtgcccacatccaaacaccctacacaaccaggtgtggtgcctgcacagctcccaagctggggcctgcccacctgtgccgcatgcacacgcacacacaggcgcccccacctcaccccaccccatactcctgtctacctacctaaggagaaagctggagggctgtgggcccgtcagggtctcctgcttccccctacaccccgccgccgtggaaagccatgggccccctcccgcccccataactaagcagcacaataaccgacttagcgaattcaggtagaaggaacgtttaggtagcacctattttgtactgattctacaagtagggcccgaggtgcgggggccctcgggtgggggctgc

SEQ ID NO: 53258 - DNA, 709 bp, Homo sapiens
atgggctgctggaaaggcccggagatgcatctgtggcctggggccatcaagatcaaagaaccaggaggcctgggagatgcagctggatggggcggcctgcagaccctgccagggggtttgaggaccctcccaggtttcccactgcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcaga

SEQ ID NO: 53259 - DNA, 709 bp, Homo sapiens; identical to SEQ ID NO: 53258

SEQ ID NO: 53260 - DNA, 16556 bp, Homo sapiens
  misc_feature 13999,15128: n = A,T,C or G
aaagacagaaccccagagaaaaacgctgccaattcgttgctttattgttccctgcctggggacctcaatagccttttccattaaccttcccttcttacgcaacggttaatgacttttggggttgttttgctttctgtttctgctgagtcactaaattttgcctctttgtccccaggtgctgctcagcataaaagttaaaagtgcaattcaggaagtactgggattctgtgtagagccgaggaaaccatttccctaagagaagctctgttccttggcttgtccttccttcccgggaaggaagcttccgaggaacgaagggagaagctttgttttgcctgcagaagcagccctgtgctcggctgagggttctcagctggctgtgaactgcggagcattgtaggcgcctggctggctcaggccaatgcagaagtctctcccttctccaaagacccaaatccccacagaaccagcttcgagttactttcccttcaaggggattaaaataattgtgatttgtggcgctctccgttcgcggtggtattttcctgttgtgttaaatgcctcttattaagtaatagatgtgatttatgtgaacgacgaaggggtgtgtggtggattcggtgattaatcagtgaattcccatccgctggcatctctcactgcccctcttgcgtgatgtaagatcagacgtaccctgcattgaaaagtcaagacacacgggcgtctcgctcgcgctcacacacgctctgcctcctctctcccgcacgcgcgcatccctccaccttccacatcctgctccaggcaggagaaggctgactggctggactcattgagctgaagaatttccagtgacatttgtaaatgacgccgctcgattccaggctccaagcggccgctgccgccgccgccgccgccgggccgaaggtgccgccgagcagtctccagcgcaggcttccttaccgggcgaccacaatgtccgagtttctcctcgccttactcactctctcgggattattgccgattgccagggtgctgaccgtgggagccgaccgagatcagcagttgtgtgatcctggtgaatttctttgccacgatcacgtgacttgtgtctcccagagctggctgtgtgatggggaccctgactgccctgatgattcagacgagtctttagatacctgtcccgaggaggtagaaatcaagtgccccttgaatcacattgcttgccttggtaccaacaaatgtgttcatttatcccagctgtgcaatggtgtcttggactgcccagatgggtatgacgaaggagtacattgtcaggaactgttatccaattgccaacagctgaattgtcagtataaatgtacaatggtcagaaatagtacaagatgttactgtgaggatggattcgaaataacagaagatgggagaagctgtaaagatcaagatgaatgtgctgtttatggtacatgcagccagacctgcagaaacacacatggatcctacacttgcagttgtgtggaaggctacctaatgcagccagacaacagatcttgcaaggctaaaattgaacctacagatagaccacctatactattaattgcaaattttgaaacaattgaggttttctatcttaatggaagtaaaatggcaactctaagctcagtcaatggaaatgaaattcatactctggattttatttataatgaagatatgatttgttggattgaatcaagagaatcttcaaatcaactcaaatgtatccagataacaaaagcaggaggattaacagatgaatggacaatcaatattcttcaatccttccacaatgtgcaacaaatggcgattgactggctcactcgaaatctctattttgtggaccatgtcggtgaccggatctttgtttgtaattccaacggttctgtatgtgtcaccctgattgatctggagcttcacaatcctaaagcaatagcagtagatccaatagcaggaaaacttttctttactgactacgggaatgtcgccaaagtggagagatgtgacatggatgggatgaaccgaacaaggataattgattcaaagacagagcagccagctgcactggcactagacctagtcaacaaattggtttactgggtagatctttacttggactatgtgggagtagtggactatcaaggaaaaaatagacacactgtcattcaaggcagacaagtcagacatctttatggtataactgtgtttgaagattatttgtatgcaaccaattctgataactacaatatcgtaaggataaaccgatttaatgggactgatattcactcattaattaaaattgagaatgcttggggaatccgaatttatcaaaaaagaactcaaccaacagtcagaagccatgcatgtgaagtcgatccatatggaatgccagggggctgttcacacatctgtctactcagcagcagttacaaaactcggacttgtcgctgcaggactggcttcaacttgggaagtgatggcaggtcatgcaaaagaccaaagaatgagttgttcctcttttatgggaaaggacgcccaggaattgttagaggaatggacttgaataccaagatagctgatgaatacatgatccccatagaaaatctggtaaaccctcgtgctttagactttcacgcagaaaccaattacatctactttgctgacaccaccagtttcctaattggccggcagaagatagatggcacagagagagaaaccatcctgaaagatgatctggataatgtagagggcattgctgtggactggattggaaataatctttactggaccaatgatggccataggaaaaccattaatgtggccaggctggaaaaagcttctcagagtcggaagactcttttagagggtgaaatgtctcatcccagaggaattgtggtggatccagttaatggttggatgtattggacagactgggaggaagatgaaatagatgacagcgtgggaaggattgagaaggcctggatggatggattcaatcggcagatttttgtgacttcaaagatgctgtggccaaacggtttaactctggactttcacaccaacacattatactggtgtgatgcctattacgatcatattgaaaaagtatttttgaatgggactcacaggaagattgtttacagtgggagagagttgaaccaccctttcggactgtcgcatcatggaaattatgtgttctggactgattatatgaatggttccatttttcaactagatttgataacaagtgaggtgacattgctgaggcatgaaagaccacccctatttgggcttcagatttatgatccacgaaagcaacaaggtgacaatatgtgccgagtaaataatgggggctgtagtacactttgcttggctatcccaggaggccgggtgtgtgcttgtgccgataatcaacttttggatgaaaatgggacaacttgcacatttaatcctggagaagcactacctcacatatgtaaagctggagagtttcgctgcaaaaacagacactgtatccaagctcggtggaaatgtgatggcgacgatgactgcctagacggaagcgatgaggattcagtaaactgcttcaatcatagctgtcctgatgatcagtttaaatgccagaataatcgctgcatccccaagagatggctttgtgatggagctaatgactgtgggagcaatgaagatgaatccaatcaaacttgcacagccagaacatgccaggtagaccagttttcttgcggaaatgggcgttgcattcccagagcatggctgtgtgacagggaagacgactgtggtgaccagacagatgaaatggcatcttgtgaattcccaacttgtgagccactaacccaattcgtatgcaaaagtggaagatgcattagcagcaaatggcactgcgactctgatgacgactgtggggacgggagtgatgaggtgggctgtgttcactcttgctttgataatcagttcagatgttccagtggcagatgcatcccaggccactgggcctgtgatggtgacaatgactgtggggacttcagtgatgaagcccagatcaattgtactaaagaagagattcattctcctgctggttgtaacggaaatgaatttcagtgccaccctgatggtaattgcgttcctgatttgtggcgctgtgatggagaaaaagactgtgaagatggtagtgatgaaaaaggttgcaatggtaccatacgattgtgtgaccacaaaaccaagttttcctgttggagtacagggagatgcatcaacaaagcatgggtgtgtgatggagatattgattgcgaagatcagtcagatgaagatgactgtgacagtttcttgtgtggaccacccaagcatccttgtgctaatgacacctcagtctgcctgcagccagagaaactctgcaatgggaaaaaggattgtcctgatggctctgatgaaggctatctctgtgatgagtgttcgctgaacaatggaggctgtagcaaccactgttctgttgttcctggaagaggaattgtctgttcctgccctgaaggacttcaactcaacaaagacaataaaacatgtgaaattgtggattattgtagcaatcatctaaagtgcagccaagtatgtgagcagcacaagcacacagtcaagtgctcatgttatgaaggttggaagctggatgtagacggtgaaagttgtacaagtgttgatccttttgaagcattcatcatcttttctattcgtcatgagatcagaaggattgatcttcacaaaagagactatagtctacttgttcctggattgagaaacacaatagcacttgattttcacttcaatcaaagtttactttattggacagatgttgtagaagacagaatataccggggaaagctttctgaaagtggaggtgtcagtgccattgaagtggttgtggagcatggcctggctactccagaaggcctgacagtcgactggatagcaggaaacatatactggatagacagcaatctggaccaaatcgaagtggccaaactagatggctccctaagaactacactaatagcaggagccatggaacaccccagggccattgctttggacccaagatatggaattcttttctggacagactgggatgcaaattttcctcgcattgaatctgcctctatgagtggtgctgggagaaaaaccatctataaagacatgaaaactggggcttggcctaatggactaactgtggaccactttgagaaaaggatagtgtggacagacgccaggtcagatgctatttattcagccctctatgatggaacaaacatgatagaaatcatccgaggtcatgaatacctttcccatccctttgctgtgtctctatatgggagtgaagtctactggacagactggaggaccaacacattgtccaaagccaataagtggacagggcagaatgtcagtgtgattcagaaaaccagtgcacagccatttgaccttcagatataccatcccagtcgccagccacaggctcccaatccttgtgcagctaatgatggcaaaggcccctgctctcacatgtgtctaatcaatcacaataggagtgctgcctgtgcgtgcccccacttgatgaagctttcttcagacaagaagacctgctatgaaatgaaaaaatttcttctttatgcaagacgttctgaaatcagaggagtggatattgacaatccatactttaacttcatcacggcatttacagtccctgatattgatgacgttactgtgatagacttcgatgcatctgaggaacgtttatactggacagatattaaaacacaaaccattaaacgagcttttattaacggaactgggttagaaactgttatttcaagagatattcagagtatcagagggctagcagtggattgggtgtcacgtaatttatactggattagctcagaatttgatgaaacgcaaattaatgtggcaaggctagatggctctttgaaaacctcaattatccatggaatcgataagccacagtgtcttgcagctcacccagtcaggggaaaactctactggaccgatggaaacacaattaacatggcaaatatggatggcagtaatagcaagattctgtttcagaatcagaaggagccagttggtctatcgatagactatgtggaaaacaagctttattggatcagttcggggaatggaaccataaatagatgcaacctggatggtggtaatttagaagtaatcgagtcaatgaaagaagaattaacaaaagctacagccctaaccatcatggataagaaactgtggtgggcagaccaaaacttagcccagctaggaacctgcagcaaaagagacggaagaaaccccaccatcctacggaataagacttctggggtagttcatatgaaagtctatgataaagaagcacagcaaggcagcaattcctgccaactaaacaatggtggatgctctcaactttgtttaccaacatctgaaactacaaggacttgtatgtgtacagtgggatattatctccaaaagaaccgtatgtcatgtcaaggtatagaatcatttcttatgtactctgttcatgaaggaatcaggggaatacctcttgaaccaagtgacaaaatggatgctttgatgcctatatcaggaacttcatttgccgtgggaatagatttccatgcagaaaatgataccatctactggacagacatgggcttcaataaaattagcagagctaaaagagatcagacttggaaagaagatatcattaccaatggcttgggaagagtggaagggatagctgttgactggattgctggtaacatatattggacagatcatggtttcaacttaattgaagttgcaagactcaatggttctttccgttatgtaattatttcccaaggcctggatcaaccaagatctatagctgtgcacccagagaaaggcctcttgttctggactgaatggggacaaatgccctgtattggaaaggctcgcttggatggctcagagaaggttgtccttgtaagcatgggaatagcatggccgaatggcatctccatcgactatgaggaaaataaattgtactggtgtgatgctcgcacagacaagatagagagaatcgaccttgagactggagggaatcgcgagatggtgctgtcaggaagcaatgtggatatgttttcagttgcagtctttggggcttacatctactggtctgacagagcacatgcaaacgggtctgtcagaaggggccacaagaatgatgccacagaaacgataaccatgagaaccggccttggagtcaacctgaaggaggttaaaatatttaaccgagtaagagagaaagggaccaatgtttgtgccagggacaatggtggctgtaagcaactctgtctttatcgaggaaattcccggagaacttgtgcttgtgcccatggatatttggcagaagatggagttacttgcctgaggcatgaaggctatttactgtattcaggaagaacaatattaaaaagtatacatctttctgatgaaaccaatttaaattccccaataaggccatatgagaatccacgttatttcaagaatgtcatagccttggcttttgactataatcaaagaagaaaaggtaccaaccgaatcttttacagtgatgcacactttggaaatatacagcttattaaagacaactgggaagacagacaagtaattgttgaaaatgtgggttctgtggaaggacttgcctatcacagagcctgggatacactgtactggacaagctctaccacctcatccatcaccagacacactgtggaccagactcggcctggagcatttgacagggaagctgtcatcaccatgtcagaagatgaccatccacatgtgctagccttggatgaatgtcaaaatttaatgttttggaccaactggaatgaacaacatccaagtatcatgagatctactctgactgggaaaaatgctcaagtggtggtcagtacagacatactcactccaaatggacttactatcgactaccgtgcagagaagctgtatttctcagatggcagtctaggaaaaattgaaaggtgtgaatacgatggatcccagagacatgtgatagttaaatctgggccagggactttcctcagtttggctgtttatgacaattatatattctggtcggactggggaagaagagctatactgcggtccaacaagtacacaggaggagatacaaaaattcttcgttccgatattccacatcagccaatgggaatcatagctgttgccaatgacaccaatagctgtgaactttctccatgtgcattattgaatggaggctgccatgacttgtgccttttaactcccaatgggagagtgaattgttcctgcagaggggaccgaatattgctagaggacaacagatgtgtgactaaaaattcctcctgcaacgcttattcggagtttgaatgtggaaatggtgagtgcattgactaccagctcacctgtgatggcattcctcactgtaaagataaatcagatgaaaaactgctctactgtgaaaacagaagctgtcgaagaggcttcaagccatgctataatcgccgctgcattcctcatggcaagttatgtgatggagaaaatgactgcggagacaactctgatgaattagattgtaaagtttcaacctgtgccacggttgagttccgctgtgcagatgggacttgtattccaagatcagcacgatgcaaccagaacatagattgtgcagatgcttcagatgaaaagaactgcaataacacagactgcacacatttctataagcttggagtgaaaaccacagggttcataagatgtaattctacctcactgtgtgttctgccaacctggatatgcgacgggtctaatgactgtggagactattcagatgaattaaagtgcccagttcagaacaaacacaaatgtgaagaaaattattttagttgtcctagtggaagatgcattttgaatacctggatatgcgatggtcagaaagattgtgaggatggacgtgatgaattccactgtgattcttcttgctcttggaaccaatttgcttgttccgcacaaaaatgtatttctaagcattggatttgtgatggagaagatgactgtggggatgggttagatgaaagtgacagcatttgtggtgccataacctgtgctgctgacatgttcagctgccagggctctcgtgcctgcgtgccccgacattggctttgtgatggtgaaagggactgtccagatggaagcgatgagctttccacagcaggctgcgctcccaataatacatgtgatgaaaatgctttcatgtgccataataaagtatgcattcccaagcaatttgtttgtgaccatgatgacgactgtggagatggctctgatgagtcaccgcagtgtggataccgacagtgtggtacagaagaatttagttgtgctgatgggcggtgtcttctaaatactcaatggcagtgtgatggagactttgactgtcctgaccattctgatgaagcacctttaaacccaaagtgtaaaagtgcagaacagtcatgcaacagttcattttttatgtgcaaaaatggcaggtgcattcccagtggaggtctttgtgacaataaggatgactgtggcgatggttcagatgagagaaactgccatataaatgaatgtttgagtaagaaagtcagtggatgttctcaagattgtcaagaccttccggtcagttataagtgcaaatgctggcctggattccaactgaaggatgacggcaaaacatgtgtagacattgatgaatgctcttcaggctttccctgtagccagcaatgcatcaatacatacgggacttacaagtgcctctgtacagatgggtatgaaatacaacctgataacccaaatggctgcaaatcgctctcagatgaagaaccttttttaattcttgctgatcatcatgagataaggaaaattagcactgatggctccaactacacacttttaaaacagggattaaacaatgttattgctatagactttgattacagagaagaattcatctattggatcgattctagccgacccaatggcagtcgcataaatagaatgtgtttaaatggaagtgacattaaggtagttcataacacagcggtccccaatgcacttgctgtcgattggattggaaaaaacctctattggtctgacacagaaaaaagaatcattgaagtatccaaactcaatggcttgtaccctactatactcgttagcaaaaggctgaagtttcccagagacttgtctttagatcctcaagctggatatttgtattggattgactgctgcgagtatcctcatattggccgtgttggaatggatggaaccaatcagagtgttgtcatagaaaccaagatttctagacctatggcactaacaatagattatgttaatcgtagactctactgggccgatgaaaatcacattgaatttagcaacatggatggatctcatagacacaaagtccctaatcaagatattccaggggtgattgcactaacattgtttgaagactacatctactggactgatgggaaaaccaagtcactcagccgtgcccataaaacatcgggagcagacagactctcactgatttactcatggcatgccatcacagatatccaggtgtatcattcttatagacaacctgatgtctccaaacatctctgcatgataaataatggtggttgcagtcatttgtgccttttagcccctggaaaaacccacacttgtgcatgtcccactaacttctatctggcagctgataataggacttgcttatccaactgcacagccagccagtttcgttgcaaaactgacaaatgtattccattctggtggaaatgtgacaccgtggatgactgtggtgatggatctgatgaacctgatgactgtcctgaatttagatgtcagccaggccgatttcagtgtgggactggactctgtgctctaccagctttcatctgtgatggagagaatgattgtggagacaattctgatgaactcaactgtgacacacatgtctgcctgtcaggtcaattcaaatgtaccaagaaccagaaatgtatcccagtaaacttaagatgtaatgggcaagatgactgtggtgatgaggaagatgaaagagactgtcctgaaaacagctgttctccagactatttccagtgtaagactacgaagcattgcatttccaagctgtgggtttgtgacgaggatccagactgtgcagatgcatcagacgaggccaactgcgataaaaagacttgtggacctcatgaattccagtgtaaaaacaacaactgtattcccgatcactggcggtgtgatagccaaaatgactgcagtgataattcagatgaagaaaactgtaagccacagacatgtacattgaaagatttcctctgtgccaatggggactgtgtttcttcaaggttttggtgtgatggagattttgactgtgcagatggctctgatgagagaaattgtgagacaagttgttccaaagatcagttccggtgttccaatggtcagtgtataccagcaaaatggaaatgtgatggccatgaagactgcaaatatggggaagatgagaaaagctgtgagccagcttctcctacttgctcatcacgtgaatatatatgtgccagtgatggatgtatttcagcatctttgaaatgtaatggagaatatgattgtgctgatggttcagatgagatggactgtgtgactgaatgtaaggaagatcagtttcggtgcaaaaataaagcccactgtattccaattagatggctgtgtgatggaattcatgactgtgtggatggcagtgatgaagagaactgtgaaagaggaggaaatatatgtagagctgatgagttcctttgcaataattctctctgcaaactacatttctgggtgtgtgatggagaggacgactgtggagacaactctgatgaagcccctgatatgtgtgtcaaatttctttgtccatccacgagacctcacagatgcagaaataacagaatatgcctacagtcggagcaaatgtgcaatgggattgatgaatgcggtgacaattcagatgaagatcactgtggtggtaagctgacatataaagcaaggccttgtaaaaaggatgagtttgcttgtagtaataaaaaatgcatccctatggatctccagtgtgatcgacttgatgactgcggagatggttcagatgagcaaggatgcagaatagctcctactgaatatacctgtgaagataatgtgaatccatgtggagatgatgcatattgtaatcaaataaaaacatctgttttctgtcgctgtaagcctggatttcagagaaacatgaaaaacagacaatgtgaagaccttaatgaatgtttggtgtttggcacatgttcccatcaatgtataaatgtggaaggatcatataaatgtgtgtgtgaccagaattttcaagaaagaaataacacctgcatagcagaaggctctgaagatcaagttctctacattgctaatgacactgatatcctgggttttatatatccattcaactacagtggcgatcatcaacaaatttctcatattgaacataattcaagaataacagggatggatgtatattatcaaagagatatgattatttggagtactcagtttaatccaggcggaattttctacaaaaggatccatggcagagaaaaaaggcaagcaaacagtggcttgatttgtcctgaatttaaaaggcccagggacattgcagttgactgggtggctggaaacatttactggactgatcattctagaatgcattggttcagttactacactactcactggaccagtctgaggtactctatcaacgtagggcagctgaatggccccaactgcaccagactcttaacaaatatggctggagaaccctatgctattgcagtaaatcctaaaagagggatgatgtactggactgttgttggggatcattcccatatagaagaagcagccatggatggtacactgagaaggattttagtacaaaagaacttacagagacccacaggtttggctgtggattattttagtgaacgcatatattgggctgactttgagctctccatcattggcagtgttctgtatgatggctctaattcagtagtctctgtcagcagcaaacaaggtttattacatccacataggatcgatatctttgaagattatatatatggagcaggacctaaaaatggtgtatttcgagttcaaaaatttggccatggttcagtagagtacttagctttaaatattgataaaacaaaaggtgttttgatatctcatcgttataaacaactagatttacccaatccatgcttggatttagcatgcgaatttctttgcttgctaaatccttctggggccacttgtgtgtgtccagaaggaaaatatttgattaatggcacctgcaatgatgacagcctgttagatgattcatgtaagttaacttgtgaaaatggaggaagatgcattttaaatgagaaaggtgatttgaggtgtcactgttggcccagttattcaggagaaagatgtgaagtcaaccactgtagcaactactgccagaatggaggaacttgcgtaccatcagttctagggagacccacctgcagctgtgcactgggtttcactgggccaaactgtggtaagacagtctgtgaggatttttgtcaaaatggaggaacctgcattgtgactgctggaaaccagccttactgccactgccagccggaatacaccggagacagatgtcagtactacgtgtgccaccactattgtgtgaattctgaatcatgtaccattggggatgatggaagtnttgaatgtgtctgtccaacgcgctatgaaggaccaaaatgtgaggttgacaagtgtgtaaggtgccatggggggcactgcattataaataaagacagtgaagatatattttgcaactgcactaatggaaagattgcctctagctgtcagttatgtgatggctactgttacaatggtggcacatgccagctggaccccgagacaaatgtacctgtgtgtctatgctccaccaactggtcaggcacacagtgtgaaaggccagccccaaagagcagcaagtctgatcatatcagcacaagaagcattgccatcattgtgcctctcgtcctcttggtgactttgataaccaccttagtaattggtttagtgctttgtaaaagaaaaagaaggacaaaaacaattagaagacaacctattatcaatggaggaataaatgtagaaattggcaatccatcttataacatgtatgaggtagatcatgatcacaacgatggaggtcttttagatcctggctttatgatagacccaacaaaggccaggtacatagggggaggacccagtgctttcaagcttccacacacagcgccgcccatctacctaaactctgatttgaaaggaccactaactgctgggccaacaaattactccaatccggtatatgcaaaattatatatggatgggcaaaactgtcgaaactccttaggaagtgttgatgaaaggaaagaactgcttccaaagaaaatagaaattggtataagagagacagtggcataatcagtgatatcttttatatgctgtataaatgtataaaatataaggattacttttgtatgttccaacagtattatacttgttttggcatcagcattacctctttctttatctttttcctggttaattgttttctgagttttttgggttttattttttgctgatgactattgattgaccatttgtatggtatttttatgaaaaagaactgcactacagtacaatttacaacaatgctgctgatatgacacacctttgaatttgttaaaattaaaaacaacgtattcctttgtagtgtgaatatgagcaatctattttatatgaacttttttggttgtacttaatcaacgaggagaatntctgcacttttccattatacggtttgaaggctgtaatacagtgtcattttatttttctgtttaaattgatggaaaaatgattgaatggtcaactctcttctttgtgcccataaagatcgattcagactctgctgaaaatatatagctctcacaagttcagcatcacctgctttgaaattagccttagattgccaaccaatagatgagaattttgaggaaaaaaattaaaaatatgtaaaattaataatttgcatgaacacagatgactacattttccaaaacttagtggactctatgtgatgtactaaatgtatacaccttgtaagcaatagttatatttaggtggtagaacatagcaaaaatataaccgaaagttggccgactgcacttgctatggaataagaccttttattctccctcagtctcgagataaatagccagcctagagcacaacagggcattgggtacttgcatcttaggtatttcttcccagtcacatccattttgtggaagattaacccaaccccttacactacactgaacactaaagaataacatataagcacacaaattggtgacagaatttcaattacgtgaacgcatcctctttgctaggtcaaaaacaaagggcaaagcagacattttagtatacagagtgattggcaaatattttcaagatttaatatgagcaacccattatttgccctatccaaaatatattcaagggccttccaagttgtagaagaacaatgatcttcccataatcaaaagtggagagtcgaaatgctgtgccagttgctctggtattcaggtttctctgggttttacagaacgcatggaccccattcacgtttggtttgtttatcttcaaatttgagttgaaacgagtgcgatttatttaagttgtatataaaaataaaaggatagcatttttatacaaatatctttaaaggcacaaaagatttattcacaagttttggagggctttttgttcctctgatagacatgactgacttttagctgtcataatgtattaacctaacagatgaaatatgttaaatatgtggttgctctttatccctttgtacaagcattaaaaaaactgctgttttataagaagactttttgttgtactatgtgcatgcatactacctatttctaaactttgccatattgaggcctttataaactattgatttatgtaatactagtgcaattttgcttgaacaatgttatgcatatcataaactttttcaggttcttgtttaagtacattttttaaattgaacagtatttttcattttggttataatatagtcattttgcctatgtttctacaatgaagtgttaaatactttataaaaaattgttgactgacttatttaaatgaaattctacatataaaaaaaaaaaaaaaaaaaaaaaaaa

SEQ ID NO: 53261 - DNA, 3464 bp, Homo sapiens
gcgggccttgcaccccaaattcctgagcctcattgggggggtcctccccccacgggccgggcatgctgccccccggaaggaacccctctcctcgctccccccagcgtccacgcggagcatgaacattgaggatggcgcgtgcccgcggctccccgtgccccccgctgccgcccggtaggatgtcctggccccacggggcattgctcttcctctggctcttctccccacccctgggggccggtggaggtggagtggccgtgacgtctgccgccggagggggctccccgccggccacctcctgccccgtggcctgctcctgcagcaaccaggccagccgggtgatctgcacacggagagacctggccgaggtcccagccagcatcccggtcaacacgcggtacctgaacctgcaagagaacggcatccaggtgatccggacggacacgttcaagcacctgcggcacctggagattctgcagctgagcaagaacctggtgcgcaagatcgaggtgggcgccttcaacgggctgcccagcctcaacacgctggagctttttgacaaccggctgaccacggtgcccacgcaggccttcgagtacctgtccaagctgcgggagctctggctgcggaacaaccccatcgagagcatcccctcctacgccttcaaccgcgtgccctcgctgcggcgcctggacctgggcgagctcaagcggctggaatacatctcggaggcggccttcgaggggctggtcaacctgcgctacctcaacctgggcatgtgcaacctcaaggacatccccaacctgacggccctggtgcgcctggaggagctggagctgtcgggcaaccggctggacctgatccgcccgggctccttccagggtctcaccagcctgcgcaagctgtggctcatgcacgcccaggtagccaccatcgagcgcaacgccttcgacgacctcaagtcgctggaggagctcaacctgtcccacaacaacctgatgtcgctgccccacgacctcttcacgcccctgcaccgcctcgagcgcgtgcacctcaaccacaacccctggcattgcaactgcgacgtgctctggctgagctggtggctcaaggagacggtgcccagcaacacgacgtgctgcgcccgctgtcatgcgcccgccggcctcaaggggcgctacattggggagctggaccagtcgcatttcacctgctatgcgcccgtcatcgtggagccgcccacggacctcaacgtcaccgagggcatggctgccgagctcaaatgccgcacgggcacctccatgacctccgtcaactggctgacgcccaacggcaccctcatgacccacggctcctaccgcgtgcgcatctccgtcctgcatgacggcacgcttaacttcaccaacgtcaccgtgcaggacacgggccagtacacgtgcatggtgacgaactcagccggcaacaccaccgcctcggccacgctcaacgtctcggccgtggaccccgtggcggccgggggcaccggcagcggcgggggcggccctgggggcagtggtggtgttggagggggcagtggcggctacacctacttcaccacggtgaccgtggagaccctggagacgcagcccggagaggaggccctgcagccgcgggggacggagaaggaaccgccagggcccacgacagacggtgtctggggtgggggccggcctggggacgcggccggccctgcctcgtcttctaccacggcacccgccccgcgctcctcgcggcccacggagaaggcgttcacggtgcccatcacggatgtgacggagaacgccctcaaggacctggacgacgtcatgaagaccaccaaaatcatcatcggctgcttcgtggccatcacgttcatggccgcggtgatgctcgtggccttctacaagctgcgcaagcagcaccagctccacaagcaccacgggcccacgcgcaccgtggagatcatcaacgtggaggacgagctgcccgccgcctcggccgtgtccgtggccgccgcggccgccgtggccagtgggggtggtgtgggcggggacagccacctggccctgcccgccctggagcgagaccacctcaaccaccaccactacgtggctgccgccttcaaggcgcactacagcagcaaccccagcggcgggggctgcgggggcaaaggcccgcctggcctcaactccatccacgaacctctgctcttcaagagcggctccaaggagaacgtgcaagagacgcagatctgaggcggcggggccgggcgggcgaggggcgtggagccccccacccaggtcccagcccgggcgcagcctgaccgggacccctccctcccacagcccagcccaccttctgggaccacgcagggaattggggagaggtggcttccagccccatctggggctcggacccccagtaaggacagggtggggctccaggagcggagtctctgggatcctcgcctcacccccgccaatccccggtgacgggaggggacgtgggacccaggagaagtggcctgagttctccgcgtttcctcctcgctctcccaccaagcgttccgggcccgccgccttccaggggagagaggagctttctccaggggtgtcctttcccctcggccccaaacaccttccttttacggttcagtttttgcagtttgacgcccgtccctccctcccactcctccgccctcaaaactgaagagatggacacgtcgccagagctcccgtcccagcgcccggctctgctcccggccggcggtccctgtcgtcggcgcgggggggagcctccacccgccccagccccacctgccccacagacacttttgatactgaagggaggtttgcgtcaacgactacctgctctgtaattactttaaaaaaaaaacatggaaaaagtaaaaaaatattttttttggtcatgaaagcacggaggagagaaaacaaagtgaatgtgggtgggggcggaaggagaggctggagagccagcctcgcagctccgtcgggagggtgggcacggggcacctccgggtggtcttaggcccctcagccttcaccctggagaccccagagaaggtctgattccctttcttcctaaactcctcccccagcaccgccacaccacacccaaacccaggtggagacttataacaaaggaaatctatcgtcccacagttctggaggctggagggagggccacgctctctctgaaacctggggatacctcaggggagcttcctgcctcgccagcttctggtgtccccaggctgtcctggctggtggctgtatcacatcaccccagtcttccagtgcctgcccctgtagcctctcatctcttccctctgtgtgcgtccgtctgtgtccaactccccctcttttatttatttattttttaattgagatggagttttattcttgtcgcccaggctggagtgcaat

SEQ ID NO: 53262 - DNA, 3464 bp, Homo sapiens; identical to SEQ ID NO: 53261

SEQ ID NO: 53263 - DNA, 2217 bp, Homo sapiens
ttgcgggtcctagaagtcgcctccccgccttgccggccgcccttgcagccccgagccgagcagcaaagtgagacattgtgcgcctgccagatccgccggccgcggaccggggctgcctcggaaacacagaggggtcttctctcgccctgcatataattagcctgcacacaaagggagcagctgaatggaggttgtcactctctggaaaaggatttctgaccgagcgcttccaatggacattctccagtctctctggaaagattctcgctaatggatttcctgctgctcggtctctgtctatactggctgctgaggaggccctcgggggtggtcttgtgtctgctgggggcctgctttcagatgctgcccgccgcccccagcgggtgcccgcagctgtgccggtgcgaggggcggctgctgtactgcgaggcgctcaacctcaccgaggcgccccacaacctgtccggcctgctgggcttgtccctgcgctacaacagcctctcggagctgcgcgccggccagttcacggggttaatgcagctcacgtggctctatctggatcacaatcacatctgctccgtgcagggggacgcctttcagaaactgcgccgagttaaggaactcacgctgagttccaaccagatcacccaactgcccaacaccaccttccggcccatgcccaacctgcgcagcgtggacctctcgtacaacaagctgcaggcgctcgcgcccgacctcttccacgggctgcggaagctcaccacgctgcatatgcgggccaacgccatccagtttgtgcccgtgcgcatcttccaggactgccgcagcctcaagtttctcgacatcggatacaatcagctcaagagtctggcgcgcaactctttcgccggcttgtttaagctcaccgagctgcacctcgagcacaacgacttggtcaaggtgaacttcgcccacttcccgcgcctcatctccctgcactcgctctgcctgcggaggaacaaggtggccattgtggtcagctcgctggactgggtttggaacctggagaaaatggacttgtcgggcaacgagatcgagtacatggagccccatgtgttcgagaccgtgccgcacctgcagtccctgcagctggactccaaccgcctcacctacatcgagccccggatcctcaactcttggaagtccctgacaagcatcaccctggccgggaacctgtgggattgcgggcgcaacgtgtgtgccctagcctcgtggctcaacaacttccaggggcgctacgatggcaacttgcagtgcgccagcccggagtacgcacagggcgaggacgtcctggacgccgtgtacgccttccacctgtgcgaggatggggccgagcccaccagcggccacctgctctcggccgtcaccaaccgcagtgatctggggccccctgccagctcggccaccacgctcgcggacggcggggaggggcagcacgacggcacattcgagcctgccaccgtggctcttccaggcggcgagcacgccgagaacgccgtgcagatccacaaggtggtcacgggcaccatggccctcatcttctccttcctcatcgtggtcctggtgctctacgtgtcctggaagtgtttcccagccagcctcaggcagctcagacagtgctttgtcacgcagcgcaggaagcaaaagcagaaacagaccatgcatcagatggctgccatgtctgcccaggaatactacgttgattacaaaccgaaccacattgagggagccctggtgatcatcaacgagtatggctcgtgtacctgccaccagcagcccgcgagggaatgcgaggtgtgattgtcccagtggctctcaacccatgcgctaccaaatacgcctgggcagccgggacgggccggcgggcaccaggctggggtctccttgtctgtgctctgatatgctccttgactgaaactttaaggggatctctcccagagacttgacattttagctttattgtgtcttaaaaacaaaagcgaattaaaacacaacaaaaaaccccaccccacaaccttcaggacagtctatcttaaatttcatatgagaactccttcctccctttgaagatctgtccatattcaggaatctgagagtgtaaaaaaggtaccaatcattgattttttttttttttgtaaactaaaatgtttaaaataaaatagcatttacagttaaaaa

SEQ ID NO: 53264 - DNA, 5572 bp, Homo sapiens
ctcggaaaagcttttcagtaaatgcactcatgctgctccaggagctcttctctgcaacaagccacccatctgccatcaacaagttaagaccaagagaactaacggctgcggaaatgagactgaagctttgattaaccagctgagcagttagaggtggagaaatttaataacttatattcaaaactgatttagggatcagagcaatcacagaaaatgaaaccaatgctttccagagggatatcctaaggaaaaaacaactcgtcctggtggattcaattttacttggaaagcctgggacacagaaaacaggaaactggtcaaaggctcctacatgttagagccttttacagactcactgcgttgagtctaacaaccgcgactgaatgcagcctccaatgtgctcagaagaatgggcttacatttcaagtggccattaggggcccctatgctggcagcaatatatgcaatgagtatggttttaaaaatgctgcctgccctgggtatggcgtgtccacccaaatgccgctgcgagaagctgctcttctactgcgactctcagggcttccactcagtgccaaacgccacagacaagggctctctgggcctgtccctgaggcacaatcacatcacagagctcgaaagagatcaatttgccagcttcagtcaacttacttggctccacttagatcacaatcaaatttcaacagtaaaagaagatgcttttcaaggactatataaacttaaggaattaatcttaagttccaacaaaatattttacttgccaaacacaacttttacccaactgattaacctgcaaaatttggacctgtcttttaatcagctgtcatctctgcacccagagctcttctatggccttcggaagctgcagaccttgcatttacgttccaactccctgcggactatcccagtacgcctgttctgggactgtcgtagtctggagtttctggatttgagcacaaatcgtttgcgaagtttggctcgcaatggatttgcaggattaattaaactgagagagcttcacctagagcacaaccagctgacgaagattaattttgctcatttcctacggctaagcagtctgcacacgctcttcttacaatggaacaaaatcagcaacttgacatgtgggatggagtggacctggggcactttagaaaagctagacctgactggaaatgaaatcaaagccatcgacttgacagtgtttgaaacgatgcccaatcttaaaatactactcatggataacaacaagttaaacagccttgattccaagatcttaaactccctgagatccctcacaaccgttggtctctctggcaatctgtgggaatgcagcgcccgaatatgtgctctggcctcctggctgggcagtttccaaggtcggtgggaacactccatcctatgccacagtcctgaccacacccaaggagaggatattctagatgcagtccatggatttcagctctgctggaatttgtcaaccactgtcactgtcatggctacaacttatagagatccaaccactgaatatacaaaaagaataagctcatcaagttaccatgtgggagacaaagaaatcccaactactgcaggcatagcagttactaccgaggaacactttcctgaaccagacaatgccatcttcactcagcgggtaattacgggaacaatggctttattgttttctttcttttttattatttttatagtgttcatctccaggaagtgctgccctcccactttaagaagaattaggcagtgctcaatggttcagaaccacaggcagctccgatcccaaacacgactccatatgtcaaacatgtcagaccaaggaccgtataatgaatatgaacccacccatgaaggacccttcatcatcattaatggttatggacagtgcaagtgtcagcagctgccatacaaagaatgtgaagtataatatctacccatcatcaaaaatcacatcagataagtaacctattttacatagtagaggctaaatacatatctaatttttaccaatggtgacattaagcctaattttccaaactaagtggagacttagtttttgaagtgttgaagtatttttaatttttttaaatgaaaccatattttaagtgttaaatgaatcaatgctcacattaatttgcactcctgttggaaagtctaaaatgcttacttcaaaataagaaatgtacgtaattatatacaatcgtgtgtaaacctttacactaaggtctccatatactatttttttctactgaaaacaatttagaaagaagctattgggcagaaacagatatagatcaatacctgtttgatcactgctctccatcccatgtaccacaactatcttgctgcttaaaaggagacttagtaaagttctcttgtatgataatttggtatttactcaaatcttcaatttcttgccagggtgggaagtagaatttcatgtatgctgaagactggtaaatattaaacattctccttccagagtttctgcctgggttagtagatattatcaaagtccatatcatgaattcagaaccctttaatgtaattctaataagctgagtgactctttaatatatttacacaatgaatccaagtgactgtgaaaaggtctcattacaatgaaaccaatcctaaataattacaccaacttcttatacatttctcgtttgacttataatggacatgatttttgtggcatttagacaactgttttaaactagcattaaactgtcattgtactaattaatgtactaaatcctatgtttacattaatatgtgaaaaaagatttagaagatattttggagataaacaagacaaactgagtcaatttaacaatcctgacatgctccctccaatttaaaagcacacacacacacacacacacacacacacacactctcgcgctctctctctcaactatcatgatcaaagatgccttgacaaaggggtttaaacctctttcttctgctttttcctgatcttcaaacctcaaagagccaagttaaaaataattggctagcaacaggcttaacactgattcttattgtattacaaaggaaccatgaaaaaaaacactttctaactattatataatacatttcgatctttcaataaagatacgcattcacgctgtaagtgtagttcagtgtaggtgaagaaaacagcaccactgagatgaatctcatggcagaacaactcgacatgcctatgcagccacacagtggtaacttgaaggcagcacagaggtgagggattaaaaggaaaggcagattttgaaatctgactctcaggttagctggagttacaaggcagccaacaatgattatacacaatctgcaccaaacagggaaaggacctgctgctgaaaagggaagaggggtagatcctccaatgtaaatataaacatgccatagttaacaaatgataaggatgccacatttttcatgcagaaaagaaccacaggtattcagtttcttgtattatgatttctaaagaaaacctattaaatatttggaatttagatgcaagctactcattcacacagaacttttccataaacattgttccacatattgaaaaaactgtaaaattatagcactaacttgattttagaaaatgagcattttttacaactgccatttactgtatgtagaaaaaagacataaaaccttagagaaagccactaccatttttcaagttatcttttccccaacatcaacatcaacatgatatccttcattcagggcatattttttcttcccaggatcaaactgaaaacatgttaaggctatagtttagccagtaagatttaatcacaatttttcttctttaatactaagagatgggtaccttagtacccttcacctaacatctctcggtaaaaagcagacaagatcacaaattacagtaaaaatgtgctcttttttaaggtgggcagattagtttgtcaaagtctcagcccagttcaattcagttgatctcgagtggtgagtattttgtctcttgttaaaccagaccctgggcttgtctgggcagagacagaagctgatttaacagcatagagcacagcgccctacttccccacagacaggctgaattagaagcccctattacaaataagagcaccacgagctaaaatttaccaacccatttatcaggatgaccattgccatttgtcaggtgacagacagcttggtcacaacacaactgtgtcctgagcacacaagattccatcagccctgaaggacagcagaggagtattttccatcatttcaaaccacaaacaaaattaagatttaaactgtgggatgggtaagaaatccccttctttggctgggaatctccaccttaatccttaaaggaccataactggcaaaatccttagtgtacggacaaaagcaaattggaaaagcaagccatttactaattcagaggaacagcatagccaaggctagcgaggcatactttccagttgaaaaaaaatcaaaattttttgccttccatttttctgggtaatgtcctttaagaaaagtgaatgacagtagtaccaaaaaggtattttcctttctcatttaaaagcaaaaacctccctttttaattgcctgtagaaggcaagattttctttcatttttgtccatttgtgtttcagaatcagcacaggtttgaagattagactgttagtcatctgtgctttctttaccaactggctagaacggaacagcatcacagcaacgctgcggatcttggttacacagtgtcagagcttttgttttttgatggggttttatcctcttcaccaccactacccactccattttttttctatttttaagattagaggaaaatgaccattaagaaccagaaaaataattaatctctctggaaaaaggaaagctaaagaagactatgataccatacccatctagaaaccaagaactagtttgaaatcgtttatattcatttctgtagcatgacagggatttcaatcacctttctgaaaagagtgggctgataaacttgtaaatccacacacaactctgagaatacccactgccagcatcaaaaagcaaagatactaattttttaagccaaaaatctgtactaacacatgtaatttcttaatgtgcctaagttaatttctgtatcaattcaataaatggaattgactgaacttcccaacgccactaattattaaaatccatctgcttattctaatgctagtcaccaagagctagactccatctttccaataaaaatgagccctatgtagcactaggtttgaattctaaaattcaaaacaggcatttcattttcttaaggcacacttcctacacacagctatcaggggaaaaagctataaatgtcctgttctttttctgaagtgtggatatcaatataaaatttgttaaagaatatttttaacagctgacttacatgatcgttttcctaatacaggaatacagcgacagacctatctgaaaagtctgtttgggggcatacttttcatatcttattgactaaagcccttgagccagg

SEQ ID NO: 53265 - DNA, 3806 bp, Homo sapiens
agaatgacagtctgcagaagtgagctgagcgtgtgcgcggtacggggctctcctgccttctgggctccaacgcagctctgtggctgaactgggtgctcatcacgggaactgctgggctatggaatacagatgtggcagctcaggtagccccaaattgcctggaagaatacatcatgtttttcgataagaagaaattgtaggatccagttttttttttaaccgccccctccccaccccccaaaaaactgtaaagatgcaaaaacgtaatatccatgaagatcctattacctaggaagattttgatgttttgctgcgaatgcggtgttgggatttatttgttcttggagtgttctgcgtggctggcaaagaataatgttccaaaatcggtccatctcccaaggggtccaatttttcttcctgggtgtcagcgagccctgactcactacagtgcagctgacaggggctgtcatgcaactggcccctaagccaaagcaaaagacctaaggacgacctttgaacaatacaaaggatgggtttcaatgtaattaggctactgagcggatcagctgtagcactggttatagcccccactgtcttactgacaatgctttcttctgccgaacgaggatgccctaagggctgtaggtgtgaaggcaaaatggtatattgtgaatctcagaaattacaggagataccctcaagtatatctgctggttgcttaggtttgtcccttcgctataacagccttcaaaaacttaagtataatcaatttaaagggctcaaccagctcacatggctataccttgaccataaccatatcagcaatattgacgaaaatgcttttaatggaatacgcagactcaaagagctgattcttagttccaatagaatctcctattttcttaacaataccttcagacctgtgacaaatttacggaacttggatctgtcctataatcagctgcattctctgggatctgaacagtttcggggcttgcggaagctgctgagtttacatttacggtctaactccctgagaaccatccctgtgcgaatattccaagactgccgcaacctggaacttttggacctgggatataaccggatccgaagtttagccaggaatgtctttgctggcatgatcagactcaaagaacttcacctggagcacaatcaattttccaagctcaacctggccctttttccaaggttggtcagccttcagaacctttacttgcagtggaataaaatcagtgtcataggacagaccatgtcctggacctggagctccttacaaaggcttgatttatcaggcaatgagatcggagctttcagtggacccagtgttttccagtgtgtcccgaatctgcagcgcctcaacctggattccaacaagctcacatttattggtcaagagattttggattcttggatatccctcaatgacatcagtcttgctgggaatatatgggaatgcagcagaaatatttgctcccttgtaaactggctgaaaagttttaaaggtctaagggagaatacaattatctgtgccagtcccaaagagctgcaaggagtaaatgtgatcgatgcagtgaagaactacagcatctgtggcaaaagtactacagagaggtttgatctggccagggctctcccaaagccgacgtttaagcccaagctccccaggccgaagcatgagagcaaaccccctttgcccccgacggtgggagccacagagcccggcccagagaccgatgctgacgccgagcacatctctttccataaaatcatcgcgggcagcgtggcgcttttcctgtccgtgctcgtcatcctgctggttatctacgtgtcatggaagcggtaccctgcgagcatgaagcagctgcagcagcgctccctcatgcgaaggcacaggaaaaagaaaagacagtccctaaagcaaatgactcccagcacccaggaattttatgtagattataaacccaccaacacggagaccagcgagatgctgctgaatgggacgggaccctgcacctataacaaatcgggctccagggagtgtgagatacctttatcaatgaatgtgtcaacctttctggcatacgaccagcccacaataagttactgtggggtgcatcatgaacttctctcccataagtcctttgaaacgaatgcacaggaagatacgatggaaacacacctagagactgagctggacctgagcacaatcacaacagctggccgaatcagtgaccataaacagcagctagcttaactgagatcattggtagccaggggttgctaccaaactttgtaacctcaaggacaaaatgaggaagatgtgttcattgtggactctaaaaacaaaacaaaacacaaaatcccctgttcaaataaacaaaaaatccaagattgattcatgaaataaagaagacatgaattgttttaagtctacactttgtaattagccaagttgtgcagtattttttgacttaaacagagtatgaccctgaaaaataaaagaatcttttttttcaaaactcatcctacctacctgtaaaaactgtacaaagctaatgtatttttcatattgtaaagtttcaattgtagaaacaactggtatgtacagtaccataatttaattacattttactttaaaaactttacacatttcagtttctaaaattttaaattaacaaaaattatttcttgtgttattcagagttactcagttttgtaaggactgttttgttactgcttttgtgcccagaaaccttgactctaaaattctgtgctgtgcgaaacatgcacgatttttattatgcttactgcgtagaattttatctacttgttccagaaataatacattaaccaaaaaggatttaattgttcagacttgtaagaggttcttcaattacataggcaggtttttcttaaaaatgaaaaaaaaatcaaagatttttttaacagttctcagacttaactgttgccttgaattacagcctagtttctaagcagtgaaatgtaatgataaagagggatattttaacatatttccgaatgaatgactcattatttcattcttttgagtaaccattgttaagggttgggggaaagcatggacaaaacatcactggaaacaaaggccgtaaccacagcaacagactttgtgatacagttaaaaggtgcagctgccagtgacaaataaaaacttttgttacatctcattattttcaggccaaggtgggagtatagtgcataataattgtacagtagcaatttttatcctaattaacccattgcggtttacctaaaagtaaccatcagtcagtgcaaaatgtgcctggttcttaagacaactttttatttagaactgtgagaccggtattttggaaacatttcaaaggaaacatatgaatttgttttgcgttgtgcactacatcatttctctcctgaggaagaattttaaacatgtacagctcattcaatatagatatgagccatggtggagaactttatcactcaagtagacggtaaacatccttaatatgttctaaattgtttatattgctatccataatgggattcacctccaaattatcaaagaaataactcagagtaatttgacaccagcccagatcatatattgattatacaattgtattataaagttcattcaaatcaaattaagaaaacctgagtctttagaagctgaaataatcaacttgtttgtgctgtttgcttgacataggttattgtttgaaaatattgttactttatcaataggaaaaaaaaaaaaaaaaaaa

SEQ ID NO: 53266 - DNA, 3616 bp, Homo sapiens
agtgtatcacaaactcaagcattagcaccaacaagctctgagcatcatcagtctctggaaagccttctgaattagacaagggctgcctcccagcacagctacaaaacactttaaacctgaccagctaaatggataaacctagcctgcatagcttttaaactggggtctcatacagcccaggaggcctacttgcttcaagaactgaaaatccagaggatgaattgctttatctgggaatggcaaaagccagcacaataaggaatgccagtttgtatggggctactagctcacatgcgggatcagaatggtgtgaatgacagccgcactgtgtcatgaaggtggtggtggtttccgcacaagagaccaaataagaagaaagctgagagaggggggaaacgtttttggatgacaaaggatgggtttccatttaattacgcagctgaaaggcatgagtgtggtgctggtgctacttcctacactgctgcttgttatgctcacgggtgctcagagagcttgcccaaagaactgcagatgtgatggcaaaattgtgtactgtgagtctcatgctttcgcaggtatccctgagaacatttctggagggtcacaaggcttatcattaaggttcaacagcattcagaagctcaaatccaatcagtttgccggccttaaccagcttatatggctttatcttgaccataattacattagctcagtggatgaagatgcatttcaagggatccgtagactgaaagaattaattctaagctccaacaaaattacttatctgcacaataaaacatttcacccagttcccaatctccgcaatctggacctctcctacaataagcttcagacattgcaatctgaacaatttaaaggccttcggaaactcatcattttgcacttgagatctaactcactaaagactgtgcccataagagtttttcaagactgtcggaatcttgattttttggatttgggttacaatcgtcttcgaagcttgtcccgaaatgcatttgctggcctcttgaagttaaaggagctccacctggagcacaaccagttttccaagatcaactttgctcattttccacgtctcttcaacctccgctcaatttacttacaatggaacaggattcgctccattagccaaggtttgacatggacttggagttccttacacaacttggatttatcagggaatgacatccaaggaattgagccgggcacatttaaatgcctccccaatttacaaaaattgaatttggattccaacaagctcaccaatatctcacaggaaactgtcaatgcgtggatatcattaatatccatcacattgtctggaaatatgtgggaatgcagtcggagcatttgtcctttattttattggcttaagaatttcaaaggaaataaggaaagcaccatgatatgtgcgggacctaagcacatccagggtgaaaaggttagtgatgcagtggaaacatataatatctgttctgaagtccaggtggtcaacacagaaagatcacacctggtgccccaaactccccagaaacctctgattatccctagacctaccatcttcaaacctgacgtcacccaatccacctttgaaacaccaagcccttccccagggtttcagattcctggcgcagagcaagagtatgagcatgtttcatttcacaaaattattgccgggagtgtggctctctttctctcagtggccatgatcctcttggtgatctatgtgtcttggaaacgctacccagccagcatgaaacaactccagcaacactctcttatgaagaggcggcggaaaaaggccagagagtctgaaagacaaatgaattcccctttacaggagtattatgtggactacaagcctacaaactctgagaccatggatatatcggttaatggatctgggccctgcacatataccatctctggctccagggaatgtgaggtatgaaccatgatcctcctaaaagcatttctactgcggggaaggagaggtaaatgtttgaagccctagaggtgtctctaatcactagaaagattaatgacccttttgcttttgggttttgctcagtgtgaaaggttacttaattaaattacaaccaccaggaaattgactgcttttttttttttttaaatggttgaaacttgaaggaagttcattcaaggataagttggaataaagcactatgttaaaacatctgctttttaacaatttgtatacaggggttggacttaaaaacacacatacaaacaaaactcttttcattctgaaatttctgtctggttcttggtgtttgactgttgtaatggagtaaagaagagggccaacttaatttaaaaataaagtgagtttaccaaaattccagaaggtaatgaagatttaaaccaaagagcaattttcccaagggttgattttgttgtaaatttttagttttaatgaaagcatgcaacagggatctcacacccatgttacttgccatttagttattataccagcatagagaatgtcagaggcctactgtgtaattgtatcaggctcctaaggcttctttcttttttttttttttgtttccttctttcctactttctttcactccttcctttccttcctttctcttccttctttttttgtttgtttgtttgttttttaattactgggatatagatccgatttcaaaggtttttatgcactggctatttgtgtttaatcagaatgaaacttcaattccatgctttggctttgtccctggtaactaaaatcaggtcacaattttgtggatgatttagcaataataaaatggcagtcataacagggactgtttgtcagtattgctgtcatccccaaaagaaatgatatgtattcttgttaaacttattaaaaaataagtgatacaaatatttataaataaaaggagagaggtttgagttctgggtatcctccctttctgtaacagcctcaaataaaggtgtaccttccatgttatattatttttgtttttataagaataaatttggacccggtttctgattatttaatttaaaagatcacttacaggatcatgttagtgagcagacaaatagtcacaaatttcaaacttgtcaataagtaatgctggatgtaaattgttcctttcttggtaatgttgatcattatgtgcaaagactgactactaaggccttgttgctggaagaaactagtgaagagaggttaaattctggcaatataatgttttagtatctgattttagatgatcactctttcaaaagacagttttaatgagtaattaaagatgttgccctttctaatgctagttaacagttggaaaatataattgctctttgatagcatatactccaatttttccatagtcctaactacaaatgctaatgaaaatgttttcagacaaagcactgaatttgaaataatctctaactcagtacaatttggactattgaactgttcttcaaagaattcattttcttcttttttgtgtatcattgaaaataagagaagtaatcctagataataaattcctaaaaggaaactgtataagcaattgcccttaaaaattaaaaagaataaaagattttctat

SEQ ID NO: 53267 - DNA, 3688 bp, Homo sapiens
ccctttcttccctctctcctctctctctctccctccatccctctctttccttctcagtttgtgactgacccagcagccccgtcccccgtctgccacaagcagtccacctcctggtgctgtgtgctgcgtgccagccgctgcccccgctgagtggagactctggcaccagtgcccactgcgctctgcctgccggtggtgtctggatttctataggaatcccaggagggtcttactggagggttgagagccacctgattgaaggcatttgcagtcagaataaagacggctgccgcagcatgaacccctgagctgatgagtcttattatagcccggctggcggaagacagagtgctgctattcacctctgcgtgggcgtcggtggtgcagggggaagcagcaggccatccagcggctcacaccctacgcggctgcagctgccaagggcctggcccctgcctccctcgggccatggactgacaggcggcgcacccaggggctcctctctccccagagcgacagggcccggagagccgtgggcctcaccatgctggcgccgggcagcagccctgggcagaggggcaggctcgccctgcagtggaggcaagtctcctggatcacctgctggatcgccctgtatgctgtggaggccctccccacctgccctttctcctgcaagtgtgacagccgcagcctggaggtggactgcagtggccttggcctcaccacggtgcccccagacgtgcccgcagccacccgaaccctcttgctcttgaacaataagctgagtgccctgccaagctgggctttcgccaacctctccagcctgcagcggttggacctgtccaacaacttcctggaccggctgccccgctccattttcggggacctgacgaatctgactgagcttcagctgcgcaataacagcatcaggaccctggacagggacctgctgcggcactcgccgctgctccgccacctggacctgtccatcaacggcctggcccagttgccccctggtcttttcgacgggctcctggctctgcgctccctctcgcttcgctccaaccgtctgcagaatctggaccggctgacatttgaacccctagcaaacctgcagctgctgcaggtcggggataacccctgggagtgtgactgtaacctgcgtgagttcaaacactggatggagtggttctcctaccgagggggacgcttggaccagcttgcctgcaccctgcccaaggagctgagggggaaggacatgcggatggtccccatggagatgttcaactactgctcccagctggaggacgagaatagctcagctgggctggatattcctgggccaccctgcaccaaggccagtccagagcctgctaagcccaagcccggggctgagccggagccggagcccagcacagcctgcccacagaagcagaggcaccggccggcgagcgtgaggcgagccatgggcacggtgatcattgcaggggtcgtgtgcggcgtcgtctgcatcatgatggtggtggccgctgcctatggctgcatctacgcctccctcatggccaagtaccaccgggagctcaaaaagcgccagcccctgatgggggaccccgagggcgagcacgaggaccagaagcagatctcttctgtggcctgagcgcccatccccacccggccaggtaggaagggcggggagagcacacggcattgctcagccacagctcccaccttgacccggcgctggccactgcctccccgagtccaccctcctccccgccctccagcagacaagccacaccgggttctctccctgcactttcgaggctccctgaaagccaccgtgctgggggctcctgctgatgctcctgtctgggccagtaaatctttggaacatgtgggggatctccctaagctctggccacagcaaagcaaggaggtgtgtgcaagaggaggcttccggactgggcattcccctgtcgcccttcctgccctggggtggccatagctggtgactcttcctaccttgctggtcccacctcacctgcattgaggggacggggagggagggatctgagggatgaaggtagatttctgagactctctcctaagccagaaagacgttcttaacacccctgcagtgtgaaagctggtccagctctacaactgttggtaccaatgtgcaaacacaccagccctgccatctggacccagcactcagaaacaccatacacccctggccgacgccatcatgcccctggatctgctataggccacactgaccacatgctcctggattcgctaattcactcacacacccattgcatcaccagtgcggtcgcatggattgaaagaattaatacacacacacacacacacacactcacacggtcacacggagaccgaggctatgagcgctcgaacagcagagacatgctcttccccaggggtctccctgagaccacagagcctctcgcgtgctcactgcaatcttctcaagtcaacagcaggaaggaactcaaccagtaacaccaggatcctttgagatcctctaaagtgggccaaagtggtgcccctggaggagccctcctgtcaccatggtaaccctctcacacctctcctgctgggctttcccgggataccacccaggggcctggagcggctgcatgtgtgcatggcggcctcctgaggacccagccacacaccactggtgttgcctcggtcctgcccacgcatctcacagcaccaggccctgtggggcccccactgattcctccacagcctgcagcctggcaccgtgactctgtgcctctcgccctccatcttcagtactcctggcctgtgacttcagggctgggacttggtggtgctttgccattggtggcaccctctggggaaagcaggtggcaggcagagaacacggtggctcccctgaggctcattgcctgccagcttattgcagacagagcccaggagcaggagcgggtggccacgtgctgcccagaggctcccaggatggggcctctgttcccgggctttgtctgctcagtgtggctccctagagcacccagccggggccaaaccagagagtgggtggggagcctgtctgggacagagccacctgctgccaaggcagtgcaagttttccaggttacctgtccccctccctagctctgcccctcctcagagtgtgaagatggtgggtacctaggtgtcatgctcacaggctcaggaggcatcaggctcgtccctggctctgggatggaatctcaatgggggctcaggaagaggccagcaagaaccctgaagccaagggtctgagcagagggagttggcaggcctagctcctgtgccccactccgaccctccctgctcatgcggcagtgggtgggtgaggtgggctgggggcctggaggagtgcctttgaggaggtcagtcctggcaggtggacagaggacgcctggcatgggctgcttactgggaccccaggcggccctggccatggccacagtcttccttcttttggcgtgtgggctggtaccagatctggggattttctaaagggactggggggaggggagggcattgtcaatggtggtatctttagcctgagacagaagatttttaaaggcaaaattatatttctggtttgttgtttcagaagaccaataaagactgtattttcctatgt

SEQ ID NO: 53268 - DNA, 957 bp, Homo sapiens
cgcgtctgcggctgcgttccccgaaagacgaggctgcgcccggattccggtccgcagggagaccgaagggcacagctccccgcgccgcgcacgccgcccgagcccggagtgcggacacccccgggatgcttgcgccccagaggacccgcgccccaagcccccgcgccgcccccaggcccacccggagcatgctgcctgcagccatgaagggcctcggcctggcgctgctggccgtcctgctgtgctcggcgcccgctcatggcctgtggtgccaggactgcaccctgaccaccaactccagccattgcaccccaaagcagtgccagccgtccgacacggtgtgtgccagtgtccgaatcaccgatcccagcagcagcaggaaggatcactcggtgaacaagatgtgtgcctcctcctgtgacttcgttaagcgacactttttctcagactatctgatggggtttattaactctgggatcttaaaggtcgacgtggactgctgcgagaaggatttgtgcaatggggcggcaggggcagggcacagcccctgggccctggccggggggctcctgctcagcctggggcctgccctcctctgggctgggccctgatgtctcctccttcccacggggcttctgagcttgctcccctgagcctgtggctgccctctccccagcctggcgtggctggggctgggggcagccttggcccagctccgtggctgtggcctgtggctctcactcctcccccgacgtgaagcctccctgtctctccgccagctctgagtcccaggcagctggacatctccaggaaaccaggccatctgggcaggaggcctggggatgagggtggggggggacccccaggtcccggaggggaagtgaagcaacagcccagctggaagggcgtcttctgcggagaaataaagtcacttttgagtcctgagaaaaaaaaaaa

SEQ ID NO: 53269 - DNA, 2380 bp, Homo sapiens
ctagaccctggaaggcaggggactgcgagctgggctggcggagcagaggtgcagaagcaactgagtccaagttgtctggcggcttcaggtggacccagaagacgtccccaactcagggagattcagcgatcactcactcgctgtacagaatgatattcctcacggcactgcctctgttctggattatgatttcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcaacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcctccttccccaacaccaccctgcagttcgagggctacgccagcatggacgtcaagtaccccccggtgattgtggagatgaactcctcggtggaggccatcgagggctcccacgtgagcctgctctgtggggctgacagcaaccccccgccgctgctgacctggatgcgggacgggacagtcctccgggaggcggtggccgagagcctgctcctggagctggaggaggtgacccccgccgaagacggcgtctatgcctgcctggccgagaatgcctatggccaggacaaccgcaccgtggggctcagtgtcatgtatgcaccctggaagccaacagtgaacgggacaatggtggccgtagagggggagacggtctctatcttgtgctccacacagagcaacccggaccctattctcaccatcttcaaggagaagcagatcctgtccacggtcatctacgagagcgagctgcagctggagctgccggccgtgtcacccgaggatgatggagagtactggtgtgtggctgagaaccagtatggccagagggccaccgccttcaacctgtctgtggagttcgcccctgtgctcctcctggagtcccactgcgcggcagcccgagacacggtgcagtgcctgtgcgtggtgaagtccaacccggagccgtccgtggcctttgagctgccatcgcgcaatgtgaccgtgaacgagagcgagcgggagttcgtgtactcggagcgcagcggcctcgtgctcaccagcatcctcacgctgcgggggcaggcccaggccccgccccgcgtcatctgcaccgcgaggaacctctatggcgccaagagcctggagctgcccttccagggagcccatcgactgatgtgggccaagatcgggcctgtgggcgccgtggtcgcctttgccatcctgattgccatcgtctgctacattacccagacacgcaggaaaaagaacgtgacagagagccccagcttctcggcaggggacaaccctcccgtcctgttcagcagcgacttccgcatctctggggcaccagagaagtacgagagcgagaggcgcctgggatctgagaggaggctgctgggccttcggggtgagcccccagagctggacctgagctattctcactcggacctggggaaacggcccaccaaggacagctacacgctgacggaggagctagctgagtatgctgaaatccgggtcaagtgaaggagctgggggcagcctgcgtggctgacccccctcaggaccctcgctggcccccactggctgtgggctcccttcctcccaaaagtatcgggggctggggcaggaggggagtgaggcaggtgacagtgaggtcctgggggcctgacctccccctccttcccagctgcccctccctgccagcacccccacgccctcattacggctcctctctaacctcctttaccctcatctgtctggaggggagctctgtctgtccgtgttatttattgctacttcctgcctggtctcctgcccccacacctggccctggggcctgtacaaaagggacatgaaataaatgccccaaagcc

SEQ ID NO: 53270 - DNA, 2425 bp, Homo sapiens
ctagaccctggaaggcaggggactgcgagctgggctggcggagcagaggtgcagaagcaactgagtccaagttgtctggcggcttcaggtggacccagaagacgtccccaactcagggagattcagcgatcactcactcgctgtacagaatgatattcctcacggcactgcctctgttctggattatgatttcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcaacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcctccttccccaacaccaccctgcagttcgagggctacgccagcatggacgtcaagtaccccccggtgattgtggagatgaactcctcggtggaggccatcgagggctcccacgtgagcctgctctgtggggctgacagcaaccccccgccgctgctgacctggatgcgggacgggacagtcctccgggaggcggtggccgagagcctgctcctggagctggaggaggtgacccccgccgaagacggcgtctatgcctgcctggccgagaatgcctatggccaggacaaccgcaccgtggggctcagtgtcatgtatgcaccctggaagccaacagtgaacgggacaatggtggccgtagagggggagacggtctctatcttgtgctccacacagagcaacccggaccctattctcaccatcttcaaggagaagcagatcctgtccacggtcatctacgagagcgagctgcagctggagctgccggccgtgtcacccgaggatgatggagagtactggtgtgtggctgagaaccagtatggccagagggccaccgccttcaacctgtctgtggagttcgcccctgtgctcctcctggagtcccactgcgcggcagcccgagacacggtgcagtgcctgtgcgtggtgaagtccaacccggagccgtccgtggcctttgagctgccatcgcgcaatgtgaccgtgaacgagagcgagcgggagttcgtgtactcggagcgcagcggcctcgtgctcaccagcatcctcacgctgcgggggcaggcccaggccccgccccgcgtcatctgcaccgcgaggaacctctatggcgccaagagcctggagctgcccttccagggagcccatcgactgatgtgggccaagatcgggcctgtgggcgccgtggtcgcctttgccatcctgattgccatcgtctgctacattacccagacacgcaggaaaaagaacgtgacagagagccccagcttctcggcaggggacaaccctcccgtcctgttcagcagcgacttccgcatctctggggcaccagagaagtacgagtccaaagaggtttctaccctggaatctcactgagtgccccaggagagcgagaggcgcctgggatctgagaggaggctgctgggccttcggggtgagcccccagagctggacctgagctattctcactcggacctggggaaacggcccaccaaggacagctacacgctgacggaggagctagctgagtatgctgaaatccgggtcaagtgaaggagctgggggcagcctgcgtggctgacccccctcaggaccctcgctggcccccactggctgtgggctcccttcctcccaaaagtatcgggggctggggcaggaggggagtgaggcaggtgacagtgaggtcctgggggcctgacctccccctccttcccagctgcccctccctgccagcacccccacgccctcattacggctcctctctaacctcctttaccctcatctgtctggaggggagctctgtctgtccgtgttatttattgctacttcctgcctggtctcctgcccccacacctggccctggggcctgtacaaaagggacatgaaataaatgccccaaagcc

SEQ ID NO: 53271 - DNA, 5844 bp, Homo sapiens
agtctggggcgggcgctcgggctgcgcgggctctgggcagcagcagcagcagcagcagcatcctctcttcctttacttcccttccgcttctttctcttccttctccttctttttcccccccctccccttcttcccctaacccttctacccctctcctttttctccggagggcgctaagtccgtgagcggtggcagtcgcgaccgcgggtgcatccagtttctgcgcccagattttattgatctaatccaaagtatcttataacttctggctggaattaagattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagcagcaggtggggaatcagctctggctcccagtgtatttaaacaggcaaaggacaaagtctctaattctaccttgtcaaagattcctgctttacagggtagcacaaagtccccaagatacagctcagcctgccctagcacgactaaaagggctacattttctgacagtttattaatacagcccacctcagcaggctccacagaccgtttgccatactcaaaatcagggaacaaggacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggttaggattttaaacaagaagatcgattttagcaaagttcagtccagatgtggttccaaggataacatcaaacattcggctgggggcggaaatgtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacct

SEQ ID NO: 53272 - DNA, 9445 bp, Homo sapiens
gggataatgctcccggagaaggattctgcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacggaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagtgccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaagagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacct

SEQ ID NO: 53273 - DNA, 5377 bp, Homo sapiens
gggataatgctcccggagaaggattctgcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacct

SEQ ID NO: 53274 - DNA, 9538 bp, Homo sapiens
gggataatgctcccggagaaggattctgcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagatttacttacagcctcgaagatggagttccacgatcaacaggaattgactccctctacagctgagccttcagaccagaaggaaaaggagtcagagaagcaaagtaagcctggtgaagaccttaaacatgctgccttagtttctcagccagagacaactaaaacttaccctgataaaaaggacatgcaaggcacggaagaagaaaaagcacccctagctttgtttgggcacactcttgttgccagcctggaagacatgaaacagaagacagaaccaagccttgtagtacctggcattgacctccctaaagagcctccaactccaaaagaacaaaaggactggttcatcgaaatgccaacggaagcaaaaaaggatgagtggggtttagttgcccccatatctcctggccctctgactcccatgagggaaaaagatgtatttgatgatatcccaaaatgggaagggaaacagtttgattctcccatgccaagtccctttcaagggggaagcttcactcttcctttagatgtcatgaagaatgaaatagttacagaaacatcgccctttgcccctgcctttttacagccagatgacaaaaaatctctgcaacaaaccagtggcccagctactgccaaagatagttttaaaattgaagagccccatgaggctaaacctgacaaaatggcagaagcaccaccctcagaggcaatgaccttacccaaagatgctcacattccagttgtagaagaacatgttatggggaaagttttagaggaagaaaaggaggccataaatcaagagactgtgcagcaaagggatactttcacccccagtggacaggaacctatacttactgaaaaggaaactgagctgaagcttgaagaaaaaaccaccatttctgacaaagaagctgtgccaaaagagagtaaacccccaaaacctgcagatgaagaaataggcataattcagacctccacagagcacactttctcagaacagaaagaccaagagcctaccacagatatgttgaaacaggactcgttccctgtaagtttggagcaagcagttacagattcagccatgacctctaaaacactggagaaagccatgaccgaaccatctgcattaattgaaaagagctcaattcaggaactttttgaaatgagagttgatgacaaagataagattgaaggagttggagctgcaacatcagctgagcttgatatgccattttatgaagataaatcaggaatgtccaagtactttgaaacatctgccttgaaagaagaagcaacaaaaagcattgagccaggcagtgattactatgaactgagtgacactagagaaagtgtccatgagtctattgataccatgtctcccatgcataaaaatggtgacaaggagtttcaaacaggaaaagaatcccagcccagtcctccagcacaagaagcagggtacagcactctcgcacagagttatccatcagatttacctgaagaacccagttctcctcaagaaagaatgttcactattgatccaaaagtgtatggagagaaaagggacctccacagtaagaataaggatgatttgacccttagcaggagtttaggacttggtggtaggtctgcaatagaacaaagaagcatgtcaatcaatttgccgatgtcttgcctagattccatagcccttggatttaactttggtcggggacatgatctttctcctctggcttccgatattctaaccaacactagtggaagtatggatgaaggggatgattaccttccagccaccacacctgcactggagaaagccccttgcttccctgtagaaagcaaagaggaagaacagatagagaaagtaaaagctactggagaagaaagtactcaagcggagatatcatgtgagtctcctttcctagccaaagatttttacaaaaatggtactgtcatggcacctgaccttcctgaaatgctagatctggcaggcacaaggtcaagattggcttctgtgagtgcagatgctgaggttgccaggaggaaatcagtcccatcagagactgtggttgaggatagtcgtactggcttgcccccggtaactgatgaaaaccatgtcattgtaaaaacggacagtcagctcgaagacctgggctactgtgtgttcaataagtacacagtcccattgccatcacctgttcaagacagtgagaatttatcaggggagagtggtaccttttacgaaggcactgatgataaagttcgaagagatttggccacagacctttcactgattgaagtgaaactggcagcagccggaagagtcaaagatgagttcagtgttgacaaagaagcatccgcgcatatctctggtgacaaatcaggactgagtaaggagtttgaccaagagaagaaagctaatgataggttggatactgtactagaaaagagtgaagaacatgctgattcaaaagaacatgccaagaaaactgaagaggctggtgatgaaatagaaacattcggattaggagtaacctatgagcaagctttggccaaagatttgtcaataccaacagatgcatcctctgagaaagcagagaagggtcttagttcagtgccagagatagctgaggtagaaccatccaaaaaggtggaacaaggtctggattttgctgtccagggtcaactagatgttaaaattagtgactttggacagatggcttcagggctaaacatagatgatagaagggcaacagagctaaaacttgaggctacacaggacatgaccccctcatccaaagcaccgcaggaggcagatgcatttatgggtgttgagtctggccacatgaaagaaggcactaaagttagtgagacagaagtcaaagagaaggtggccaagcctgacttggtgcaccaggaggctgtagacaaggaggagtcctatgaatctagtggtgagcatgaaagtctcaccatggagtccttgaaagctgatgagggcaagaaggaaacatctccagaatcatctctaattcaagatgagattgccgtcaaattgtcagtggaaataccttgcccacctgctgtttcagaggctgatttagccacagatgagagagctgatgtccagatggaatttattcaggggccaaaagaagaaagcaaagagaccccagatatatccatcacgccttctgatgttgcagagccattgcatgaaacgatcgtatctgaaccagcagagattcagagtgaggaagaagagatagaagcccagggagaatatgataaactgctcttccgctcagacacccttcagataactgacctgggtgtctcaggtgccagggaggaatttgtggagacctgcccaagtgaacacaaaggagtgattgagtctgttgtgaccatcgaggatgatttcatcactgtagtgcaaaccacaactgatgaaggggagtcagggtcccacagcgtgcgttttgcagccctagagcagcctgaggtggaaaggagaccatctcctcatgatgaagaagagtttgaagtagaagaggcagctgaagcccaggcagaacccaaagatggttccccagaggctccagcttcccctgagagagaagaggttgcactttctgaatataagacagaaacctatgacgattacaaagatgagaccaccattgacgactccatcatggacgctgacagcctctgggtggacactcaagatgatgataggagcatcatgacagaacagttagaaactattcctaaagaggagaaagctgaaaaggaagctcggagatcatctcttgagaaacatagaaaagaaaagccttttaaaaccgggagaggcagaatttccactcctgaaagaaaagtagctaaaaaggaacctagcacagtctccagagatgaagtgagaaggaaaaaagcagtttataagaaggctgaacttgctaaaaaaacagaagttcaggcccactctccctccaggaaattcattttaaaacctgctatcaaatatactagaccaactcatctctcctgtgttaagcggaaaaccacagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggttaggattttaaacaagaagatcgattttagcaaagttcagtccagatgtggttccaaggataacatcaaacattcggctgggggcggaaatgtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacct

SEQ ID NO: 53275 - DNA, 5470 bp, Homo sapiens
gggataatgctcccggagaaggattctgcagcagttctcaaaggctagacttgagtggtattgctgcatatgcgctgattcttcagcttgtctctaaccgaggaagcattgattgggagctactcattcagaaaattaaaagaaagaagccagaaaatattatcaaccctttgagaacacgacacaacgaactttatattttaccacttccttgaatagttgcaggagaaataacaaggcattgaagaatggcagatgaacggaaagatgaagcaaaggcacctcactggacctcagcaccgctaacagaggcatctgcacactcacatccacctgagattaaggatcaaggcggagcaggggaaggacttgtccgaagcgccaatggattcccatacagggaggatgaagagggtgcctttggagagcatgggtcacagggcacctattcaaataccaaagagaatgggatcaacggagagctgacctcagctgacagagaaacagcagaggaggtgtctgcaaggatagttcaagtagtcactgctgaggctgtagcagtcctgaaaggtgaacaagagaaagaagctcaacataaagaccagactgcagctctgcctttagcagctgaagaaacagctaatctgcctccttctccacccccatcacctgcctcagaacagactgtcacagtggaggaagcagcaggtggggaatcagctctggctcccagtgtatttaaacaggcaaaggacaaagtctctgacggagtaaccaagagcccagaaaagcgctcttctctcccaagaccttcctccattctccctcctcggcgaggtgtgtcaggagacagagatgagaattccttctctctcaacagttctatctcttcttcagcacggcggaccaccaggtcagagccaattcgcagagcagggaagagtggtacctcaacacccactacccctgggtctactgccatcactcctggcaccccaccaagttattcttcacgcacaccaggcactcctggaacccctagctatcccaggacccctcacacaccaggaacccccaagtctgccatcttggtgccgagtgagaagaaggtcgccatcatacgtactcctccaaaatctcctgcgactcccaagcagcttcggcttattaaccaaccactgccagacctgaagaatgtcaaatccaaaatcggatcaacagacaacatcaaataccagcctaaaggggggcaggttaggattttaaacaagaagatcgattttagcaaagttcagtccagatgtggttccaaggataacatcaaacattcggctgggggcggaaatgtacaaattgttaccaagaaaatagacctaagccatgtgacatccaaatgtggctctctgaagaacatccgccacaggccaggtggcggacgtgtgaaaattgagagtgtaaaactagatttcaaagaaaaggcccaagctaaagttggttctcttgataatgctcatcatgtacctggaggtggtaatgtcaagattgacagccaaaagttgaacttcagagagcatgctaaagcccgtgtggaccatggggctgagatcattacacagtccccaggcagatccagcgtggcatcaccccgacgactcagcaatgtctcctcgtctggaagcatcaacctgctcgaatctcctcagcttgccactttggctgaggatgtcactgctgcactcgctaagcagggcttgtgaatatttctcatttagcattgaaataataatatttaggcatgagctcttggcaggagtgggctctgagcagttgttatattcattctttataaaccataaaataaataatctcatccccaaactgtagtaattgttacaattttctatttaaaaaatgaatagtacatgcagaaattgacctgatttccatttgcaacaggaagacactggctttacatgggttcaattggacaattatttttgctctgctctgttttgcatggagtattattattttaaaaattgcatttttacctttcatgtgcctgaaggctatccactacattctgaaggccttgttaaaatccaagctgctcatttcactattctgtttctgagtgagaagataaaaactgcccattgtaacttatttcaggttaaattaaaccaaggagtctgattgcaggaagggaagagcatgtaagaaataagtttttttaaagtgttattttgtataaatgggaagaaagattcaattaagttattaacatttgggacctggataattatatcagagtatgtcagtccaataaattatttaactaattaaaaaatagttgcaaagcatttgagctgtggttgaggaagtggtgtaaaagtgcatccattaggaatgatgcactttcattaggatggactcgtgtctgattagaatgtcagttgatcagctagatttgtgtccacactaccagtttcacaccccctttccatctgtttgatacagtattatagatataaatatatatatatttctctgtggccatttgtgatacttcctcatatacttgaatattatacttctttattcacagtatctgtgtctcctgcaccctttggtgttgcaattttagatatgtgaaagtagatgttagcagggttctctccctatttaaaaaaaatacattaaaaaagacaaaaaattttagcatgaagttgctttctgtaacaactcaaagccgtaaccctgttttagtgccagatacaagtctctcccgtgatgctagacaaaaaattatttttctttgctttcaccaacatggagtttgtgggggtgggtccagttatacatgaaagggtttacagattgttggtttaagattatggatttatctcatttttaatcacaggatagtttggggtttattcctattattattcatgaaaccgacttaagattttttctttatttttctttttttttccatttgctaaagttgaaagttgaaactaactataatagtttgaaacatgttttctcatttttccaaatagtatctgtttattaaattctctaatagaagatgtttgtctttcttacccaaagtaaagatcccctgatcagaaagaaaaaatacaatactttgggaagctatagctataaaacacttgagacacagatatctaaatcagtttttttccaagactccaacattgcactctgtaaagtaacacactgtgatctagtattatttatcagtagataatactgttctgactgtatatacagtctagaactcacaaatcaattagttcctctcacaaatcattcatcttagacttacaaataaggaatgaaatagtcaatggcctgattaaggcaaagagctaccaggctagatggacactttttaaaaattttatctgttctttttcttgctcagggctggtaggttggatctgaaccattaaaatcaaatggtccactaggcgtatgatctctttgagccaaatcagttcctgaatataaaggaggaaatgatgaggatgtactgaggcaacggggaagtatagaaacatccaagacaaaagccaagggatgcaaaggcagagacacaggtgctttttggtgacccagtggatatggcaaccagtgtaactgccatacaagaaaccctaggagcaaacccacaccactcattctcagctaagagattttacacaggcaaacgtgtcttaaaccatctataaatcagttattttatatgacagtcaaaaccttagaaaccttaggatcattatatctattttctgcctattaattgctgtgaggtttgatttgaccaatctgggcaatttattcatcagcttcccttgaagtgcaccagaaaatagaagaaaggtgtgtggagacttagggtattttattacatgttttcatagtcttaaatagtgattaaatttctctagaaagaagttaacagctcattagaaaagttttaacctgtgaaataagtatttttctcaacattctttaaagtttttatataagttaacactaggtaaacattctgcatactagaagtcagtttattacaaatacatgtcaaaaataaagattatacaaggcaccaaactactagatttggcattaaaacaaatgtttatttctaatcacaacaaaattataatgaataaatgttcttgctttgtatggaaatacaattctttattaaagttaacagaaaggaactgatcgtttgtaccagtaaaagagagaaacacacaggttaaatatcttcttgtggggttaaggggtagaacctatcttgccttcactctcaagataacgactcaaattaagctttttgagcaccactcttgtggggacacacatacgctgatctaggaatgaaatcttcgtggtctcaattctagatctactatgccagtttctctctggctttagcctttgagaacctgtataagaatacgtaagtaatccagagctgtgaagagtttaaaggccaacttctccagtgaactcaacctctgggtcacttgcaaccagaaattggatacctcataatgatgcaggaaagacccgagttcatgatgagtttcaaaggccacgttcatttaggaaccaactctctctggatttacctgctgagttccagcagcgtgatgggctgacatcccacctacaagtatgacacctgtgtaacaccagctaggtacggctggagaaggctgaagagagaatgccattaaatggaagaatgtactgattgtagtgaccttctccacacacacacacacacacacacacacacacacctacagtaatacagcaagcgtggaataatcagccaatatataacattccatcagtattttattaaggaaataacctgaatgtggttgattttgacatagctgcaattacagttttcttctatttttcaagccacaataaggaaaataaactactcatggtctaaatactagagataaagtagattcatggcttggtaaggaaattttaagcattccttcaaagattgacgtgctaaaataagcattgatgttttgagtttttttacacctaggatttttagcttgggtgtgtaggtgaaggccaagactctctgcaggaaaaagcttattttcaaactcagaaaataaaatgtcaatcataaaaatctacttcaactttagcaaaaagaaaaaaaaatcaacaaaaagtatactctgtatgctgggattccgaggttccaacacactgttacaaatctgtggggggtttctttcttctgataattctagagcctgttaccatagaaaggcatttcttcaatggctggttgtagttagttcatgtttttcaatcaaatttgcaaatgtatttgttgctgtatagtgattgttttgcaaaataaaattgcttgtcacct

SEQ ID NO: 53276 - DNA, 4173 bp, Homo sapiens
gagctttggagcatcttaaggagctcagctcagtaaacaaactcttgcatttcagccagaaagagcctcttgtaacaagtattcaaaggggagagtttctgcatcttttactttgcagtccactatggtagaaaacttgacattccatagataatgatactgggttttctttccaagatccgacgtttaaaagaaatatgagccattctaagctttaagaagggttcaggaaacacaggaattagtagacagcgctcccaatgcaggttaagacgacagcctgcgcccccaactagcacagctcagcgagcatgaccatatgccattctcgtctccagagagctggtggcagtgacctcactaggagaaaacacatccctcagccgtgggacttgacagaatgaggtgcgcgagggaggccgctagccgagacttggcctttcctgactgcccctgtgttacctgggcagctccagatcactgagcccacaatggctgagaagggtgactgcatcgccagtgtctatgggtatgacctcggtgggcgctttgttgacttccaacccctgggcttcggtgtcaatggtttggtgctgtcggccgtggacagccgggcctgccggaaggtcgctgtgaagaagattgccctgagcgatgcccgcagcatgaagcacgcgctccgagagatcaagatcattcggcgcctggaccacgacaacatcgtcaaagtgtacgaggtgctcggtcccaagggcactgacctgcagggtgagctgttcaagttcagcgtggcgtacatcgtccaggagtacatggagaccgacctggcacgcctgctggagcagggcacgctggcagaagagcatgccaagctgttcatgtaccagctgctccgcgggctcaagtacatccactccgccaacgtgctgcacagggacctgaagcccgccaacatcttcatcagcacagaggacctcgtgctcaagattggggatttcgggttggcaaggatcgttgatcagcattactcccacaagggttatctgtcagaagggttggtaacaaagtggtaccgttccccacgactgctcctttcccccaataactacaccaaagccatcgacatgtgggccgccggctgcatcctggctgagatgcttacggggagaatgctctttgctggggcccatgagctggagcagatgcaactcatcctggagaccatccctgtaatccgggaggaagacaaggacgagctgctcagggtgatgccttcctttgtcagcagcacctgggaggtgaagaggcctctgcgcaagctgctccctgaagtgaacagtgaagccatcgactttctggagaagatcctgacctttaaccccatggatcgcctaacagctgagatggggctgcaacacccctacatgagcccatactcgtgccctgaggacgagcccacctcacaacaccccttccgcattgaggatgagatcgacgacatcgtgctgatggccgctaaccagagccagctgtccaactgggacacgtgcagttccaggtaccctgtgagcctgtcgtcggacctggagtggcggcctgaccggtgccaggacgccagcgaggtacagcgcgacccgcgcgggttcggcgcactggctgaggacgtgcaggtggacccgcgcaaggactcgcacagcagctccgagcgcttcctagagcagtcgcactcgtccatggagcgcgccttcgaggccgactacgggcgctcctgcgactacaaggtggggtcgccgtcctacctggacaagctgctgtggcgcgacaacaagccgcaccactactcggagcccaagctcatcctggacctgtcgcactggaagcaggcggccggcgcgccccccacggccacggggctggcggacacgggggcgcgcgaggacgagccggccagcctcttcctggagatcgcgcagtgggtcaagagcacgcagggcgcccagagcacgccagcccgcccgccgacgaccccgagcgccgcttgtctgcctcgccccccgccgcccggccccggtggacggcggcgccagcccccagttcgacctggacgtgttcatctcccgcgccctgaagctctgcaccaagcccgaggacctgccggacaataaactgggcgacctcaatggtgcgtgcatccccgagcaccctggcgacctcgtgcagaccgaggccttctccaaagaaaggtggtgagggcggaggggccgctccaggccccacagagcaggagacccccagagaaagccggggctggcaggaggcggccgcctccgccctctctgctgccttggggttggcagaacacgtgaaggatccgaggagcgagaggaatgtccatttcttaaactgccttaataactagcctttaacctgtgggagcgggtttgaactggaccctggcttaggggtgactcatttctacgaaagggagaccacatgtgtgcacagggaagaacgctttagacacgagtctgcggccactggtgcagatcggagaatctgcagaggtagctcgaaaccatctgcccaactagcctcaactgacagctgaggaaagcaattagccagagaggcagagacactcgcttaagatcacaggcttagtgtgaggacgagcttgaaatcccagtctcctggcccccaggcagggtctgtcaccatagaatgtcttcctctactggggtcgttctggctttttgttagaaacttggtctgagatgttcttcccctgtccattaccattcgatgttcttttgttcagagcaatgtttcttgtattctgaaactggaaactgaaccagtttgcctttctcctagtcaccaagcatactttcctggctccccaagtacttaaatgttctcatctgtcgcacccctgtatttgcctcacccctgcatggtcggaaatcttcgtttcaggtcagaacagcctggggtctgtgggtaaaatcagcccttctcccaggcctgtgcacacaccccctcagcactccctatgcactttcctgacacgcaaagacacagccctctttccccactgggcgtcctaccccagtgaggttgaaggcaccaattccaagaatccctccaacctccctgccagcactcccccttcaccccacacccggcccccccaccctaaccacagcgcctctccagacctacctcggaccaaatgttctctacatgaactgctcatttggaggacagcagtgaggtcctgccatagagcaaatgtgttaggagagaaggtttcacatgggacccaacatccttcatcaatactttcctgagtttgatcatccatttagccttgacaaacagcagaccctacagagatgtgttggagagcacgtcgtgaccttgggggcaaggaatccagaaaggtaggaagatatgaaaagagaggtgtcaacagcaagggctcttaggggtcaggcaccagcatggagacctcatgacaaaggagggactcaaagcagcaatgcccctcatagtgtaggctaaggtgagtttggtgcatgcaaactgtgtgtcacccacagagcatggggtaatggtgtgtagacacaggcctctgcagaagcgtggggtggggacactgacagccctatctggtcccaggacattctaccatttctgccactggtgttcagctccttctcttcccccaacactcccaaagatacccacagaagtccagccagtttccaggtagagatccaccattggtcttgggctgcgttcaccctcacaccacacgccttaaatctaatcagcaaactataatttgtcgttaaacctgcaacacattagaaacttatatttaaaaacagaattaactcacatgaccaacttttaaatggaaaatatgtaaataggaagtgtttgggttttgttttttctttaagaaaaagaaatgtacaccactcctcatgtgccattttgtcctcagagggcgcttactttttggtaaagaacaagctgctgccttgaccaggagttcatatataactgttattacagaggaattgttataactactaatgtttttaaaaaatttattaaacattattaaacttgatcaggtcaggccaaataaagttttattggaac

SEQ ID NO: 53277 - DNA, 3414 bp, Homo sapiens
cgcggggcggacgccgcagggcgtgtcacgaggtgagcggggcgggccgagcgccggcgcggggcgcggcgaggctcccgcaccccccgccgcagtcgcgggcctctcccggagaagatggcggatcgcgcggagatgttttctctctccaccttccactcgctgtcgccgccgggctgcaggcctccccaggacataagcctggaagaatttgacgacgaagatctgtctgagatcactgatgactgtggcctgggcctcagctacgactcagaccactgtgagaaggacagcctctccctggggcgctcggagcagccgcaccccatctgctccttccaggatgacttccaggagtttgagatgatcgatgacaatgaagaggaggacgatgaggacgaggaagaggaggaggaggaggaggagggagatggggaaggccaggagggaggagaccctggctcagaggcacctgcccccgggccccttatcccctccccttccgtggaggagccccacaagcaccggcccaccaccctccgtctgaccacactgggggcccaggactccctaaacaacaacggaggctttgacctggtgcgtccggcctcctggcaggagacagcgctatgctcacccgccccggaggccctcagagagctcccgggccccctccctgccacggacaccgggcccggcggggcgcagtcgccagtgcgcccgggttgcgactgcgaagggaaccggcctgcggaaccccctgcgccaggggggacttcgccctcctcagatcccggcatcgaggctgacctgagaagccgctcgagcggcggccgcgggggacgtcgcagcagccaggagctgtcctcgcccggctccgactcggaggacgcgggcggcgcgcgcctggggcgcatgatctcgtccatctcggagacggagctggagctgagcagcgatggcggaagcagcagcagcggccgctcctcgcacctcaccaactccatcgaggaggcctcgtcgcccgcctcggagccggagcccccgcgcgaacccccgcgccgccccgccttcctgcccgtgggccccgacgacaccaacagcgagtacgagtcggggtcggagtcggagccggacctcagcgaggacgcggactcgccctggctgctcagcaacctggtgagccgcatgatctccgagggctcctcgcccatccgctgccccggccagtgcctgtctcctgcgccgcgcccgcccggggagcccgtgtcgccggccggcggggccgcccaggactcccaggaccccgaggcggccgcggggcccggcggcgtggagctggtggacatggagacgctgtgcgcgccgccgccgcccgcgcccgccgcgcctcgacccggccccgcgcagcccgggccctgcctattcctcagcaaccccacgcgtgacaccatcacgccgctgtgggccgcgcccggccgcgccgcccgcccgggacgagcctgctccgccgcctgctccgaggaggaggacgaagaggacgacgaggaagaggaggatgccgaggacagtgcggggtcccccgggggcaggggcacgggcccctcggcgccgcgggacgcgtcgctggtgtacgacgcggtcaagtacacgctggtggtggatgagcacacgcagctggagctggtgagcctgcggcgctgtgctgggctgggccacgacagcgaagaggacagcggcggggaggccagcgaggaggaggcgggcgcggcgctgctaggcggcggtcaggtctcgggggacacctcgccggacagccctgacctcactttctccaagaagttcctcaatgtcttcgtcaacagcacatctcggtcctccagcaccgagtcctttggccttttctcctgtctggtcaacggcgaggagcgagagcagactcaccgggctgtgttcaggttcatcccgcggcatccagacgagctggagctggatgtggatgaccctgtgttggtggaggccgaggaggacgacttctggttccgtggcttcaacatgcgcacgggggagcgcggtgtgtttcctgccttctacgcccatgcggtgcccggccctgccaaggacctgctggggagtaagcggagcccctgctgggtggagcgctttgacgtgcagttcctgggctccgtggaggtgccctgccaccagggcaacggcatcctgtgtgcagccatgcagaagattgccactgcccggaaactgaccgtccacctgcgccctcctgcctcctgtgacctcgagatctctcttcggggggtcaagctgagtctgagcggaggagggcccgagttccagcgctgcagccatttcttccagatgaagaacatctccttctgcggctgccatccccgcaacagctgctatttcggcttcatcaccaaacaccccctgctgagccgcttcgcctgccacgtctttgtctcccaggagtccatgaggccggtggcgcagagtgtgggccgcgccttcctggagtactaccaagagcacctggcgtacgcctgccccacggaggacatctacctggagtagcctgcccaccgctctgtctcctggccgtctgctccaggcgcagctggggctgaggatgtctcaagaggccaccatggctttggcaaggactggattggggggacatgggaccttacgcttgtgggggtctgcgggctgggaactctcgtcctcggtccccagggcgcagctgttggggctgcgggggagtggagcccccgtgcccctgcttttcctcagatccgttctttctctgtgttgtcctcctccttcccttcccagtctcccttttctctctcctggtgtctctgcccctctctgtgcctgcaaaccttatcctctattcttcactttggggtcagaacttcgggggtgtggaggaggtgcggctctagggacaggtaatgtcggcttccaagtgatgccctcctgccactcccctgcgatttataagggaattttaatttttatagtgaatctcaagggatcatcccatccttgaccacagggacaagaggggccccctcgccccagccccaccccacatggagctcagggggaagcagggaggggttcccaaaagagccctgcggaggctaggagtggttcttgatgctcacctgaagcccctagacgctgctaggagggggggccctcctgggcccccaatacccctccgcttgccgctgctagcgcacccctgcagtccagcgtgcatccaccccacgcacgccccgtgctgtgttcctgggccctgcccatggcctcaataaactctctgcttggtgtgaaaaaaaaaaaaaaaaaaaaaaaaaaaaaaaaaaaaaaaaaaaaaaaaaaaaa

SEQ ID NO: 53278 - DNA, 3216 bp, Homo sapiens
atgctccccgatttcccttctcctagcacctgggcccctgggctactgctgccctctggcccagccctgctatctccctccgtcctgcaggacagcctctccctggggcgctcggagcagccgcaccccatctgctccttccaggatgacttccaggagtttgagatgatcgatgacaatgaagaggaggacgatgaggacgaggaagaggaggaggaggaggaggagggagatggggaaggccaggagggaggagaccctggctcagaggcacctgcccccgggccccttatcccctccccttccgtggaggagccccacaagcaccggcccaccaccctccgtctgaccacactgggggcccaggactccctaaacaacaacggaggctttgacctggtgcgtccggcctcctggcaggagacagcgctatgctcacccgccccggaggccctcagagagctcccgggccccctccctgccacggacaccgggcccggcggggcgcagtcgccagtgcgcccgggttgcgactgcgaagggaaccggcctgcggaaccccctgcgccaggggggacttcgccctcctcagatcccggcatcgaggctgacctgagaagccgctcgagcggcggccgcgggggacgtcgcagcagccaggagctgtcctcgcccggctccgactcggaggacgcgggcggcgcgcgcctggggcgcatgatctcgtccatctcggagacggagctggagctgagcagcgatggcggaagcagcagcagcggccgctcctcgcacctcaccaactccatcgaggaggcctcgtcgcccgcctcggagccggagcccccgcgcgaacccccgcgccgccccgccttcctgcccgtgggccccgacgacaccaacagcgagtacgagtcggggtcggagtcggagccggacctcagcgaggacgcggactcgccctggctgctcagcaacctggtgagccgcatgatctccgagggctcctcgcccatccgctgccccggccagtgcctgtctcctgcgccgcgcccgcccggggagcccgtgtcgccggccggcggggccgcccaggactcccaggaccccgaggcggccgcggggcccggcggcgtggagctggtggacatggagacgctgtgcgcgccgccgccgcccgcgcccgccgcgcctcgacccggccccgcgcagcccgggccctgcctattcctcagcaaccccacgcgtgacaccatcacgccgctgtgggccgcgcccggccgcgccgcccgcccgggacgagcctgctccgccgcctgctccgaggaggaggacgaagaggacgacgaggaagaggaggatgccgaggacagtgcggggtcccccgggggcaggggcacgggcccctcggcgccgcgggacgcgtcgctggtgtacgacgcggtcaagtacacgctggtggtggatgagcacacgcagctggagctggtgagcctgcggcgctgtgctgggctgggccacgacagcgaagaggacagcggcggggaggccagcgaggaggaggcgggcgcggcgctgctaggcggcggtcaggtctcgggggacacctcgccggacagccctgacctcactttctccaagaagttcctcaatgtcttcgtcaacagcacatctcggtcctccagcaccgagtcctttggccttttctcctgtctggtcaacggcgaggagcgagagcagactcaccgggctgtgttcaggttcatcccgcggcatccagacgagctggagctggatgtggatgaccctgtgttggtggaggccgaggaggacgacttctggttccgtggcttcaacatgcgcacgggggagcgcggtgtgtttcctgccttctacgcccatgcggtgcccggccctgccaaggacctgctggggagtaagcggagcccctgctgggtggagcgctttgacgtgcagttcctgggctccgtggaggtgccctgccaccagggcaacggcatcctgtgtgcagccatgcagaagattgccactgcccggaaactgaccgtccacctgcgccctcctgcctcctgtgacctcgagatctctcttcggggggtcaagctgagtctgagcggaggagggcccgagttccagcgctgcagccatttcttccagatgaagaacatctccttctgcggctgccatccccgcaacagctgctatttcggcttcatcaccaaacaccccctgctgagccgcttcgcctgccacgtctttgtctcccaggagtccatgaggccggtggcgcagagtgtgggccgcgccttcctggagtactaccaagagcacctggcgtacgcctgccccacggaggacatctacctggagtagcctgcccaccgctctgtctcctggccgtctgctccaggcgcagctggggctgaggatgtctcaagaggccaccatggctttggcaaggactggattggggggacatgggaccttacgcttgtgggggtctgcgggctgggaactctcgtcctcggtccccagggcgcagctgttggggctgcgggggagtggagcccccgtgcccctgcttttcctcagatccgttctttctctgtgttgtcctcctccttcccttcccagtctcccttttctctctcctggtgtctctgcccctctctgtgcctgcaaaccttatcctctattcttcactttggggtcagaacttcgggggtgtggaggaggtgcggctctagggacaggtaatgtcggcttccaagtgatgccctcctgccactcccctgcgatttataagggaattttaatttttatagtgaatctcaagggatcatcccatccttgaccacagggacaagaggggccccctcgccccagccccaccccacatggagctcagggggaagcagggaggggttcccaaaagagccctgcggaggctaggagtggttcttgatgctcacctgaagcccctagacgctgctaggagggggggccctcctgggcccccaatacccctccgcttgccgctgctagcgcacccctgcagtccagcgtgcatccaccccacgcacgccccgtgctgtgttcctgggccctgcccatggcctcaataaactctctgcttggtgtgaaaaaaaaaaaaaaaaaaaaaaaaaaaaaaaaaaaaaaaaaaaaaaaaaaaaa

SEQ ID NO: 53279 - DNA, 2271 bp, Homo sapiens
cgcggggcggacgccgcagggcgtgtcacgaggtgagcggggcgggccgagcgccggcgcggggcgcggcgaggctcccgcaccccccgccgcagtcgcgggcctctcccggagaagatggcggatcgcgcggagatgttttctctctccaccttccactcgctgtcgccgccgggctgcaggcctccccaggacataagcctggaagaatttgacgacgaagatctgtctgagatcactgatgactgtggcctgggcctcagctacgactcagaccactgtgagaaggacagcctctccctggggcgctcggagcagccgcaccccatctgctccttccaggatgacttccaggagtttgagatgatcgatgacaatgaagaggaggacgaagaggacgacgaggaagaggaggatgccgaggacagtgcggggtcccccgggggcaggggcacgggcccctcggcgccgcgggacgcgtcgctggtgtacgacgcggtcaagtacacgctggtggtggatgagcacacgcagctggagctggtgagcctgcggcgctgtgctgggctgggccacgacagcgaagaggacagcggcggggaggccagcgaggaggaggcgggcgcggcgctgctaggcggcggtcaggtctcgggggacacctcgccggacagccctgacctcactttctccaagaagttcctcaatgtcttcgtcaacagcacatctcggtcctccagcaccgagtcctttggccttttctcctgtctggtcaacggcgaggagcgagagcagactcaccgggctgtgttcaggttcatcccgcggcatccagacgagctggagctggatgtggatgaccctgtgttggtggaggccgaggaggacgacttctggttccgtggcttcaacatgcgcacgggggagcgcggtgtgtttcctgccttctacgcccatgcggtgcccggccctgccaaggacctgctggggagtaagcggagcccctgctgggtggagcgctttgacgtgcagttcctgggctccgtggaggtgccctgccaccagggcaacggcatcctgtgtgcagccatgcagaagattgccactgcccggaaactgaccgtccacctgcgccctcctgcctcctgtgacctcgagatctctcttcggggggtcaagctgagtctgagcggaggagggcccgagttccagcgctgcagccatttcttccagatgaagaacatctccttctgcggctgccatccccgcaacagctgctatttcggcttcatcaccaaacaccccctgctgagccgcttcgcctgccacgtctttgtctcccaggagtccatgaggccggtggcgcagagtgtgggccgcgccttcctggagtactaccaagagcacctggcgtacgcctgccccacggaggacatctacctggagtagcctgcccaccgctctgtctcctggccgtctgctccaggcgcagctggggctgaggatgtctcaagaggccaccatggctttggcaaggactggattggggggacatgggaccttacgcttgtgggggtctgcgggctgggaactctcgtcctcggtccccagggcgcagctgttggggctgcgggggagtggagcccccgtgcccctgcttttcctcagatccgttctttctctgtgttgtcctcctccttcccttcccagtctcccttttctctctcctggtgtctctgcccctctctgtgcctgcaaaccttatcctctattcttcactttggggtcagaacttcgggggtgtggaggaggtgcggctctagggacaggtaatgtcggcttccaagtgatgccctcctgccactcccctgcgatttataagggaattttaatttttatagtgaatctcaagggatcatcccatccttgaccacagggacaagaggggccccctcgccccagccccaccccacatggagctcagggggaagcagggaggggttcccaaaagagccctgcggaggctaggagtggttcttgatgctcacctgaagcccctagacgctgctaggagggggggccctcctgggcccccaatacccctccgcttgccgctgctagcgcacccctgcagtccagcgtgcatccaccccacgcacgccccgtgctgtgttcctgggccctgcccatggcctcaataaactctctgcttggtgtgaaaaaaaaaaaaaaaaaaaaaaaaaaaaaaaaaaaaaaaaaaaaaaaaaaaaa

SEQ ID NO: 53280 - DNA, 4833 bp, Homo sapiens
ctgctgccgcacctgccaccatgtcgccgccgccgggtcatgtctgactctctctggaccgcgctttctaatttctcgatgccctccttccccggcggcagtatgttccgccgcaccaagagctgccgcaccagtaatcggaaaagcctcatcctgaccagcacttcacccacgctaccgagaccccactccccgctgccaggtcacctaggcagcagtcccctggacagcccccgaaacttctcccccaacacccccgcccacttctcgtttgcctcctcccgaagggcggacggacgccggtggtctctggcctcgctcccttcatctggctatggcaccaacacgcccagttccaccgtctcgtcctcctgctcctcccaggagcgccttcaccagctgccctaccagcccacggtggacgagctccacttcctctccaaacacttcgggagcaccgagagcatcacagacgaggatggtggccgtcgctccccagccgtgcggccccgctcacggagcctcagccccgggcgctccccctcctcctacgacaacgagatcgtgatgatgaatcacgtctacaaggagaggttcccgaaggccactgcgcagatggaggagaagctgcgcgacttcacccgcgcctacgaacccgacagcgttctgcctctggccgatggcgtgctcagcttcatccaccaccagatcatcgagctggcccgggactgcctgaccaagtcccgtgacggcctcatcaccacggtctacttctatgaattgcaggagaacctggagaagctccttcaagacgcctatgaacgctctgagagcttggaggtggccttcgttactcagctggtgaagaagttgcttattatcatctcacgccctgcgaggctgctggagtgcctggaattcaaccccgaggagttctaccacctgctggaggcggccgaaggacacgccaaggagggccaccttgtgaagacggacatcccccgctacatcatccgccagctgggcctcacccgtgacccctttccagacgtggtgcatctggaggaacaggacagtggtggttccaacacccctgagcaagacgatctctctgagggccgcagcagcaaggccaagaaaccgccgggggagaatgacttcgataccatcaagctcataagcaacggtgcctacggcgctgtctacctggtgcggcaccgcgacacgcggcagcgctttgccatgaaaaagatcaacaagcagaacttgatcctccgcaaccagatccagcaggcctttgtggagcgcgatatcctcaccttcgccgagaacccgtttgtggtcggcatgttctgctcctttgagactcggcgccacctctgcatggtcatggaatatgtggaaggcggcgactgtgccaccctgctgaagaatattggagcgctgcccgtagagatggcccgcatgtactttgctgagacggtgctagccctggagtatttgcacaactatggcatcgtgcaccgcgacctcaagcctgacaacctccttatcacctccatgggtcacatcaagctcacagatttcggcctctccaagatggggctcatgagcctcaccaccaacttatatgaaggccacatcgagaaggacgcccgagagttcctggacaaacaggtgtgtgggaccccagagtacatcgcgcccgaggtcatcctgcgtcaaggctacggcaagccagtggactggtgggctatggggatcatcctctacgagttcctggtgggctgtgtgcccttcttcggagacacaccagaggagctatttggacaggtcatcagtgatgacatcctgtggcccgagggggatgaggccctacctacggaggcccaactcctcatatccagcctcctgcagaccaaccctctggtcaggcttggggcaggcggcgcttttgaggtgaagcagcacagtttctttcgagacctggactggacagggctgctgaggcagaaggccgagttcatcccccacctagagtcggaagatgacactagctactttgacacccgctcagacaggtatcaccacgtgaactcctatgacgaggatgacacgacggaggaggagcccgtggaaatccgccagttctcttcctgctctccgcgcttcagcaaggtgtatagcagcatggagcagctgtcgcagcacgagcccaagaccccagtagcagctgcagggagcagcaagcgggagccgagcaccaagggccccgaggagaaggtggccggcaagcgggaggggctgggcggcctgaccctgcgtgagaagacctggagagggggctctccggagatcaagcgattctccgcgtccgaggccagtttcctggagggagaggccagtccccctttgggcgcccgccgccgtttctcggcgctgctggagcccagccgcttcagcgccccccaagaggacgaggatgaggcccggctgcgcaggcctccccggcccagctccgaccccgcgggatccctggatgcacgggcccccaaagaggagactcaaggggaaggcacctccagcgccggggactccgaggccactgaccgtccacgcccaggtgacctctgcccaccctcgaaggatggggatgcatcaggcccaagggctaccaatgacttggttctgcgccgggcgcggcaccagcagatgtcaggggatgtggcagtagagaagaggccttctcgaactgggggcaaagtcatcaaatcagcctcagccactgccttatctgtcatgattcctgcagtggacccacatggaagttcaccccttgctagtcccatgtctccacgatctctgtcctccaacccatcctcacgggactcctcacccagccgggactactcaccagctgtcagtgggctccgctcccccatcaccatccagcgctcgggcaagaagtatggcttcacactgcgtgccatccgtgtctacatgggtgacacggatgtctatagtgtccaccacattgtctggcatgtggaggaaggaggcccagcccaggaggcaggactctgtgctggggacctcatcacccacgtgaatggggagcctgtgcatggcatggtgcatcctgaggtcgtggagctgatccttaagagtggcaacaaggtagcagtgaccacaacgcccttcgaaaatacctctatccgcattggtcccgcaaggcgcagcagctacaaggctaaaatggctcggaggaacaagcgaccctccgccaaggagggccaggagagcaagaagcgcagctccctcttccggaagatcacgaagcagtcgaacctgctgcatactagccgctcgctgtcgtcgctgaaccgctcgctgtcatccagcgatagtctcccgggctcgcctacgcacgggctgccggcgcgctcgcccacgcacagctaccgctccacgcctgactccgcctacctaggcgcctcatcccagagcagctccccagcctcgagcacgcccaactcgcctgcgtcgtcggcgtcgcaccacattcggcccagcacgctgcacggactgtcgccaaagctccatcgccagtaccgctctgcgcgatgcaagtcggccggcaacatccctctatcgccgctggcacacacgccgtcccccacgcaggcgtcaccgccgccactgccgggccacacggtgggcagctcgcacactactcagagcttcccggccaaactgcactcatcgcctcccgtcgtgcgcccgcgccccaagagtgccgagccccctcgctcgccgctcctcaagcgcgtgcagtcggccgagaagctgggagcctctttgagtgcggacaagaagggcgcgctgcgcaaacacagcctcgaggtgggccacccggatttccgcaaggacttccatggcgagctggcgctgcatagccttgccgagtccgacggtgagacgcccccagtcgagggccttggcgcgccccggcaggtcgccgtccgccgcctgggccgacaggagtcacctttgagcctgggcgcggacccgttgctgcccgagggtgcctccaggccaccagtgtcgagcaaggagaaggaatccccggggggcgccgaggcgtgcaccccaccccgcgcgacgacccccggtggccggaccctggagcgggacgtcggctgcacgcggcatcagagcgtgcagacggaggatggcactggcgggatggccagggctgtggccaaggcggcgctgagcccggtgcaggaacacgagacaggccggcgcagcagctctggcgaggcgggcacacccctggtacccattgtcgtagagcctgcgcggcccggggctaaggctgtggtgcctcagcctctgggcgcggactccaaggggttgcaggaacccgcacccctggcgccttccgtgcccgaggccccccggggccgggagcgctgggtgttggaggtggtggaggagcgcaccacgctgagcggtcctcgctccaagcccgcctccccaaagctctccccggagccccagacaccctccctagccccagcgaagtgcagtgcacccagcagtgcagtgaccccagtcccacccgcatccctcttgggctcgggcaccaagcctcaagtggggctgacctcccggtgccctgctgaagctgtgcccccagcaggcctgaccaaaaaaggagtgtccagtcccgcacccccgggaccatagccaagggggtcatcggccccgcgctgtacagcctccgtatacatatgtacacatataaataaagtgcgtccgtgctgcgtg

SEQ ID NO: 53281 - DNA, 2300 bp, Homo sapiens
ggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtaccctggctaaagccgggccggagccctctgccctctcatgcccgcagccagcctgggctgtgcaacatgtacaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggtaaaaaaaaaaaaaaaaaaaaaa

SEQ ID NO: 53282 - DNA, 2222 bp, Homo sapiens
ggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggtaaaaaaaaaaaaaaaaaaaaaa

SEQ ID NO: 53283 - DNA, 2189 bp, Homo sapiens
ggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggtaaaaaaaaaaaaaaaaaaaaaa

SEQ ID NO: 53284 - DNA, 2229 bp, Homo sapiens
ggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggcgtgaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggtaaaaaaaaaaaaaaaaaaaaaa

SEQ ID NO: 53285 - DNA, 2196 bp, Homo sapiens
ggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaagcgtgaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggtaaaaaaaaaaaaaaaaaaaaaa

SEQ ID NO: 53286 - DNA, 4889 bp, Homo sapiens
tgggtgcgcgcccgtccctcggagccgccgccgtcagtcaccgccgccgcgcgccagagagaagcagcctccggccccggcggcccctgtctcccgaccccggaaggcgaagcaggctgcccggggaccccgcgcgtgggcgcttgaagccgagaccagcctgcccgggcctgggcaggcggagcagggccttggaccccgcggcgcccctcggcctcggagcaacgagcgcagcgccgcctctgaagagccaatccattcaggatgggaaaccacgcaggcaaacgagaattaaatgccgagaaggccagtacgaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtgagctctgaggagtagaggagttttagtttaaatggaaaaagcaaaggagaaatcagtaggtgaactcagccattagaggaagaactggcacgtagcctcttgctgtctaaggtctcgttccgtgctggagaatgcatatgagcccaagagtgtgggcctgagtggctgcttaggacgttttcgtttaactcaccccctcttttcctcacaagggatggtggccggggtgtggctcaggaatgtaaggacatgctgaattctggatctctaagggtgcctggacatgggcgttgcagaaagagagccacattctcagggtctctggtggtgtgtgcttgcggacttgatgactgatgttgcctctgcagcccacacgctggggttcaacactgggttatgctcgttttttcctggagtcagtgctgctagcttcatgttgctctgcgacaatcataggattgaggtcgaggaagacttttgaacaaactcctcaatttaaatccgccttgagcaaacgttctctgtggtctgagaagtggaaggggggagggataaatgagtgtctatgaatcaaagctttattatcttgtgattccattaatttgcatacagagtcttagaagtttctttattcaaaagcaaatgtggataaaaatgtattacaaaaaaaaaaaactctgctatggggtccagagtctaggagtggtttctgcagttgattgtcagtggagaacctgtggctgctggttcatcaaagcgctggtccctgagtgccattcagattgcagatgcagtattttacgtgatgtttagagtgtttggtggttgtgtaattttggagagaaagaagtttttcccaaaaaagtccctagtttattgggtgttctcacacaacctgtaagatgaagctgtttttctgcctgtgtgcagggctgattctggaattccagaaggccttgtgggagcgtaaaaggcttttgaataaagtgtggaacagagcgcctcattctgataacatgcaatcataaaaaccatagggcaacttggagttaaggagtttctagaatttgctttagtctccaactgcaattctttattgatcatgaaattgttgaagagaaacacaaatgtcagttttacctttcctgtgggcgtgaaagcacatcgaagtttcaggcaactgttaacatctctaccatctgtctgagttgagatttcaggttgtgacacttgccgtgacttatttgtaaatgacattttgtgtgtcttagatactaatggaattcatattctggctagttctttcagtgcatttgtagacatgttcttttcctttgtagcagtcctccctcaccctgaaatgttggtgttctaaccgatttctaatgctaatttcaactggaagcactttttcaagcccagctatcaaaccacaccagacatgtatggattcgggttgcccaataaagcgttgctattatgtaagcatccctcacgcatacagcatcaccagttttgaaagcttgaactattctgcttacttcaaggtacagaaaaaaaaaatgtacttaaactgtgcagaaaagatgaaatcactggataatatgtattataaaataagcttcatgtgagtgacactggtttaagttgaaataaaatggtgaaagcattgatatcaatcattgtgactttatctcaaaacaatattgacacacatagatgtttttcttcctttatggtaagattacagcctttattgtcttaaatctcttatactcttcaatattttcaaagaaaacattctagtctcagaaatagtccatctctttgcaaaacagggctggccaattatcaaggacccataaaaatcaaaacactttcaaaaattttaaaaataaaaataattttcacatgattgctttaggaattttgaagtatccattcttttcactatggagtgttgaatatagaagattttttaatgaacaggcttgccctttgatgccaaaggcaaaaaataataataataacatttgcacgtgtgatcacagagcagctgtgaggcatcccgggggagcgcacgcagtggggatgtgattgctccactcaactattttatcacaaagtgttgtaaacatgggagatgaaagcttaactctctctacacccagctacagacccgcaatggccctaaaaatctggggtattcattgggtgggctgccatggaggaatttttggttttgtttttatttttatttgttgttctgtttacaaatcaggagagcccctgtttttatatgctaggaaggtccttgggataggccgaagaggtgtgcaaacgagcagtggaaggcccgggccctgtctctcaggaccacggcggcctgccccacacacagttctgcttctccctatctagaacgaggttttcctggcagattcctgccagactctgagtggagcccccccatgaccctataaaaggggctgtttgtcctcctcccaccctcctgtgctcttcctccctccccttgagggcacatggccgctggtaccacatgttggagcggccgcccccgagcccgggaatgccctaacaacacccatgcttgtgttgctgggagctgacattcaagaaaagtgcattaaaaattccttgagaaggcatattcttttgagagccgtaaatgaaaagtgcattcacggagaacatgctcctttgttgtgagaggaaagaaaggactgttgttgcctttaaggaacaggtttcccagttccccggaatgtcagggtcacatgaggaatgggtgagcacttagggccaagattgtcgtgtgcttggcccggcagcttctctctaagtgacctctccagcatcactctgtgccagtgctcatatctgaggccacttgagtgtcacgaggcagagcctggaaacattagctttggaaaccgttccttcctttttatgtggaggaagtaaggtttcacaagacacctaagctggacatggtgatgtgccacttggatagttcccaaagcagaaagcagccaggacatcccagtaccccacttctccgtgccgtgtacttttagggaggttttcgaaagctagcttcttaccgatgattttgtctatttttctgttttatgtgaaaaccttcatttataacctgctcttctcagtgttcttctattcagcattcagtatgacttctatgcctctaattgcgactgtatggagaagaactgtttgtcattcagtgccgtgggatataatcagtcctgtaaattcatcagaatgttctgttgcctgattttttttccattgcattttaatttcattaaacatattttagttctacagtaacctaattcctcattgttaccatgagatcctaattctgtagctgtgttctgtaatcccatggggcgtgtaccatttggagacacatgaaggatacagtagacagcacggaaggcagcagcaacacacaggggtgtcctccctccccagagcccagtgtgcacacagaaccaaattcaatctcattcatcgtgagcttgcatggtaactgatccagccactcagtacctccattggataagagatttggccacagattcttctagagaaaatccaaatgtggagggtgcatttgtttctgcacccaaacaaataccttttgagatttcttataggcattcctctcaaagtctcattactctgatcagttattgatcggaggctaccctggctcagtcaccagctgctcactgtgtccttctgtggtctcaggagctgcagttgttgctgttgtatgaatagacgatagttaattagactggatgtgtctgtactggcagtgattttgcaacttcctctgtataagcgatacatttgtaaatcatgggaatgtatttgatggtaattgcctgtggtggttgtatcatgatttaattttattatgagcttttggctttatatatttttctgcctttttatgcattcattaaacagtttaacagaccaaggacagtgta

SEQ ID NO: 53287 - DNA, 2794 bp, Homo sapiens
tgggtgcgcgcccgtccctcggagccgccgccgtcagtcaccgccgccgcgcgccagagagaagcagcctccggccccggcggcccctgtctcccgaccccggaaggcgaagcaggctgcccggggaccccgcgcgtgggcgcttgaagccgagaccagcctgcccgggcctgggcaggcggagcagggccttggaccccgcggcgcccctcggcctcggagcaacgagcgcagcgccgcctctgaagagccaatccattcaggatgggaaaccacgcaggcaaacgagaattaaatgccgagaaggccagtacgaatagtgaaactaacagaggagaatctgaaaaaaagagaaacctgggtgaactttcacggacaacctcagaggacaacgaagtgttcggagaggcagatgcgaaccagaacaatgggacctcctctcaggacacagcggtgactgactccaagcgcacagcggacccgaagaatgcctggcaggatgcccacccagctgacccagggagccgcccccacttgatccgcctcttttcccgagatgccccggggagggaggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaaggggagaggactgtccctgagcagatttagctggggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggtaaaaaaaaaaaaaaaaaaaaaa

SEQ ID NO: 53288 - DNA, 2267 bp, Homo sapiens
ggacaacaccttcaaagacaggccctctgagtccgacgagctccagaccatccaagaagacagtgcagccacctccgagagcctggatgtgatggcgtcacagaagagaccctcccagaggcacggatccaagtacctggccacagcaagtaccatggaccatgccaggcatggcttcctcccaaggcacagagacacgggcatccttgactccatcgggcgcttctttggcggtgacaggggtgcgcccaagcggggctctggcaaggtaccctggctaaagccgggccggagccctctgccctctcatgcccgcagccagcctgggctgtgcaacatgtacaaggactcacaccacccggcaagaactgctcactacggctccctgccccagaagtcacacggccggacccaagatgaaaaccccgtagtccacttcttcaagaacattgtgacgcctcgcacaccacccccgtcgcagggaaagggggccgaaggccagagaccaggatttggctacggaggcagagcgtccgactataaatcggctcacaagggattcaagggagtcgatgcccagggcacgctttccaaaatttttaagctgggaggaagagatagtcgctctggatcacccatggctagacgctgaaaacccacctggttccggaatcctgtcctcagcttcttaatataactgccttaaaactttaatcccacttgcccctgttacctaattagagcagatgacccctcccctaatgcctgcggagttgtgcacgtagtagggtcaggccacggcagcctaccggcaatttccggccaacagttaaatgagaacatgaaaacagaaaacggttaaaactgtccctttctgtgtgaagatcacgttccttcccccgcaatgtgcccccagacgcacgtgggtcttcagggggccaggtgcacagacgtccctccacgttcacccctccacccttggactttcttttcgccgtggctgcggcacccttgcgcttttgctggtcactgccatggaggcacacagctgcagagacagagaggacgtgggcggcagagaggactgttgacatccaagcttcctttgtttttttttcctgtccttctctcacctcctaaagtagacttcatttttcctaacaggattagacagtcaaggagtggcttactacatgtgggagcttttggtatgtgacatgcgggctgggcagctgttagagtccaacgtggggcagcacagagagggggccacctccccaggccgtggctgcccacacaccccaattagctgaattcgcgtgtggcagagggaggaaaaggaggcaaacgtgggctgggcaatggcctcacataggaaacagggtcttcctggagatttggtgatggagatgtcaagcaggtggcctctggacgtcaccgttgccctgcatggtggccccagagcagcctctatgaacaacctcgtttccaaaccacagcccacagccggagagtccaggaagacttgcgcactcagagcagaagggtaggagtcctctagacagcctcgcagccgcgccagtcgcccatagacactggctgtgaccgggcgtgctggcagcggcagtgcacagtggccagcactaaccctccctgagaagataaccggctcattcacttcctcccagaagacgcgtggtagcgagtaggcacaggcgtgcacctgctcccgaattactcaccgagacacacgggctgagcagacggccccgtggatggagacaaagagctcttctgaccatatccttcttaacacccgctggcatctcctttcgcgcctccctccctaacctactgacccaccttttgattttagcgcacctgtgattgataggccttccaaagagtcccacgctggcatcaccctccccgaggacggagatgaggagtagtcagcgtgatgccaaaacgcgtcttcttaatccaattctaattctgaatgtttcgtgtgggcttaataccatgtctattaatatatagcctcgatgatgagagagttacaaagaacaaaactccagacacaaacctccaaatttttcagcagaagcactctgcgtcgctgagctgaggtcggctctgcgatccatacgtggccgcacccacacagcacgtgctgtgacgatggctgaacggaaagtgtacactgttcctgaatattgaaataaaacaataaacttttaatggtaaaaaaaaaaaaaaaaaaaaaa

SEQ ID NO: 53289 - DNA, 999 bp, Homo sapiens
atggtgaactccacccaccgtgggatgcacacttctctgcacctctggaaccgcagcagttacagactgcacagcaatgccagtgagtcccttggaaaaggctactctgatggagggtgctacgagcaactttttgtctctcctgaggtgtttgtgactctgggtgtcatcagcttgttggagaatatcttagtgattgtggcaatagccaagaacaagaatctgcattcacccatgtactttttcatctgcagcttggctgtggctgatatgctggtgagcgtttcaaatggatcagaaaccattatcatcaccctattaaacagtacagatacggatgcacagagtttcacagtgaatattgataatgtcattgactcggtgatctgtagctccttgcttgcatccatttgcagcctgctttcaattgcagtggacaggtactttactatcttctatgctctccagtaccataacattatgacagttaagcgggttgggatcatcataagttgtatctgggcagcttgcacggtttcaggcattttgttcatcatttactcagatagtagtgctgtcatcatctgcctcatcaccatgttcttcaccatgctggctctcatggcttctctctatgtccacatgttcctgatggccaggcttcacattaagaggattgctgtcctccccggcactggtgccatccgccaaggtgccaatatgaagggagcgattaccttgaccatcctgattggcgtctttgttgtctgctgggccccattcttcctccacttaatattctacatctcttgtcctcagaatccatattgtgtgtgcttcatgtctcactttaacttgtatctcatactgatcatgtgtaattcaatcatcgatcctctgatttatgcactccggagtcaagaactgaggaaaaccttcaaagagatcatctgttgctatcccctgggaggcctttgtgacttgtctagcagatattaa

SEQ ID NO: 53290 - DNA, 7522 bp, Homo sapiens
aaagattgctttcttctgggacgctgcttgaacgctaaccgcgttgattggaacagattttgtgtcttggctggctttgggtgaagaccggggagaaaaggttgcgctgcgattctcaagatctctggacctggattatcattgcaaatccattaaagaaggagaagcaagcggatttcagagaggttgttcttcagaaaaaaatggttatttctttgaactcatgcctgagctttatttgtttattgttatgccactggattgggacagcatcacctctgaatcttgaagaccctaatgtgtgtagccactgggaaagctactcagtgactgtgcaagagtcatacccacatccctttgatcaaatttactacacgagctgcactgacattctaaactggtttaaatgcacgcggcacagagtcagctatcggacagcctatcgacatggggagaagactatgtataggcgcaagtctcagtgttgtcctggattttatgaaagcggggaaatgtgtgtcccccactgtgctgataaatgtgtccatggtcgctgtattgctccaaacacctgtcagtgtgagcctggctggggagggaccaactgctccagtgcctgcgatggtgatcactggggtccccactgcaccagccggtgccagtgcaaaaatggggctctgtgcaaccccatcaccggggcttgccactgtgctgcgggcttccggggctggcgctgcgaggaccgctgtgagcagggcacctatggtaacgactgtcatcagagatgccagtgccagaatggagccacctgcgaccacgtcacgggggaatgccgctgcccaccaggatacaccggagccttctgtgaggatctttgtcctcctggtaaacatggtccacagtgtgagcagagatgcccttgtcaaaatggaggagtgtgtcatcacgtcactggagaatgctcttgcccttctggctggatgggcacagtgtgtggtcagccttgccccgagggtcgctttggaaagaactgttcccaagaatgccagtgccataatggagggacgtgtgatgctgccacaggccaatgtcattgcagtccaggatacacaggggaacggtgccaggatgagtgtcctgttgggacctatggcgttctctgtgctgagacctgccagtgtgtcaacggagggaagtgttaccacgtgagcggcgcatgcctctgtgaagcaggctttgctggcgagcgctgcgaagcacgcctgtgtcctgaggggctctacggcatcaaatgtgacaaacggtgtccctgccacttggaaaacactcatagctgtcaccccatgtctggagagtgtgcctgcaagccgggctggtcaggactctactgtaatgagacatgttctcctggattctacggggaagcttgccagcagatctgcagctgccaaaatggggcagactgtgacagtgtgactggaaagtgcacctgtgccccaggattcaaaggaattgactgctctaccccatgccctctgggaacctatgggataaactgttcctctcgctgtggctgtaaaaatgatgcagtctgctctcctgtggacgggtcttgtacttgcaaggcaggctggcacggggtggactgctccatcagatgtcccagtggcacatggggctttggctgtaacttaacatgccagtgcctcaacgggggagcctgcaacaccctggacgggacctgcacgtgtgcacctggatggcgcggggagaaatgcgaacttccctgccaggatggcacgtacgggctgaactgtgctgagcgctgcgactgcagccacgcagatggctgccaccctaccacgggccattgccgctgcctccccggatggtcaggtgtccactgtgacagcgtgtgtgctgagggacgctggggccccaactgctccctgccctgctactgtaaaaatggggcttcatgctcccctgatgatggcatctgcgagtgtgcaccaggcttccgaggcaccacttgtcagaggatctgctcccctggtttttatgggcatcgctgcagccagacatgcccacagtgcgttcacagcagcgggccctgccaccacatcaccggcctgtgtgactgcttgcctggcttcacaggcgccctctgcaatgaagtgtgtcccagtggcagatttgggaaaaactgtgcaggaatttgtacctgcaccaacaacggaacctgtaaccccattgacagatcttgtcagtgttaccccggttggattggcagtgactgctctcaaccatgtccacctgcccactggggcccaaactgcatccacacgtgcaactgccataatggagctttctgcagcgcctacgatggggaatgtaaatgcactcctggctggacagggctctactgcactcagagatgtcctctagggttttatggaaaagattgtgcactgatatgccaatgtcaaaacggagctgactgcgaccacatttctgggcagtgtacttgccgcactggattcatgggacggcactgtgagcagaagtgcccttcaggaacatatggctatggctgtcgccagatatgtgattgtctgaacaactccacctgcgaccacatcactgggacctgttactgcagccccggatggaagggagcgagatgtgatcaagctggtgttatcatagttggaaatctgaacagcttaagccgaaccagtactgctctccctgctgattcctaccagatcggggccattgcaggcatcatcattcttgtcctagttgttctcttcctactggcattgttcattatttatagacacaagcagaagggaaaggaatcaagcatgccagcagttacctacacccctgctatgagggtcgtcaatgcagattataccatttcaggaacccttcctcacagcaatggtggaaacgctaatagccactacttcaccaatcccagttaccacacgctcacccagtgtgccacatcccctcacgtcaacaacagggacaggatgactgtcacgaagtcaaaaaacaatcaactgtttgtgaatcttaaaaatgtgaaccctgggaagagaggccctgtgggggactgcactgggacattgccggctgactggaaacatggcggctacctcaacgagctcggtgcttttggacttgacagaagctatatgggaaaatccttaaaagacctgggaaagaattctgaatataattcaagtaactgctccctaagcagttctgagaacccatatgccactattaaagacccacctgtacttatcccgaaaagctcagagtgtggttatgtggagatgaaatcgccggcacgaagagattccccatatgcagagatcaataactcaacttcagccaacaggaatgtctatgaagttgaacctacagtgagtgttgtccaaggagtattcagcaataatgggcgtctctcccaggatccatatgacctcccaaagaacagtcacatcccttgtcattatgacctgctgccagtccgagacagttcatcctcccctaagcaagaggacagtggaggtagcagcagcaacagcagcagcagcagtgaatgacaccaaaggaccgcttggtagccactggaaccctttccagaactgctgtttggttcttctccatcctcaattttgccactttcatgtgaatgttagtcaattcggtgggcaatttttggacatgaaccagaaagctgaaagctgaggctgacacggactgtaggtgctttttgttcaggtggattcgaaggagttagagatgtgatttgccattgctgttagttttagaactatacccgtgaagcatgacttattgtaagatgttggctgaaagcatgaacttgcagaactccctcggagacgcaggttgcagtggacattgggattgttgcttgaaaaattaaaatttgaatattttctctctcatttgcatcatacagctctacctaggattgtacagtttaccataaaatttacttcatgaaagtgggaatcactgaacatgtagaagacaaggaacatattgttaactcctgattcttaactttattcaactggactcagaattgtagggataatatgaatgcaggaggaaacattctgtcaggcggtatgactggacagactttgaatatactctaaaagtggacagaaaatttacgaaaatcttagattttgtttagaatgagaaaatatacaattagaattattttagaaatagtaggaagtattgcagaagtcaatacacaaatgtgccaggcagaggtggttttctctgtttgactctcaaccaacttcagatctatgacattattctgatcactggctccatcatacatattcaccacttgagattcataacatatcaatagttatttcataaatatagaaatgaaataattttatttttgacagactggatggaatgagtgtgtaatgattgataaaggttgtaaattttaaatgcaagatgacgcttacgttctgtaaaccattagtaatacatgctgtaatatagaattagtggaacattttgattaatctttccctagaagtgactgaaatatttttgtgcatatttgagaaagggaactttccttttattaattgtcaatttagagaaactatgcttaagctggtcttttgcattgctaatgtgacatgtacccaacttttcattaatttgtatttccatttttaaattgcatattctatgttttgtagtgtttggattgttaatgaaaaaatattatatgttcgttattccttgtattattgccacttatcttttgcttgataaaaatgcgttgttcttttttcttttggagggacaagatgaaaatatataatttgaattgattaaaattggtcgttactaaaatagtatagtaaccacaagtgattggcttataaatgaagtagaaatgctttttaatattccaaaatagagttccttttgatctgttggtgctgagccttggttaaaccagggagaaggggagcagaaaggaaacgttgttactgatgagtaccacagactcatcttaaaaaaaactctcattatggtgatcatagaattgaccatccaaactgggacactcttgagagtaaatggagggcattattaataattatcttgtaatgaacttaaatctggactgttccaggcaaaccagacttatcttgcaatatgagaatgctgacacaatgcaggaaagccagtttcccttttgttgatctacttgaccaagcaaaggggctgaaaaactgaataaggaaacaactttataagagaaacagtggtcttcaatcttttaaagacatgaaatcctatatggcattctgtctcagtgagtcagttaacaaatacgtatgtgcaacccttctgctagtagtgcacataagtgattatccctgccaggtatcgagttggaatatccagttatttcatgtcacacatcggcacgtatgatggtggtttggtcagatggataatacagcagacacacttagaacactcactgcactggtggctgttcattttgaggaactccaaagtcaattcaaggaaataaggaatgacctggaacaggccttagaaacaattgatttattccaatagttaaccactggctggctcccaactctaggtgataggcatctaattgagacatgtgtgagtcaatagccatcggggtcctttttggtgagaagaaataagacattttctcccttttaaagatcatctcttcagagctgcatggtaaatttgaatttccccattgttctctagagataggtcaaaaaaacaactgtttcttttcttattccactattaataaattgaaagcttgctgtacaaaggcaacagcaacttaaaaaagaaaatctggacaatagatgtggactccaaggggccactgccatcccttcctgtgtgctctttttgacaagtaaatcactccagttagctgatgtcctgaaatgacatttgtacctgaggcaattcttattagagcttactcaggacttttcaaacatcaggacacacatagcaatttggatgttgtaaaactacgtgttacatttggagaggtcttgttgagaaggcaaaattttctaaatattttgatatcaatttgggtaaagaaaggaatacttttgttagaatgagaattaaagagaaaacaaaagaatcttggcaaaattttccctctgaaattacaaactttaggaacttttccagatgtatcgaatttaatttgacattgatgtcactcttcataccaagtgaatctattctcatgaactttgaacccatgttaattttggaccctataactaatttcctttctgtatcccatggtggtcaaagcagtaaaggagtttagagatacttagcaaatgccattcatatagtattgttagccaaactattattccttccttagaagttgatgtatcagaaaatttataagttatttgtatttatatataagtacatcagaacttgcccacatgataactcatgtttgctttaataaggaaaatatgttatttgaggttaattatatgatagtgaggaacattttacaattatttacagtgtttgacattaattgctgtcctatgatacagtagtaatgttaacagagagtttaatatgtttagcattatctttatggaatttatattcaccaatttcaggaaaaccaaccatagaactttataataggacagttataacctgactgaaccaaatccatcagcataatgactgtgtgttctgagaaatgcaaacaactttatgaaagtgtggtcatcttgacccccaaagagccacagtagctgtcaattattgagatttttaaatggtaaatattgcaaaagttaaacaagggtaccacaatatcatttataattgatgtcaatattagtagtccactttatgcttaaaataaaatcataaaaaatcaagttttaaggttatattttttaaaataatgaattttctatctctaggcaacatgtctttattattcaagctgaatgtttaagagagattttggtcttaaaggcttcatcatgaaagtgtacatgcatatgcaagtgtgaattacgtggtatggatggttgcttgtttattaactaaagatgtacagcaaactgcccgtttagagtcctgttaatattgatgtcctaacactgggtctgcttatgctagttcagtatttggtctaggcttcattttgatatgactgaattgcaatctatatttttaaaaagaaaaatcaaaatacattagggtttacttggttgtggcaaacaaacaaaaaatgctttcagtgttgaaatatctctattttccaaagatgataaactttcatcgttcttagcctacattgtcatttatatcaccaaatgagtttatagattaatgcaataaactttctaat

SEQ ID NO: 53291 - DNA, 4246 bp, Homo sapiens
gcgagcccgagcaggcagacgcgcggccggcggtctgggggcgcgccgcctcccggtccccaaaatgtgaagcggggagggcggagacgcagagacggcccggccgggcgccctcgccgccctccggcagccgcgccgctccctccgctgcacgcccaggcctgagcagcgaggccaccgggccgcgcgctcccagcttcgctcggacgcggcttcggcccgcagagggttcgtggcccggacgcggcgagagctgggcccaggacggtgcgtccggcctcgcccgcggctgctcgcaccaacaagtttgaacaatgatcaccgtcaaccccgatgggaagataatggtcagaagatgcctggtcaccctgagaccctttcggctttttgtcctgggcatcggcttcttcactctctgcttcctgatgacgtctctgggaggccagttctcggcccggcgcctgggggactcgccattcaccatccgcacagaagtgatggggggccccgagtcccgcggcgtcctgcgcaagatgagcgacctgctggagctgatggtgaagcgcatggacgcactggccaggctggagaacagcagtgagctgcaccgggccggcggcgacctgcactttcccgcagacaggatgccccctggggccggcctcatggagcggatccaggctattgcccagaacgtctccgacatcgctgtgaaggtggaccagatcctgcgccacagtctgctcctgcacagcaaggtgtcagaaggccggcgggaccagtgtgaggcacccagtgaccccaagttccctgactgctcagggaaggtggagtggatgcgtgcccgctggacctctgacccctgctacgccttctttggggtggacggcaccgagtgctccttcctcatctacctcagtgaggtcgagtggttctgccccccgctgccctggaggaaccagacggctgcccagagggcacccaagcccctccccaaagtccaggcagttttccgaagcaacctgtcccaccttctggacctgatgggcagcgggaaggagtccctgatcttcatgaagaagcggaccaagaggctcacagcccagtgggcgctggctgcccagcgcctggcacagaagctgggggccacccagagggaccagaagcagatcctggtccacatcggcttcctgacggaggagtccggggacgtgttcagccctcgggtcctgaagggcgggcccctaggggagatggtgcagtgggcggacattctgactgcactctatgtcctgggccatggcctgcgggtcacagtctccctgaaggagctgcagagtaacttaggggtaccgccaggccggggaagctgcccgctcaccatgcccctgcccttcgacctcatctacaccgactaccacggcctgcagcagatgaagcggcacatgggactctccttcaagaagtaccggtgccgaatcagggtcatcgacaccttcgggacggaacctgcgtacaaccacgaggagtacgccacgctgcacggctaccggaccaactggggctactggaacctcaaccccaagcagttcatgaccatgtttcctcatacccccgacaactccttcatgggcttcgtgtccgaggagctcaacgagacggagaagcggctcatcaaaggcggcaaggccagcaacatggccgtggtgtacggcaaggaggcgagcatctggaaggggaaggagaagttcctgggcatcctgaacaaatacatggagatccatggcaccgtgtactacgagagccagcggccccccgaggtgccagcctttgtgaagaaccacggcctcttaccgcagcctgagtttcagcagctgctgcgcaaggccaaactcttcatcgggtttggcttcccctacgagggccccgcccccctggaggccatcgccaatggttgcatcttcctgcagtcccgcttcagcccgccccacagctccctcaaccacgagttcttccgaggcaagcccacctccagagaggtgttctcccagcatccctacgcggagaacttcatcggcaagccccacgtgtggacagtcgactacaacaactcagaggagtttgaagcagccatcaaggccattatgagaactcaggtagacccctacctaccctacgagtacacctgcgaggggatgctggagcggatccacgcctacatccagcaccaggacttctgcagagctccagaccctgccctaccagaggcccacgccccgcagagcccctttgtcctggcccccaatgccacccacctcgagtgggctcggaacaccagcttggctcctggggcctggccccccgcgcacgccctgcgggcctggctggccgtgcctgggagggcctgcaccgacacctgcctggaccacgggctaatctgtgagccctccttcttccccttcctgaacagccaggacgccttcctcaagctgcaggtgccctgtgacagcaccgagtcggagatgaaccacctgtacccggcgttcgcccagcctggccaggagtgctacctgcagaaggagcctctgctcttcagctgcgccggctccaacaccaagtaccgccggctctgcccctgccgcgacttccgcaagggccaggtggccttgtgccagggctgtctgtgaatccgcctctgccgccctgcctggcacccacgctggctctctcctgccgcgggagaaagcaccagcaggttctgagccctggctgcttgtcctcctcgcaacccccccaggccggagcttccttccttagccgggaagctggcagaggagagccgtgcccgggaataggaggaggcagcatgccgagcccctgggacctcccaggcaggctccggttctctcctggggactcacagaagcatcgtggccaagcaggtgtcggactgctcagagtccgcatggcccaggagcaggtggtcggaggcccctggctttgtgcaaggccggatctgggccaggtggcgaaaggggcccagtcgttcttgggcccaggatggggcctctagacttgcaagggagaggaacagggaccaggctgccccacggtccctgaagggtccaaggaggggccctccccatggccctggagagtgggcctgggtggtacctgctccaggcagggaaactgggggctcgcccttctcctgtgaggggagccaggcacacagggcccattggtgtttgggatgtggacagaggggcagggggctgggagaaggctaagccgaggggtcctgtttgtgcctccccttagtcccttccctcccgatttcccgattcccccaccctccctctacacttgaggaccacagttgggggtgtagggaccacccagaccctggttgaattgtttctctctcctgcttgttccaacccttttcactctgggcttctcccaaaacccatcctggcatgacctgcaactccaggtggtggatttgttccaaagcctcaatccctaccccctccaaggggcaggtttccagtccagcctcagagatcaggctctgggacccctgcctggggggtggccttcatgcactagccacttccgcaggtgctgactcccgcactccctggcattttttgcagacaagggcttgggatggaccctcagccccatggtacgccctgcccagtttccagttgccctgtccacttaccctaggtagccccccaccccatcagtgccgagtccttgtccctacctccagcttcctccagcctcaaaccgcctctggatctagctgtccttctccgagtggcacgcctgccccaggatgccccctttccctcccccccatgcccagagccccgcctgcctcagcgggtcaggccttcagaacactgccacccacccagttttataatcccgctccctctccaggcaaccccacccaccagcctaggcctgctcctccacccttcccgggaggcagccccgggatgctgagagttggtggaggggccaggctggacgcttcctgtgggagtcccctccagacctggctggcccctgcagccacagaaaccacgatggcaaaaaatctcattggttctcaaggactaacctgtgggggaaagcaatagagacactctttttctctcttttttttaaagatttatttcttgaaataataaatattttattgggatgtgaggtgcagaagaaaaaaaaa

SEQ ID NO: 53292 - DNA, 4068 bp, Homo sapiens
gccagcatcttgtagttgagctctctttatcctatagtgggggggccctcctgggtctggagctcagcccccatcctttcattctcccttgcttccttcactcatgcactcattcgtaaaacatttgtgcagccggtacgtggtggagcgtcagggcacgatggcccttcctgccctcctgacccgcctccttcctctccgcaggctttttgtcctgggcatcggcttcttcactctctgcttcctgatgacgtctctgggaggccagttctcggcccggcgcctgggggactcgccattcaccatccgcacagaagtgatggggggccccgagtcccgcggcgtcctgcgcaagatgagcgacctgctggagctgatggtgaagcgcatggacgcactggccaggctggagaacagcagtgagctgcaccgggccggcggcgacctgcactttcccgcagacaggatgccccctggggccggcctcatggagcggatccaggctattgcccagaacgtctccgacatcgctgtgaaggtggaccagatcctgcgccacagtctgctcctgcacagcaaggtgtcagaaggccggcgggaccagtgtgaggcacccagtgaccccaagttccctgactgctcagggaaggtggagtggatgcgtgcccgctggacctctgacccctgctacgccttctttggggtggacggcaccgagtgctccttcctcatctacctcagtgaggtcgagtggttctgccccccgctgccctggaggaaccagacggctgcccagagggcacccaagcccctccccaaagtccaggcagttttccgaagcaacctgtcccaccttctggacctgatgggcagcgggaaggagtccctgatcttcatgaagaagcggaccaagaggctcacagcccagtgggcgctggctgcccagcgcctggcacagaagctgggggccacccagagggaccagaagcagatcctggtccacatcggcttcctgacggaggagtccggggacgtgttcagccctcgggtcctgaagggcgggcccctaggggagatggtgcagtgggcggacattctgactgcactctatgtcctgggccatggcctgcgggtcacagtctccctgaaggagctgcagagtaacttaggggtaccgccaggccggggaagctgcccgctcaccatgcccctgcccttcgacctcatctacaccgactaccacggcctgcagcagatgaagcggcacatgggactctccttcaagaagtaccggtgccgaatcagggtcatcgacaccttcgggacggaacctgcgtacaaccacgaggagtacgccacgctgcacggctaccggaccaactggggctactggaacctcaaccccaagcagttcatgaccatgtttcctcatacccccgacaactccttcatgggcttcgtgtccgaggagctcaacgagacggagaagcggctcatcaaaggcggcaaggccagcaacatggccgtggtgtacggcaaggaggcgagcatctggaaggggaaggagaagttcctgggcatcctgaacaaatacatggagatccatggcaccgtgtactacgagagccagcggccccccgaggtgccagcctttgtgaagaaccacggcctcttaccgcagcctgagtttcagcagctgctgcgcaaggccaaactcttcatcgggtttggcttcccctacgagggccccgcccccctggaggccatcgccaatggttgcatcttcctgcagtcccgcttcagcccgccccacagctccctcaaccacgagttcttccgaggcaagcccacctccagagaggtgttctcccagcatccctacgcggagaacttcatcggcaagccccacgtgtggacagtcgactacaacaactcagaggagtttgaagcagccatcaaggccattatgagaactcaggtagacccctacctaccctacgagtacacctgcgaggggatgctggagcggatccacgcctacatccagcaccaggacttctgcagagctccagaccctgccctaccagaggcccacgccccgcagagcccctttgtcctggcccccaatgccacccacctcgagtgggctcggaacaccagcttggctcctggggcctggccccccgcgcacgccctgcgggcctggctggccgtgcctgggagggcctgcaccgacacctgcctggaccacgggctaatctgtgagccctccttcttccccttcctgaacagccaggacgccttcctcaagctgcaggtgccctgtgacagcaccgagtcggagatgaaccacctgtacccggcgttcgcccagcctggccaggagtgctacctgcagaaggagcctctgctcttcagctgcgccggctccaacaccaagtaccgccggctctgcccctgccgcgacttccgcaagggccaggtggccttgtgccagggctgtctgtgaatccgcctctgccgccctgcctggcacccacgctggctctctcctgccgcgggagaaagcaccagcaggttctgagccctggctgcttgtcctcctcgcaacccccccaggccggagcttccttccttagccgggaagctggcagaggagagccgtgcccgggaataggaggaggcagcatgccgagcccctgggacctcccaggcaggctccggttctctcctggggactcacagaagcatcgtggccaagcaggtgtcggactgctcagagtccgcatggcccaggagcaggtggtcggaggcccctggctttgtgcaaggccggatctgggccaggtggcgaaaggggcccagtcgttcttgggcccaggatggggcctctagacttgcaagggagaggaacagggaccaggctgccccacggtccctgaagggtccaaggaggggccctccccatggccctggagagtgggcctgggtggtacctgctccaggcagggaaactgggggctcgcccttctcctgtgaggggagccaggcacacagggcccattggtgtttgggatgtggacagaggggcagggggctgggagaaggctaagccgaggggtcctgtttgtgcctccccttagtcccttccctcccgatttcccgattcccccaccctccctctacacttgaggaccacagttgggggtgtagggaccacccagaccctggttgaattgtttctctctcctgcttgttccaacccttttcactctgggcttctcccaaaacccatcctggcatgacctgcaactccaggtggtggatttgttccaaagcctcaatccctaccccctccaaggggcaggtttccagtccagcctcagagatcaggctctgggacccctgcctggggggtggccttcatgcactagccacttccgcaggtgctgactcccgcactccctggcattttttgcagacaagggcttgggatggaccctcagccccatggtacgccctgcccagtttccagttgccctgtccacttaccctaggtagccccccaccccatcagtgccgagtccttgtccctacctccagcttcctccagcctcaaaccgcctctggatctagctgtccttctccgagtggcacgcctgccccaggatgccccctttccctcccccccatgcccagagccccgcctgcctcagcgggtcaggccttcagaacactgccacccacccagttttataatcccgctccctctccaggcaaccccacccaccagcctaggcctgctcctccacccttcccgggaggcagccccgggatgctgagagttggtggaggggccaggctggacgcttcctgtgggagtcccctccagacctggctggcccctgcagccacagaaaccacgatggcaaaaaatctcattggttctcaaggactaacctgtgggggaaagcaatagagacactctttttctctcttttttttaaagatttatttcttgaaataataaatattttattgggatgtgaggtgcagaagaaaaaaaaa

SEQ ID NO: 53293 - DNA, 1715 bp, Homo sapiens
ctgttaccaaggaggcagggccgtgtcatttaagcatggccccatggactgaccctttcagcagggacttttattgggggctggtacccagaagaaggagcatgagtgggcaagaccttcaaaaagaacctactacacactggaactgactagtactcctgggatgccatgccacgcagcagccagcactcggagagcagtcccctggatactaccacacagagaaaaggggcatcttcacttgcacatcaggtgagggtgcacacacttgaaactctgctagactggccagagctgccccagccacttctcaccccaccaccagttattgatacagccgctgggtctaggaagcgatttctgaacaaggcccagttagcacaatgtcttgctcagcagacaataaatacttgtaaattgaattgcatgatcttagctcaggtgctactaatgtggctcacggccacacacttgcatggataagaaaaccaatgagcccctcaacagagtcttttgaaacaaaattggtttcaagtgaaacttacattattttttggctgtgaccttctgaatataataacttagtgtcctgagaattgaaaggcctcttgatttcttaggtgaactgttacagaatcctagcctgtggtaaatgctaaaatgtaaggtgtttctgagaaggaatatttaggaaatataattgtgccacacacacattactttagaagatatgcagttgctctgattctgcaggtttaaaaaaaatgggaagtttgtgatatggcagaatctgtctccattggtcaaaccatacttcagtgagagccattataagtgaaatctaaaaattgatcgttttcattctctgactttggtcagacttttgcaaattatggagagaggccatcaacatattttacataaattactgtggccccatcttatttctcctcatttcttccttatgtttaaacacgcccccatctcacacacaaactgagaaaagatttgtatcaaacagaatcagaggcatatgaatggactggaaattgtgaaaaaggtataaatatcctagaccttgatcaactcactttaaactggtctctgattcctcatctgtcaaatgagtataagaccctctgtacttcccatggtgattttgaggagcacatgcataatgtatctgaaaatggcttgacaagcacttgaagccattcttactaaattattagttttgtaattcggttttatccaggaaaatattttagctcctcctatctgctgaattaatttatacagtcacatgttccatgacaccatgttttgccaaggaaaaataaagaaattcctaaatttgaaattgcccacaagatctagcctcatctggagttgctgttattgtccttgttgtctatgatttggaggatatgtaagtacttgtacatgtgctttaactctgggtgaaaaaccccaaccggtgagtctttaaaaccatattagacacattgggcaaagtactgagcagaagctttgaatgtagctgttgttattttaatgcttcgctttctaatgaactttgtacgtccttagcctctgccgggaacagagtgttcatatgctgttagaattttttattgtaaaataaaatgacaaaggctttcataccccaaaaaaaaaaaaaaaaaaaaaaaaaaaaaaaaaaaaaaaaaaaaaaa

SEQ ID NO: 53294 - DNA, 2704 bp, Homo sapiens
gcgggaggcggttcctgcagggtccagtcccgggagcacccccaggaggaggggagggtgggagcgcctctctttgagtccccgggtttggtcgctgggatgtgaggaagccggagaggccgcggctggacgcaggtgggtgtggaggggccgcccggactgcggggacccgctccgcgcacagtggctgagcgcccgcctctctttccaggggctgaggatccggcggctcggctgcactatgcccttcccgcccatgccgccgccgcccgcccccgccccgggggcccaagccgcgcgccagttaccccggaggccctgcgccgcgggggacaagaagaagaggcccccacagcggcccgaggggctcctctccagctcctggccctccgccacgctcaagaggccgccggcccggcgcggccccggcctggacaggacgcagccgccggcccctccgggcgtctccccccaggccttgcccagccgcgcgcgggccccagccacgtgcgccccgccccggccggcaggctccggccacagcccagcgaggaccacctatgcggcgacctcggcggggacggggaccaccgccgcgggcacctcctcgggggcggggccttgtccagactccgctgcgcgcttctgcctgaatctcacccccgaggccgtcctggtcatccagaagcgtcatctggagaagcagctgctggcgcggccccgcaggcccttcccctcaccctcggccgaacccaggcgcctactcgccccgtgtctcccggctagggccgcgggcccgcggaggggcggccccgccagcgaccccgacgcaccccccaccgccggccagggccgccgcgcgcctccgcccggcgcccagctgctgcacggcggcctgcaggttccccagctcagcccgcggcccggggccctgcggccgatgctcaaggtgtcgctgctcaacgagcggcacaggtacgacgacgtggagtacgaggaggagccagaggcggtggacgagggcctggtacgcaagtgcacggagtggctgcgcggcgtggagtccgcggctgccgcgcggggccgggcgggggccctggactcacggcggcacctgagcacgctgtgagcccagcgggcctgcggggacaggccaggcctgatcccacctcacttcctgcacgcgccactccgcctaggggccctcgggggagaccgcaggctcctctggccgccagcgcccactttcgggacaccagtgcgcaagctggcccacgtggggcgcagccagactcgcccgacggccacggcccccctcctgccctcgccagccggcagcccgggcctttctcgttcacaccggtggtatctaccccagatgcctgcctctgcccccactctggcctcctcttggcatcgccgagcatccatgcagttcgtggggaattaagcaactgagaaaatgcctcttggtgccccgacccccagggttcgtctaggtcccagagaccctctgcctggaggcgggccttccccagggctacatctgcacgccccgtggtgtcaccctcagccggcgccgggcaccctggacagtgcggtgggcgatggcccaggtgggtggccgcgacggtggcctcctgcagagctgggacccggtcctacattcgtgattttgttttctcccaagtcagaaaaatgttgagggtattagacatccctgaaactcagttaaccgaatttccagtctccaaagcggaagggtaggcatcgccaggcgctggtgagccctggtcaatgagcgcttccatggaaaccgctcggctgattacattttttctgtgtattatttgaatagagagtaaagctcctccgctgtttcgtaaccatatcctttcccccgctaactggaggctgatttctacatatttcttccatgtatctgagaatatctaactagaaggatgagaaggaaataaaatgttataatcagataaggctggttataaaagagtaatgtattacctcaatttttgactgactttgtaaaagccaataactggtttaatgtttatcttgatagactttaaatgtatcaagtcttaattgtattttaaattgaagccttacatttttaaaacagattttgtatttttcttgtggaggtctttgctctaataacacacacacactgtctctctctctctctctctctaattctaggcacacatttagttagatgtgaagcatttaattcattgggagctaggtcagctgccagatgagttgcaaaaacagaaaaaaacctacccattgaataacttctttgaatttggagataagttttcttttacttaaaatgaatatattaattctagaggggcaaaactagcaatgcttatgcaagtgacggtgctgctcttgttccacccccacccagatggtctctgagtgcgccgtcctgggcagggcacacggtctggagctgagagggtggagcaagagtgcactgactccgagccgagggcaggagtggctcaacttggtctcgtcttgcacttagtgcaaataccaataattaagatgcctagacttctgcccttggtcacagtaacaacaacattttgaagacttttccctggtggcatcctagagggaccgactttctgcagcctctgtcttccaagctgagcttctgctgcag

SEQ ID NO: 53295 - DNA, 3934 bp, Homo sapiens
ctcggctggctaagcctgcgccgggccgcctcgctcgctcccagctctgtcagtggcccgcggggcccgatcgctgcgcccgcggccagggccgaggcaggcctgacccggggccgggcagcccgcgcgactttcggaacatggcaacccgtgtgtgtctcatcccagaaagagaagactttaaccactgtgatgcctgagaatccagtgagtgtgacgtttctccagatacttcatgctgttcacctgtgtcctcgccgcaccactgccgcacacgactcctgaaccatgggggaaaacgaggatgagaagcaggcccaggcggggcaggtttttgagaactttgtccaggcatccacgtgcaaaggtaccctccaggccttcaacattctcacacgacacctggacctagaccctctggaccacagaaacttttattccaagctcaagtccaaggtgaccacctggaaagccaaagccctgtggtacaaattggataagcgtggttcccacaaagagtataagcgagggaagtcgtgcacgaacaccaagtgtctcatagttgggggaggaccctgtggcttgcgcactgccattgaacttgcctacctgggagccaaagtggtcgtggtggagaagagggactccttctcccggaacaacgtgctacacctctggcctttcaccatccatgaccttcggggcctgggagccaagaagttctatgggaagttctgtgctggctccatcgaccatatcagtattcgccaactacagctcatcctattcaaggtggccctgatgctgggagttgaaatccatgtgaatgtggagttcgtgaaggttctagagcctcctgaagatcaagaaaatcaaaaaattggctggcgggcagaatttctccctacagaccattctctgtcggagtttgagtttgacgtcatcattggtgccgatggccgcaggaacaccctggaagggttcagaagaaaagaattccgtgggaagctggcgattgccatcaccgccaacttcataaacagaaacagcacagcggaagccaaggtggaagagattagtggtgtggctttcatcttcaatcagaaattttttcaggaccttaaagaagaaacaggcatagatcttgagaacattgtttactacaaggactgcacccactattttgtaatgacagccaagaagcagagcctgctcgacaaaggtgtcatcattaacgactacatcgacacagagatgctgctgtgtgcggagaacgtgaaccaagacaacctgctatcctatgcccgggaagctgcagactttgccaccaactaccagctgccatccttagactttgccatgaaccactatgggcagcctgatgtggccatgtttgactttacctgcatgtatgcctcagagaacgcggccctggtgcgggagcggcaggcgcaccagctgctcgtggcccttgtgggtgacagcttgcttgagccattttggcccatgggtacaggctgtgcccgtggcttcctggcagcctttgacacggcatggatggtgaagagctggaaccagggcacccctcccctggagctgctggctgaaagggaaagtctctaccggctgttacctcagacaaccccggagaacatcaacaagaactttgagcagtacacgttggacccagggacacggtacccaaacctcaactcacactgtgtcaggccccatcaggtgaagcatttgtatatcactaaggagctggagcactaccctctcgagagactgggctcggtgaggagatctgtcaacctctccaggaaggagtcagatatccggcccagcaagctcctgacctggtgccagcagcagacagagggctaccagcatgtcaacgtcaccgacctgaccacatcctggcgcagtgggttggccctgtgtgccatcatccaccgcttccggcctgagctcatcaactttgactctttgaatgaagatgatgctgtggagaacaaccagctcgcatttgatgtggccgagcgagagtttgggatccctccagtgaccacgggcaaagagatggcatctgcccaggagcctgacaagctcagcatggtcatgtacctctccaagttctacgagctcttccggggcaccccactgaggcccgtggattcttggcgcaaaaactatggagaaaatgctgacctcagcttggccaaatcatccatttctaataactatctcaacctcacatttccaaggaagaggactccacgggtggatggtcaaaccggagagaatgacatgaacaaacggagacggaagggcttcaccaacctggacgagccttcaaacttttccagccgtagcttgggctccaatcaagagtgtgggagcagtaaggaaggtggaaatcagaacaaagtcaagtccatggcgaatcagctgctggccaagtttgaggagagcactcggaacccctcactcatgaagcaggaacgccgtgtctcagggataggtaagccggtcctgtgctcttcctccggccctcctgttcactcttgctgccccaagccggaggaggccacacccagcccatcacctcctctgaaaaggcagttcccctctgtggtcgtgacggggcacgtgctcagagagctcaagcaagtgtctgctggcagtgagtgcctgagcagaccttggagagccagagccaagtctgacctacagctgggtgggacagaaaatttcgctaccctgccttctacccgcccgagggcgcaggctctttccggggtgctgtggcggctgcagcaagtggaggaaaagattctccagaagagggctcagaacttggccaacagggaatttcacacaaagaacattaaggagaaggcggctcaccttgcctccatgtttggacacggggatttcccgcagaataaactactctctaaaggcctgtctcatactcatcctccatctcctccctctcgccttccgtctcctgatccagctgcttcttcctctccatcaactgttgactctgcttctcctgccagaaaggaaaagaagtcaccttcagggttccattttcatcccagccatttgagaacagtgcatcctcagctgacggtagggaaagtgtccagcggaataggggctgcagctgaagtcctggtcaatctgtacatgaatgatcacagacctaaggcccaggccacctctccagacctggaatctatgcgaaagtcatttccccttaacctgggaggcagcgacacgtgttacttctgtaagaaacgtgtgtacgtgatggaacggctgagcgccgagggccacttcttccaccgggagtgtttccgctgcagcatctgtgccaccaccttgcgcctggccgcctacacctttgactgcgatgaaggcaaattttactgcaagcctcacttcattcactgtaaaaccaatagcaaacaacggaagagacgggcagagttgaagcaacaaagagaggaggaggcaacatggcaagagcaggaagcccctcggagagacactcccaccgaaagttcttgcgcagtggccgccattggcaccctggaaggcagccccccagttcatttcagccttccagtgctacacccacttcttggctgacacacttctgctctaagagtctccctccctttatagaatgtcaaccaaagagtgccctcctcccctctcagcctcctctttagctagcctccccatctcatcacaacgcatgtctgtgacctttggtaatcatttacagtgccacacggaaccctgtattttgcacacagcaaaacaaacaatgtttagctttatttatggtatttgatgctgtaaatggaaataaatattgttctttataaaaaaaaaaaaaagaaaaaaaaaaaaaaaa

SEQ ID NO: 53296 - DNA, 3516 bp, Homo sapiens
attcaggaagcagctctccttcccctgccttcagctcaagtttgctgagcttttgtttcatttgtgaatacttcttgctggaagtccctcacccagagaccagtgctcccaacggcagagcagcgggggagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggcttggcgcctctgtcctggcccgggagccgcaggggcccctcctccagagcctgggcgcaagcgacacaggctgccgctgctctcccaggtgaaatccacaccagtccacgccgggtcgcctgccctgtctccctacttagacccagtcattctagagggatccaccgccacactggccggcccacgtcctgggtgctgtcatgcccagcttggagtgccacgtggccgctgcccacgtcccgggcactgtcatgcccagcttggagtgccacatggccgctgcccacgtcccgggcactgtcatgcccagcttggagtgccacgtggccgctgctgtgacaggcagtgttcttgggggtggggctgcatccaaggctttgtaaaccggctggaccacgtctccctggccccagtgaccgggggaagctgagcccctccctcctgtgtttgctcccattactcaaaatgcaggacagatcaggtcagagcccaggaattctcacaggttcacccagcgccctctacctcctagcaagtactttgtcttgatcctcactgagaaggccccagggcagcggtcttctccatctccgctgttttggggtcttagggtacagcccaggcggtcactgcccacctgccaggctgcagggacagttgggtgtgagaataacactggctttgggtagtgccatggccaggagtgggtttccctgcgtctcctcgtcccgagggcgcctgggtcctcccagctgacggcagtaaatccacagtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccactgcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggaacgtttttgctggcttgcactttcttattttcttattttagagcgcttaaaaaatccggaaaaatggggtttaaaagaactgtctctttcagtctacatttttgtttaatacgcttgagcaataaacgctgacttgcagacgtg

SEQ ID NO: 53297 - DNA, 3572 bp, Homo sapiens
atctctcgtttagctaccaattggagcagtttaacgtgcttgagtccccggcgtgatgtgttcatggacgaagttgccgatggatgttgtcaggtgttgcacctggagggcccagatggatcaatgaggcatttaaagtgtagaatctcaccctgaacccagactattcagataaagaactggtgacacgtggctgtacattcagcacagctgtggtgtccccaagtgccatgacccaggagccattcagagaggagctggcctatgaccggatgcccacgctggagcggggccggcaagaccccgccagctatgccccagacgcgaagccgagcgacctgcagctgtcgaagagactgcccccctgcttcagccacaagacgtgggtcttctctgtgctgatggggagctgcctcctggtgacctcggggttttcgctgtacctggggaacgtgttcccggctgagatggattacttgcgctgtgctgcaggctcttgcatcccctcggcaattgtgagcttcaccgtctccaggaggaacgccaatgtgattcccaactttcagatattgtttgtttccacgtttgctgtgaccactacgtgtttaatttggtttggatgcaaactagtcctgaacccatcagcaataaacatcaacttcaacctcatcctgctgctcctgctggagctgctcatggcggccacggtgatcatcgctgcacggtccagcgaggaggactgcaagaaaaagaagggctccatgtctgacagcgccaacattctggacgaagtgccatttcctgctcgggtcctgaaatcttactcagtcgtcgaggtaatcgcaggcatctctgccgtcctcggggggatcattgccctgaacgtggatgactcagtttcaggcccacacctctcagtgacgttcttttggatcctagtggcctgctttccaagtgccattgccagtcatgtggcagcagagtgtcccagcaagtgtctggtggaggtcctgattgccataagcagcctcacgtctccgctgctgttcacagcctctggatatctgtcattcagcatcatgagaatcgtggagatgtttaaggattacccgccagccataaaaccatcctacgatgtgctgctgctgctgctgctgctagtgctcctgctgcaggccggcctcaacacgggcaccgccatccagtgcgtgcgcttcaaggtcagtgcaaggctgcagggtgcatcctgggacacccagaacggcccgcaggagcgcctggctggggaggtggccaggagccccctgaaggagttcgacaaggagaaagcctggagagccgtcgtggtgcaaatggcccagtgacccccagacgcggaaaccgggtggcagcgcccagcctggccccaagcatggaaacgcacaacccctaatcgccctgagctactgcttctaacacctcttttcccttgtgtgagggcaaaccaggctgcaggtggggttttcacttcctagggtagtttaattttaaaataggccaatgttggctagtctgtgcctcagtgagatcagtcagctccgagtggctcccgtgtcgtaacagcaggagcatggccgcaacttcccaggccgaggaagggcccccggctcggcctcttgagagccccacccctgaactggccccagctcctcttcctgcctctctcatggcttgggctggagtgggctctctggacctgaccagactgtgggtccctgcgtctcctgcccactctgaccgggcttcctccctccacgcttagggtctgtcccgggtactcagtcagcccagtgggatcttacccacttccctgcaaggtgcacctgccccaggctcaggctgcccagcggctcttcctggacagtgagagcagggctgggcgcctctgtcctggcccgggagccgcaggggcccctcctccagagcctgggcgcaagcgacacaggctgccgctgctctcccaggtgaaatccacaccagtccacgccgggtcgcctgccctgtctccctacttagacccagtcattctagagggatccaccgccacactggccggcccacgtcctgggtgctgtcatgcccagcttggagtgccacgtggccgctgcccacgtcccgggcactgtcatgcccagcttggagtgccacatggccgctgcccacgtcccgggcactgtcatgcccagcttggagtgccacgtggccgctgctgtgacaggcagtgttcttgggggtggggctgcatccaaggctttgtaaaccggctggaccacgtctccctggccccagtgaccgggggaagctgagcccctccctcctgtgtttgctcccattactcaaaatgcaggacagatcaggtcagagcccaggaattctcacaggttcacccagcgccctctacctcctagcaagtactttgtcttgatcctcactgagaaggccccagggcagcggtcttctccatctccgctgttttggggtcttagggtacagcccaggcggtcactgcccacctgccaggctgcagggacagttgggtgtgagaataacactggctttgggtagtgccatggccaggagtgggtttccctgcgtctcctcgtcccgagggcgcctgggtcctcccagctgacggcagtaaatccacagtgagttggggcgactgtgaaactggaatgctgttactttgataattactttccagcaggtgttttccttcacaatggttttgtttctttccttctgatctgagaagacatgaacgttttctcttcaccgccgtggggtgtattgactggtcccccatgggctgctggaaaggcccggagatgcatctgtggcctggggccatcaagatcaaagaaccaggaggcctgggagatgcagctggatggggcggcctgcagaccctgccagggggtttgaggaccctcccaggtttcccactgcggaacaggagtgactctggctgccaagataccttcatggtgttcatgacaagtggaatcattattttcaaccattgaagggggatgcaggcaagacaccttcccagctgctcctagaggggacaagccaggccctctctgcagtcctcggcagctccggaaggacacagtcaggggccgggcaaacactttggccacagccccaaacaagcgccaccgtgggagaggagaggctgctgtcactggtaccggatgcagaccccaccctgtctgcaggccacccccacctccctgcagctttgaggctggcggggtctgctcctgggaatggggtgggagccacagggacgacccggggcgggctgatgtcttcttgggggcagaccagagagctcaagtttcagagtcagaattaggcacttggagcgtttttgctggcttgcactttcttattttcttattttagagcgcttaaaaaatccggaaaaatggggtttaaaagaactgtctctttcagtctacatttttgtttaatacgcttgagcaataaacgctgacttgcagacgtgaaaaaaaaaaaaaaaa

SEQ ID NO: 53298 - DNA, 1869 bp, Homo sapiens
gtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgtgccactgcactctagccggagtgacagagtaagactctgtctcaaaaataaataaataaataaataaataaataaataaataaataaataaaaaataataatacaagttttcataagcacacttctaaaaaaaaaaaa

SEQ ID NO: 53299 - DNA, 2119 bp, Homo sapiens
gtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgtgccactgcactctagccggagtgacagagtaagactctgtctcaaaaataaataaataaataaataaataaataaataaataaataaataaaaaataataatacaagttttcataagcacacttctaaaaaaaaaaaa

SEQ ID NO: 53300 - DNA, 2007 bp, Homo sapiens
gtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtgacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctactcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgtgccactgcactctagccggagtgacagagtaagactctgtctcaaaaataaataaataaataaataaataaataaataaataaataaataaaaaataataatacaagttttcataagcacacttctaaaaaaaaaaaa

SEQ ID NO: 53301 - DNA, 2257 bp, Homo sapiens
gtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcaagaccctctctgcccagctgcctctgctccttcctcctcctcctcctcctccaagtgtcttccagctatgcagggcagttcagagtgataggaccaagacaccctatccgggctctggtcggggatgaagtggaattgccatgtcgcatatctcctgggaagaacgctacaggcatggaggtggggtggtaccgcccccccttctctagggtggttcatctctacagaaatggcaaggaccaagatggagaccaggcacctgaatatcggggccggacagagctgctgaaagatgctattggtgagggaaaggtgactctcaggatccggaatgtaaggttctcagatgaaggaggtttcacctgcttcttccgagatcattcttaccaagaggaggcagcaatggaattgaaagtagaagtgtctcactctgtgacccaggattggttgcagtggcacgatcatggctcattgcagcctccacctcccaggctcaagtgatcctcctgactcagcctcttgaatagctgagaccacaggcttgtgtcaccatgcccagatcctttctactgggtgagccctggagtgctggttctcctcgcggtgctgcctgtgctcctcctgcagatcactgttggcctcatcttcctctgcctgcagtacagactgagaggaaaacttcgagcagagatagagaatctccaccggacttttgatccccactttctgagggtgccctgctggaagataaccctgtttgtaattgtgccggttcttggacccttggttgccttgatcatctgctacaactggctacatcgaagactagcagggcaattccttgaagagctacgaaatcccttctgagtgatgtcacatcttggcaggggtggaggagagcctggttgcccagggatttgtccttggggacatctcatccatcaagttgcacactcactggcatctttgctatggggacattccaatttgcactttcaggaacactctgaattccaagtagaattgatttcccttcttctgtcatctaccttttctcttcattttcccatttttattacccttctttccatttctctctccagtcttccacctggaagccctctctggctaaggacaggcaggtgcccctctctccatcagaggacacctgtactggagagcaacacaggatggtctctgccatgaactggaggccaggaatctcctcactgaaaattacagtatggtaactttgcaaatggtggttgtttcttccaagactccagccctgattgcgcaaaactgaaaggcatgtgaagggaaggaagaggaagagtgcaaaacattgaagagagagctgagtgagctgaagagtgaggatatgagtagccccaacccaaacctggagatggggagaaacctacagaatactagccagagctcctccttgtcttggcagcctactagggacctggggaagcaaaaacgaaagctgggcaacatgcctgctttagaatgttttccttctacttacacatcttccacaggtctcagaatctttccttcctctcatccttttctcctatcttcatatctatcagagtatccactgtttattcaacaactactacttgatggtcagacacaaacaaacaagctaggtgctaattaataaagatacgagttttggccgggtgcggtggctcacgcctgtaatcccagcactttgggaggccgaggcgggcgaatcacgaggtcaggagttcaagaccagcctggccaacatggtgaaaccccatctctactaaaaatacaaacaattaactgagcatagtggtgggcacctataataccagctactccggaggctgaggcaggagaatcgcttgaacccaggaggcagaggttgcagtgagctgagatcgtgccactgcactctagccggagtgacagagtaagactctgtctcaaaaataaataaataaataaataaataaataaataaataaataaataaaaaataataatacaagttttcataagcacacttctaaaaaaaaaaaa

SEQ ID NO: 53302 - DNA, 2559 bp, Homo sapiens
tgatagctgcgtaatcatactgcggcaccgtttttttcttgcagcagtagctgcttgcggaggaggtctgcccactgcagctctctgcagtctccggctctctcctgcaggatcggtcaacgcagccgtcgccgccctctgcacccagcccaggtcgccactgcttcagtccggttctcaaagcctcagcaccatcttttatccccgagcagcctggatcgtcgttccctcagtccggacgccactgctaggtccgaccaccgccgcttctgatatttcggtgagtcttttcctgtggaggtttggtctcccgatctctgtggtagccaccttaggcgtgtacggtcctttgaaaaatggccgagtcagagaaccgcaaggagctgtcagaatccagtcaagaagaggctggtaatcagataatggtggaagggctcggggaacatctggagcgcggtgaagatgccgctgctgggcttggagacgatgggaagtgcggtgaagaagctgccgctgggcttggggaagaaggggaaaacggtgaagatactgctgctgggtccggggaagatgggaaaaaaggtggcgatactgatgaggactcagaggcagaccgtccaaaaggacttatcggttatgttttagatacagactttgttgaaagtctacctgtgaaagttaagtaccgtgtgttagcccttaaaaagcttcaaactagagcggccaatttagaatccaaattcctgagggaatttcatgacattgaaagaaagtttgctgaaatgtaccaacccttactggaaaaaagacgtcagatcatcaatgcaatctatgaacctacagaagaggaatgtgaatataaatcagactctgaggactgtgatgatgaggaaatgtgtcatgaagagatgtatggtaatgaggagggtatggtacatgaatatgtggatgaggacgatggttatgaggactattattatgattatgctgtggaagaggaggaggaggaggaggaggaggacgacattgaggctactggagaagagaataaagaagaggaggatcctaagggaattcctgatttttggctaactgttttaaaaaacgttgatacactcactcctttgattaagaaatatgatgagcctattctgaagctcctgacagatattaaagttaagctttcagatcctggcgagcccctcagtttcacactagaatttcacttcaaacccaatgaatatttcaaaaatgagttgttgacaaagacctatgtgctgaagtcaaagctagcatattatgatccccatccctataggggaactgcgattgagtattccacaggctgtgagatagattggaatgaaggaaagaatgtcactttgaaaaccatcaagaagaaacagaaacatcggatctggggaacaatccgaactgtaactgaagattttcccaaggattcatttttcaattttttctctcctcatggaatcacctcaaatggaagggatggaaatgatgattttttacttggtcacaatttacgtacttacataattccaagatcagtattatttttctcaggtgatgcactggaatctcagcaggagggggtagttagagaagttaatgatgcaatttatgacaaaattatttatgataattggatggctgcaattgaggaagttaaagcttgttgcaaaaaccttgaggcattagtagaagacattgatcgttagagcagagtatacatggccctgaaattaactgccctagatatagttactcaaggtataagaagccttgtgttctgtatttttcttgtagtgttagttaaaacatatgtttcaaaaatataagaaaagttcaaaaactaattaatttgaccttgagttttagtagtagaatgttttcaagaaatgtacactgtggtaaatgatttaaaacactagtatagtgttgtgtagcttaatccttctgaagtctttttgtcatgtagctattaatctgtggctatgaaatgatcagaaatgctaagtgagatcaatatttgtttggaaaaaaaatcttgggaaacaacccaagggttttcgctgttgttgtttttctttttctatttttgtttacttagtcctttagctagtggatttaattttgttgtgcctgcttcattttgcaataacaatgcagtagaatttaaaacttggatgcttaagaggcctgcatatagataagaatttcaggcaaaactacatttattgttaataacagcttgttcataggctcttgtattttatgtaactgtgataaataatgaaacttagttatattgaggttattgtttgtcggtgaagtgttagtcacagtattttcaaaagtttgcacatattgttctgtgtaattgtgtaagccataattacagtgtttaattctcttttcctattacatcattcattgaaagtgatcactttaccattttgaaaagatatttcgtgttctttcactgcaaaataaaaagaataaaaatttcaaaaaaaaaaaaaaaaaaaaaaaaaaaaa

SEQ ID NO: 53303 - DNA, 3446 bp, Homo sapiens
agccaggagtgggcaacgcggcgtgagcagcggcccgaggctcccggagcatcgcgctgggagaagacttcgccgctcggggccgcagcctgtgtgatctcatcgccgccctgtcgtgacttcatcaatgtcgtgttgtgacctggctgcggcgggacagttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtgacgagaaaaaaaaaaaaaaa

SEQ ID NO: 53304 - DNA, 3378 bp, Homo sapiens
agccaggagtgggcaacgcggcgtgagcagcggcccgaggctcccggagcatcgcgctgggagaagacttcgccgctcggggccgcagcctgttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtgacgagaaaaaaaaaaaaaaa

SEQ ID NO: 53305 - DNA, 3718 bp, Homo sapiens
agccaggagtgggcaacgcggcgtgagcagcggcccgaggctcccggagcatcgcgctgggagaagacttcgccgctcggggccgcagcctggtgagctcagcccccttcgggccctcccctgcatcccagccggggcctctccgagccggcgctgatcgatgccgacacaccccggggaccctatcgcgactccatcgcgccatatcgcgacaccatcgtgccctgtcgagactccattttgtcacagcccttttcaatatatatcttttttttttttaatttgccctgtcatctttgggggctgtctcccatgtcgtgattttgacgtgatctctccgtgacatcaccgcgccatcgtgaagtgtgatctcatcgccgccctgtcgtgacttcatcaatgtcgtgttgtgacctggctgcggcgggacagttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgcccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtgacgagaaaaaaaaaaaaaaa

SEQ ID NO: 53306 - DNA, 1846 bp, Homo sapiens
cctctctctctctccctctctctctccctctctctctctccctgtgtcgcttaaacaacagtcctaacttttgtgtgttgcaaatataaaaggcaagccatgtgacagagggacagaagaacaaaagcatttggaagtaacaggacctctttctagctctcagaaaagtctgagaagaaaggagccctgcgttcccctaagctgtgcagcagatactgtgatgatggattgcaagtgcaaagagtaagacaaaactccagcacataaaggacaatgacaaccagaaagcttcagcccgatcctgccctttccttgaacgggactggatcctaggaggtgaagccatttccaattttttgtcctctgcctccctctgctgttcttctagagaagtttttccttacaacaatgagaaaacatgtactagctgcatccttttctatgctctccctgctggtgataatgggagatacagacagtaaaacggacagctcattcataatggactcggaccctcgacgctgcatgaggcaccactatgtggattctatcagtcacccattgtacaagtgtagctcaaagatggtgctcctggccaggtgcgaggggcactgcagccaggcgtcacgctccgagcctttggtgtcgttcagcactgtcctcaagcaacccttccgttcctcctgtcactgctgccggccccagacttccaagctgaaggcactgcggctgcgatgctcagggggcatgcgactcactgccacctaccggtacatcctctcctgtcactgcgaggaatgcaattcctgaggcccgctgctgtgtgtggcttctggatgggacaactgtagaggcagttcgaccagccagggaaagactggcaagaaaagagttaaggcaaaaaaggatgcaacaattctcccgggactctgcatattctagtaataaagactctacatgcttgttgacagagagagatactctgggaacttctttgcagttcccatctcctttctctggtacaatttcttttggttcattttcagattcaggcattttcccccttggctctcaatgctgtttgggtttccaacaattcagcattagtgggaaaaagtgggccctcatacacaagcgtgtcaggctgtcagtgtttggtgcacgctggggaagaatttactttggaaagtagaaaagcccagcttttcctgggacatcttctgttattgttgatgtttttttttaccttgtcattttggtctaaggttgccattgctgctaaaggttaccgatttcaaagtccagataccaagcatgtggatatgtttagctacgtttactcacagccagcgaactgacattaaaataactaacaaacagattcttttatgtgatgctggaactcttgacagctataattattattcagaaatgactttttgaaagtaaaagcagcataaagaatttgtcacaggaaggctgtctcagataaattatggtaaaattttgtaagggagcagacttttaaagacttgcacaaatacggatcctgcactgactctggaaaaggcatatatgtactagtggcatggagaatgcaccatactcatgcatgcaaattagacaaccaagtatgaatctatttgtgggtgtgctatagctttagcgtgtcacgggcatcattctctaatatccacttgtccatgtgaaacatgttgccaaaatggtggcctggcttgtcttctgaacgtttggttcaaatgtgttttggtcctggaggctcaaattttgagttattcccacgttttgaaataaaaagagtatattcaaaaaaaaaaaaaaaaaa

SEQ ID NO: 53307 - DNA, 3238 bp, Homo sapiens
atgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacccggcggcgactacaagctgtcccgctccaacgagaaggagcagctgcaggggctgaacgaccgctttgccggctacatagagaaggtgcactacctggagcagcagaataaggagattgaggcggagatccaggcgctgcggcagaagcaggcctcgcacgcccagctgggcgacgcgtacgaccaggagatccgcgagctgcgcgccaccctggagatggtgaaccacgagaaggctcaggtgcagctggactcggaccacctggaggaagacatccaccggctcaaggagcgctttgaggaggaggcgcggttgcgggacgacactgaggcggccatccgggcgctgcgcaaagacatcgaggaggcgtcgctggtcaaggtggagctggacaagaaggtgcagtcgctgcaggatgaggtggccttcctgcggagcaaccacgaggaggaggtggccgaccttctggcccagatccaggcatcgcacatcacggtggagcgcaaagactacctgaagacagacatctcgacggcgctgaaggaaatccgctcccagctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggacaccatccagcagctggaaaatgagcttcggggcacaaagtgggaaatggctcgtcatttgcgcgaataccaggacctcctcaacgtcaagatggctctggatatagaaatcgctgcgtacagaaaactcctggagggtgaagagactagatttagcacatttgcaggaagcatcactgggccactgtatacacaccgacccccaatcacaatatccagtaagattcagaaaaccaaggtggaagctcccaagcttaaggtccaacacaaatttgtcgaggagatcatagaggaaaccaaagtggaggatgagaagtcagaaatggaagaggccctgacagccattacagaggaattggccgcttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgcccaagtcaccagtggaagagaaaggcaagtctcctgtgcccaagtcaccagtggaagagaaaggcaagtctcctgtgccgaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagaagaaaaggaagtcaaggaagctcccaaggaagagaaggtagagaaaaaggaagagaaaccaaaggatgtgccagagaagaagaaagctgagtcccctgtaaaggaggaagctgtggcagaggtggtcaccatcaccaaatcggtaaaggtgcacttggagaaagagaccaaagaagaggggaagccactgcagcaggagaaagagaaggagaaagcgggaggagagggaggaagtgaggaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaatgaaacacagaactcagccttaagaaagctatatatgaataattatgtttacctcactggtgcatttaaaatggacttttgttcatgggagaacctcgttgacatgcacagtttgcaatcttatgttgatcgatgttaaacgtcacagcagtacttgctcaataaaggtcatattggaaacata

SEQ ID NO: 53308 - DNA, 2019 bp, Homo sapiens
agagatgccacactcgctccgcggttcgcatggcgctctgaagacgccggcgcccgccgccttgaggagccgctgcccccgctccctgaagatgggggaacaatgaaataagcgagaagatccctcttctcccccctctctctcttgccccctccccccctcccctcccctctccccttgactcctctccgaggcaccatgctgacccgcctgttcagcgagcccggccttctctcggacgtgcccaagttcgccagctggggcgacggcgaagacgacgagccgaggagcgacaagggcgacgcgccgccaccgccaccgcctgcgcccgggccaggggctccggggccagcccgggcggccaagccagtccctctccgtggagaagaggggacggaggccacgttggccgaggtcaaggaggaaggcgagctggggggagaggaggaggaggaagaggaggaggaagaaggactggacgaggcggagggcgagcggcccaagaagggcgggcccaagaagcgcaagatgaccaaggcgcgcttggagcgctccaagcttcggcggcagaaggcgaacgcgcgggagcgcaaccgcatgcacgacctgaacgcagccctggacaacctgcgcaaggtggtgccctgctactccaagacgcagaagctgtccaagatcgagacgctgcgcctagccaagaactatatctgggcgctctcggagatcctgcgctccggcaagcggccagacctagtgtcctacgtgcagactctgtgcaagggtctgtcgcagcccaccaccaatctggtggccggctgtctgcagctcaactctcgcaacttcctcacggagcaaggcgccgacggtgccggccgcttccacggctcgggcggcccgttcgccatgcacccctacccgtacccgtgctcgcgcctggcgggcgcacagtgccaggcggccggcggcctgggcggcggcgcggcgcacgccctgcggacccacggctactgcgcagcctacgagacgctgtatgcggcggcaggcggtggcggcgcgagcccggactacaacagctccgagtacgagggcccgctcagccccccgctctgtctcaatggcaacttctcactcaagcaggactcctcgcccgaccacgagaaaagctaccactactctatgcactactcggcgctgcccggttcgcggcccacgggccacgggctagtcttcggctcgtcggctgtgcgcgggggcgtccactcggagaatctcttgtcttacgatatgcaccttcaccacgaccggggccccatgtacgaggagctcaatgcgttttttcataactgagacttcgcgccggctcccttctttttcttttgcctttgcccgccccccctgtccccagcccccagagcgcagggacacccccatcctaccccggcgccgggcgcggggagcgggccaccggtcctgccgctctcctggggcagcgcagtcctgttacctgtgggtggcctgtcccaggggcctcgcttcccccaggggactcgccttctctctccgcaaggggttccctcctcctctctcccaaggagtgcttctccagggacctctctccgggggctccctggaggcacccctcccccattcccaatatcttcgctgaggtttcctcctccccctcctccctgcaggcccaaggcgttggtaagggggcagctgagcaatggaacgcgtttccccctctcattattattttaaaaacagacacccagctgccgaggcaaaaaggagccaggcgctccctctttcttgaagagggtagaagttagggcgccggagcccgggcctggaacgccctcacccccaacctccagtctccgcgttttgcgattttaattttggcgggaggggaagtggattgagaggaaagagagaggccaagacaatttgtaactagaatccgtttttcccttttcctttttttaaacaaacaaacatacaaaaaaaaaaaaaaaa

SEQ ID NO: 53309 - DNA, 2175 bp, Homo sapiens
tgaaatgctggtgcagatttttttcctatcagtctaaccttctgtgttgatgcatgaaggctggtacccacttacagggatgccagatgatcagtgcagaatgaaggtcccaagagagaggatcacatggctctctctgccctgtgacgtcactagcagatggcatgggtaccagctctggcagttggcatcaatgtcactttttagagatcaatgagatagtgcagatatacacagatctagagactccaggagacgatgcgacactcagcctgaaaagatttggaagacccaaaatgaaaactgattattgaatgaaattaaaacctaaggtaatttaagattagagaaccatgttaacactaccgtttgatgagtctgttgtaatgccagaatcccagatgtgcagaaagttttctagagaatgcgaggaccagaagcaaattaagaagccagaaagcttttccaaacagattgtccttcgaggaaagagcatcaaaagggcccctggagaagaaaccgagaaagaagaagaggaggaagacagggaagaggaagatgaaaatgggttgcctagaaggaggggtcttaggaaaaaaaagacaacaaagctgcgattggaaagggtcaagttcaggagacaggaagcgaacgcgcgcgagaggaacaggatgcacggcctcaacgacgctctggacaacttaagaaaagtggtcccctgttattctaaaacccagaaactgtccaaaatagagactttacgactggccaaaaactacatctgggcactttctgaaattctgagaatcggcaagagaccagatctgctcacattcgtccaaaacttatgcaaaggtctttcccagccaactacaaacttggtggcaggctgcttgcagctcaacgccaggagtttcctgatgggtcagggtggggaggctgcacaccacacaaggtcaccctactctaccttctacccaccctaccacagccctgagctcaccactcccccagggcatgggactcttgataattccaagtccatgaaaccctacaattattgcagtgcgtatgaatccttctatgaaagtacttcccctgagtgtgccagccctcagtttgaaggtcccttaagtcctcccccaattaactataatgggatattttccctgaagcaagaagaaaccttggactatggtaaaaattacaattacggcatgcattactgtgcagtgccacccaggggtccccttgggcagggtgccatgttcaggttgcccaccgacagccacttcccttacgacttacatctgcgcagccaatctctcacaatgcaagatgaattaaatgcagtttttcataattaatgaggaaaatgaaaataaacagtggtcattcacctcccctgtctaattaagacaaagcagatgcttgtgggctgagtaattggcacaactctatctaaggtgtttactagtttctgaagtgtgtttcaactattgtgagaattttctatgtaataataaatctcttttcgtatgagaacttcttttcctttccttttgtctgtgaagcactgtgattctgtttctactggaaagatttttttctttttaattttcttttaaacttatttaatttgtttgaacaaggtgtctaagaatatactgttgaataaagacatgcacacagcataattcaatgtctattttggttgtacagtaattataaaatgcatgttattaaaaccagatgagtaaaatgatgtgtttataattattaggaattatatattatgtatcttttaaaaattgaaattttaaaatatggagaatatcactaagctgacaatgatattgggagatgaatttgcaacaatataaaaagctatgcaattttctttttattaaggatgaatctaaatgcattcaattggtaactattcctcttcaagtatttgcagatggggcaacatgatatttgggtagctgatgtcataattcggggacaattatctcaatcatcaagaaaaaaatttcagcacttgttttgtattattcagaaattaactgtacaggtttgttatcacaatgtataattgtgtttttccaccccacatttttaaggcaattaaatatagatatttccactcgtaaaaaaaaaaaaaaaaaaaaa

SEQ ID NO: 53310 - DNA, 3177 bp, Homo sapiens
caggacgaagtttttggctgtgggctctctgggacagagtggagcgcctgtggatttagccggggacacaccatcctgctcgcaggtgcctggacaggacaggggacgagggaggaacactctctgaggaagcccaactcctatgagctcctctctggcagcactcaaaccagtgaagcttgggaaagtcattgacctccagtcgttctgctgagaaacatctggctctatttccatggagaccagggaatctgaagatttggaaaagacccggaggaaatcagcaagtgatcaatggaacactgataatgaaccagccaaggtgaaacctgagttactcccagaaaaagaggagacttctcaagctgaccaggatatccaagacaaagagcctcattgccacatcccaattaagagaaattccatcttcaatcgctccataagacgcaaaagcaaagccaaggccagagacaaccccgaacggaacgccagctgcctggcagattcacaggacaatggaaaatctgtaaatgagcccctgaccttgaatatcccctggagcagaacgcctccttgcagaacagcaatgcagacagacccaggagcccaggaaatgagtgagtcgtcctccaccccgggaaatggggccacgcccgaggagtggccggccctggccgacagccccaccacgctcaccgaggccctgcggatgatccaccccattcccgccgactcctggagaaacctcattgaacaaatagggctcctgtatcaggaataccgagataaatcgactctccaagaaatcgaaaccaggaggcaacaggatgcagaaatagaagacaataccaatgggtccccggccagtgaggacaccccggaggaggaagaagaagaggaggaggaggaggagccggccagcccaccagagaggaagactctgccccagatctgcctgctcagtaacccccactcaaggttcaacctctggcaggatcttcccgagatccggagcagcggggtgcttgagatcctacagcctgaggagattaagctgcaggaggccatgttcgagctggtcacttccgaggcgtcctactacaagagtctgaacctgctcgtgtcccacttcatggagaacgagcggataaggaagatcctgcacccgtccgaggcgcacatcctcttctccaacgtcctggacgtgctggctgtcagtgagcggttcctcctggagctggagcaccggatggaggagaacatcgtcatctctgacgtgtgtgacatcgtgtaccgttatgcggctgaccacttctctgtctacatcacctacgtcagcaatcagacctaccaggagcggacctataagcagctgctccaggagaaggcagctttccgggagctgatcgcgcagctagagctcgaccccaagtgcagggggctgcccttctcctccttcctcatcctgcctttccagaggatcacacgcctcaagctgttggtccagaacatcctgaagagggtagaagagaggtctgagcgggagtgcactgctttggatgctcacaaggagctggaaatggtggtgaaggcatgcaacgagggcgtcaggaaaatgagccgcacggaacagatgatcagcattcagaagaagatggagttcaagatcaagtcggtgcccatcatctcccactcccgctggctgctgaagcagggtgagctgcagcagatgtcaggccccaagacctcccggaccctgaggaccaagaagctcttccacgaaatttacctcttcctgttcaacgacctgctggtgatctgccggcagattccaggagacaagtaccaggtatttgactcagctccgcggggactgctgcgtgtggaggagctggaggaccagggccagacgctggccaacgtgttcatcctgcggctgctggagaacgcagatgaccgggaggccacctacatgctaaaggcgtcctctcagagtgagatgaagcgttggatgacctcactggcccccaacaggaggaccaagtttgtttcgttcacatcccggctgctggactgcccccaggtccagtgcgtgcacccatacgtggctcagcagccagacgagctgacgctggagctcgccgacatcctcaacatcctggacaagactgacgacgggtggatctttggcgagcgtctgcacgaccaggagagaggctggttccccagctccatgactgaggagatcttgaatcccaagatccggtcccagaacctcaaggaatgtttccgtgtccacaagatggatgaccctcagcgcagccagaacaaggaccgcaggaagctgggcagccggaatcggcaatgacccccacccagggggccagcgggagcagggcctgcatgagaccccgacagaaggtggggggggggcctctgggaagcacaggccagcacctccccaggtggcaggatctggcttggggtgcccggccctcatccctgcccacgcagtgagtgctcatgtgtcttggccccttgcttgcaaactggataaagggtgcccaagcctctcctgatgcatttgtaaacaagaaggtttcagcagtattacaccacctccctcatgcctccgagggggtggaagggggtgggcacactccagggccccccatgcccctggcccccagggactggaagaggctcccaacccagagtgtccctgtgggaggcaggcagaaggtgacaattgacacgatttcctgcacgcgtcctcctctaccttggaagcagttagaatctaccaggcacagatgaggccgcccttgcctgacggagcttgatgagcagcccttggtctccggttccaggactgagagcccagctgcctctgcccacccttccccaggcctctgccagcctctggctgcacggtcaggccctgccccatggcaggcctgccagagcttggctggggacccctcccgcctctggctccctgatgggctggatgtaacttgtgtcttctagccgcttaaggagcccaggtgttttaaggaatgaattggtcactgcatcttgtatcgattatggttctgagaaaagcaaatatcacttttggctgcattaaaagaagcatcatatataaaataaaaaaaaaaaaaaaaaaaaaaaaaa

SEQ ID NO: 53311 - DNA, 834 bp, Homo sapiens
atggacactaaccgcccgggcgcgttcgtgctgagcagtgccccgctggccgcgctgcacaacatggccgagatgaagacgtcgctgttcccctacgcgctgcagggtccggccggcttcaaggcgcccgcgctggggggcctgggcgcgcagctcccgctcgggaccccgcacggcatcagcgacatcctgggccggcccgtgggcgcggcgggcgggggcctcctgggggggctgccccggctcaacgggctcgcgtcgtccgccggcgtttacttcgggcccgcggccgctgtggcgcgcggctaccccaagcccctggccgagctgccggggcgcccgcccatcttctggcccggcgtggtgcagggcgcgccctggagggacccgcgtctggctggcccggccccggccggcggcgtcctggacaaggacgggaagaagaagcactcgcgcccgaccttctcgggccagcagatcttcgcgctggagaaaaccttcgagcagaccaagtacctggcgggcccggagcgcgcgcgtctcgcctactcgctgggcatgaccgagagccaggtgaaggtctggttccagaaccgccggaccaagtggcgcaagcggcacgcggcggagatggcgtcggccaagaagaagcaggactcggacgccgagaagctgaaggtgggcggctcggacgcggaggacgacgacgaatacaaccggcccctggaccccaactcggacgacgagaagatcacgcggctgctcaagaagcacaaaccctcgaacttggcgctggtcagcccgtgcggcggcggcgcgggggacgccttgtga

SEQ ID NO: 53312 - DNA, 2891 bp, Homo sapiens
ttcgtcccgggcggtgcgttccactgctctggggccggcgccgcgcccagtcccgcttcgggccgcaagccccaccgctcccctccccgggcaggggcgccgcgcagcccgctcccgccgccacctcctcccctgccgccctcctagccggcaggaattgcgcgaccacagcgccgctcgcgtcgcccgcatcagctcagcccgctgccgctcggccctcggcaccgctccgggtccggccgccgcgcggccagggctccccctgcccagcgctcccaggccccgccacgcgtcgccgcgcccagctccagtctcccctccccggggtctcgccagccccttcctgcagccgccgcctccgaaggagcgggtccgccgcgggtaaccatgcctagcaaaaccaagtacaaccttgtggacgatgggcacgacctgcggatccccttgcacaacgaggacgccttccagcacggcatctgctttgaggccaagtacgtaggaagcctggacgtgccaaggcccaacagcagggtggagatcgtggctgccatgcgccggatacggtatgagtttaaagccaagaacatcaagaagaagaaagtgagcattatggtttcagtggatggagtgaaagtgattctgaagaagaagaaaaagcttcttttattgcagaaaaaggaatggacgtgggatgagagcaagatgctggtgatgcaggaccccatctacaggatcttctatgtctctcatgattcccaagacttgaagatcttcagctatatcgctcgagatggtgccagcaatatcttcaggtgtaacgtctttaaatccaagaagaagagccaagctatgagaatcgttcggacggtggggcaggcctttgaggtctgccacaagctgagcctgcagcacacgcagcagaatgcagatggccaggaagatggagagagcgagaggaacagcaacagctcaggagacccaggccgccagctcactggagccgagagggcctccacggccactgcagaggagactgacatcgatgcggtggaggtcccacttccagggaatgatgtcctggaattcagccgaggtgtgactgatctagatgctgtagggaaggaaggaggctctcacacaggctccaaggtttcgcacccccaggagcccatgctgacagcctcacccaggatgctgctcccttcttcttcctcgaagcctccaggcctgggcacagagacaccgctgtccactcaccaccagatgcagctcctccagcagctcctccagcagcagcagcagcagacacaagtggctgtggcccaggtacacttgctgaaggaccagttggctgctgaggctgcggcgcggctggaggcccaggctcgcgtgcatcagcttttgctgcagaacaaggacatgctccagcacatctccctgctggtcaagcaggtgcaagagctggaactgaagctgtcaggacagaacgccatgggctcccaggacagcttgctggagatcaccttccgctccggagccctgcccgtgctctgtgaccccacgacccctaagccagaggacctgcattcgccgccgctgggcgcgggcttggctgactttgcccaccctgcgggcagccccttaggtaggcgcgactgcttggtgaagctggagtgctttcgctttcttccgcccgaggacaccccgcccccagcgcagggcgaggcgctcctgggcggtctggagctcatcaagttccgagagtcaggcatcgcctcggagtacgagtccaacacggacgagagcgaggagcgcgactcgtggtcccaggaggagctgccgcgcctgctgaatgtcctgcagaggcaggaactgggcgacggcctggatgatgagatcgccgtgtaggtgccgagggcgaggagatggaggcggcggcgtggctggaggggccgtgtctggctgctgcccgggtaggggatgcccagtgaatgtgcactgccgaggagaatgccagccagggcccgggagagtgtgaggtttcaggaaagtattgagattctgctttggagggtaaagtggggaagaaatcggattcccagaggtgaatcagctcctctcctacttgtgactagagggtggtggaggtaaggccttccagagcccatggcttcaggagagggtctctctccaggactgccaggctgctggaggacctgcccctacctgctgcatcgtcaggctcccacgctttgtccgtgatgcccccctaccccctcactctccccgtctccatggtcccgaccaggaagggaagccatcggtaccttctcaggtactttgtttctggatatcacgatgctgcgagttgcctaaccctccccctacctttatgagaggaattccttctccaggcccttgctgagattgtagagattgagtgctctggaccgcaaaagccaggctagtccttgtagggtgagcatggaattggaatgtgtcacagtggataagcttttagaggaactgaatccaaacattttctccagccggacattgaatgttgctacaaagggagccttgaagctttaacatggttcaggcccttggtgtgagagcccagggggaggacagcttgtctgctgctccaaatcacttagatctgattcctgttttgaaagtcctgccctgccttcctcctgcctgtagcccagcccatctaaatggaagctgggaattgcccctcacctcccctgtgtcctgtccagctgaagcttttgcagcactttacctctctgaaagccccagaggaccagagcccccagccttacctctcaacctgtcccctccactgggcagtggtggtcagtttttactgcaaaaaaaaaaaa

SEQ ID NO: 53313 - DNA, 5814 bp, Homo sapiens
cggccgcggcgacagctccagctccggctccggctccggctccggctccggctcccgcgcctgccccgctcggcccagcgcgcccgggctccgcgccccgaccccgccgccgcgcctgccgggggcctcgggcgcccccgccgcccgcctcacgctgaagttcctggccgtgctgctggccgcgggcatgctggcgttcctcggtgccgtcatctgcatcatcgccagcgtgcccctggcggccagcccggcgcgggcgctgcccggcggcgccgacaatgcttcggtcgcctcgggcgccgccgcgtccccgggcccgcagcggagcctgagcgcgctgcacggcgcgggcggttcagccgggccccccgcgctgcccggggcacccgcggccagcgcgcacccgctgccgcccgggcccctgttcagccgcttcctgtgcacgccgctggctgctgcctgcccgtcgggggcccagcagggggacgcggcgggcgctgcgccgggcgagcgcgaagagctgctgctgctgcagagcacggccgagcagctgcgccagacggcgctgcagcaggaggcgcgcatccgcgccgaccaggacaccatccgtgagctcaccggcaagctgggccgctgcgagagcggcctgccgcgcggcctccagggcgccgggccccgccgcgacaccatggccgacgggccctgggactcgcctgcgctcattctggagctggaggacgccgtgcgcgccctgcgggaccgcatcgaccgcctggagcaggagcttccagcccgtgtgaacctctcagctgccccagccccagtctctgctgtgcccaccggcctacactccaagatggaccagctggaggggcagctgctggcccaggtgctggcactggagaaggagcgtgtggccctcagccacagcagccgccggcagaggcaggaagtggaaaaggagttggacgtcctgcagggtcgtgtggctgagctggagcacgggtcctcagcctacagtcctccagatgccttcaagatcagcatccccatccgtaacaactacatgtacgcccgcgtgcggaaggctctgcccgagctctacgcattcaccgcctgcatgtggctgcggtccaggtccagcggcaccggccagggcacccccttctcctactcagtgcccgggcaggccaacgagattgtactgctagaggcgggccatgagcccatggagctgctgatcaacgacaaggtggcccagctgcccctgagcctgaaggacaatggctggcaccacatctgcatcgcctggaccacaagggatggcctatggtctgcctaccaggacggggagctgcagggctccggtgagaacctggctgcctggcaccccatcaagcctcatgggatccttatcttgggccaggagcaggataccctgggtggccggtttgatgccacccaggcctttgtcggtgacattgcccagtttaacctgtgggaccacgccctgacaccagcccaggtcctgggcattgccaactgcactgcgccactgctgggcaacgtccttccctgggaagacaagttggtggaggcctttgggggtgcaacaaaggctgccttcgatgtctgcaaggggagggccaaggcatgaggggccacctcatccagggcccctcccttgcctgccactttggggacttgaggggggtcatattccctcctcagcctgcccacgcactggccttccctcctgccccactcctggctgtgcctcccatttcccctcacctgtacccacacctccagaatgccctgccctgcgagtgtgtcccctgtccccacctgagtggggaggagcgtctcaagtgaacagtgggagcctgcccacctggcactgcactggagttgtctcttaccccaccctccctgcccatcaactgtatctgatttcactaattttgacagcacccccagtagggtaggattgtgtatgagggggaccccactatctcagtggtgggggtggccgcccgcccccttgtcccccatgcaacaggcccagtggcttccccttcagggccacaacaggctgtagaaggggatgacgaggacatcagaggttagacttaccctcctccctctttccaccagctgccagtcaagggcagtgggatctcgatggagcctccccccccccccacccatgcctccctcttcctcctctttcctcctctctttgtgtgtagcggtttgaatgttggttccatgcctggcccagccccacctcagtctccaggacattcctttcccagctccagcctggagggaaggggacaaagaccccaggaggccaaagggctgcagtcaccccttgtgctcacccatagtgatggccactggtatagtcatcgctctccctccatgccaaggacaggacttggaccgcttcagcctgggctgggagcagccctaaggtagaggcctcatggcccaggagaccccacctctggcagagccacattacctaccctgtgcatggtcctggggcagcaaggaagaagctcagagggtggggagaagcatgaagcagtgagcagagcactgggtgagagggagaagaccttggttcctagccagccctgctaatgtgctgtgtggccttctgtaagtccctgccctctctgggcctggccttcctcattcgtgagctgaggccctcgctttggtcatttgctctccagattgggtgtgagcttctctgtgattccaggtggatatgtggggaaagctctggtgaccctgggcttcgcaggggtagatcccaggactcggcagtggatgggatgcagccagtcatgggttagggtcagcagagactcagagtccagggcaaggttcaaggcagactaacctcatgcatggattgtaaaaaaccagctccctttggatcaacccagcctggcacccttgcctgtctgagagtgtctcaaagggctgatggcttcctggtccccttgagtcatcaccagcttccccaagagagtgtcagaatcttaagagctgagaggccgggcacggtggctcacgcctgtaatcccagcactttgggaggctgagacaggcagatcacttgaggtcaggagttcgaagtcagcctggccaacgtggtgaaaccccatcttcactaaaaatacaaaacttagctggttaggtggtgcatgcctgtagtcccagctactcgggaggccgaggcagaagaatctcttgaactgaggaggtggaggttgcagtgagccgagatcacgccattgcactccagcctgggcaacagagcaagactccatctcaaaaaaataataataatcttaaagatgagaaaagccaccccatctggcaccacagctgcatcttgcttgtgagaaatggggaagagttcagggaggacacgtgacctgcacaggatcacagagcatggggcagagccaggactagagctcagggcatctgactccctcttcagtgttcttccccctccatgttgcctgcccctgaagacctttgagttcagtctacacctaagcaggtagacatccgcgaggtcagatgctttccaacatgacacctgaacatcttcctttatgcaacacccaaacatcttggcatccccaccccaggaagtgcggggaggaggttatgatccctgggcgcttcggcagaatggagagctgaggtgtccctcccctgctagtcacctaccaggtgtctgagcagctgcatgctccctggctcaagtgggcactgtaccttttgcctgcctttttgttccctatctccactccctgaggccacttagcctgagacatgatgcaagagctgcaggccggggggctcagtgccatggaagctactccaagttgcattgcctcccgcgcccagatcctgctttccatttcgagaacataaatagattgcccagcccctccagtacaatcccactggaagaaaaggcaatggcgggcttcagccagacctgctgagacctaggttgccacggtaacagccaaagacatcaacccaagtgctgggtcaagtgtctcatcatactggcactgttgctggggtgacggcagaattcagaacttcaatttcagtgacgccaagcttgatgtgtttctgttattgttttgaagaaggtagctcttgtggaggacttgggagaaggatggggtcttaggaaggaggtgacagcacttgcatggtcacttgagcccacacacacgctcaaccccaagtcctttatgctttgtcacagtgaagatgagacctctgacgtccaagccttgttcctgtgctgcatcacccactcagccttccaaagggaacaggaacaaatttccccagcaccactgtttgggtcccgcttttcctatcttctgctgcccctgagcacatccaagcagacagggaaagaggagtcagacatggcccagtcacatcctgagctgctcctggctgataaccacgatggagcccgtgtttgtcctgccatctggcactgcactgagtgtggcacaggcaccgtcctgttgatctcacaacacagttctaagttaggacgttcttggctccgttagacaggtgaggaaactggggcacagagaggtgatgtcatctgcctggtgtcaatcagctagcaagtgatggagcccagatttcaaaccaaagggggttacgtccaggggctgagttcccactcacctgtgtagagtgccatctgggcaccattgctccagacgtgttccgacccctttcccagcccacagggcttgaagtgaaggaacagaggcagggggtgggccagccccagggccagggtccccttggtgaagccgtgccagggggctcagctgcttcagggaatgtgtccctcccaccatgggccagagcttcagcccttctttagctcagctagagttcacaggagagccaaaaaagaaaaggaagctgagcatctcccgagtcctgggcagggaaggggagggaaattgctgcttctccaactcttgcttggggccaagccctgcaccagttgcttcccagctgttatctgccagatcttcccatcttgtggcatgtggtgcccccaccaacatcccaaggggaccaatccccttgccaccactttgcatcacctgggaccacagatttggacaggaagggctctgagaagaggccaaagccctcattttacagatgaggaagctgaagcccggggaggggagcgaccctcaaggccacccagctggacacgggagacttgagcccagccttctgactgcattcagccctctctaggacgcagcagcctctccccagcactgagtcccccctcctttgtgtgtcccagcacccttggcctgagtaaacttggaaaggggctccctcccagagaagggactactctcttcacccctttattccagctgcctgccaccccagacccccacctcccaccctgacccccgacccctgggtggggaaggggctcacatgggcccaggctgagtgtgagtgagcatgtcaagttgtctgacactgtgacattagtgcaccctactgacaacccctccccagccttgcccctttctcctctccctgttttgtacataaattgacatgagctgcaacatgtgtgcgtgtgtgtgcgtgtgtgtgtgtgtgtatgtgtgtgtgatctgtgtcatggttttgttacctttttgtttttgtaaacttgaatgttcaaaataaacatgctgtttactctga

SEQ ID NO: 53314 - DNA, 5811 bp, Homo sapiens
cggccgcggcgacagctccagctccggctccggctccggctccggctccggctcccgcgcctgccccgctcggcccagcgcgcccgggctccgcgccccgaccccgccgccgcgcctgccgggggcctcgggcgcccccgccgcccgcctcacgctgaagttcctggccgtgctgctggccgcgggcatgctggcgttcctcggtgccgtcatctgcatcatcgccagcgtgcccctggcggccagcccggcgcgggcgctgcccggcggcgccgacaatgcttcggtcgcctcgggcgccgccgcgtccccgggcccgcagcggagcctgagcgcgctgcacggcgcgggcggttcagccgggccccccgcgctgcccggggcacccgcggccagcgcgcacccgctgccgcccgggcccctgttcagccgcttcctgtgcacgccgctggctgctgcctgcccgtcgggggcccagcagggggacgcggcgggcgctgcgccgggcgagcgcgaagagctgctgctgctgcagagcacggccgagcagctgcgccagacggcgctgcagcaggaggcgcgcatccgcgccgaccaggacaccatccgtgagctcaccggcaagctgggccgctgcgagagcggcctgccgcgcggcctccagggcgccgggccccgccgcgacaccatggccgacgggccctgggactcgcctgcgctcattctggagctggaggacgccgtgcgcgccctgcgggaccgcatcgaccgcctggaggagcttccagcccgtgtgaacctctcagctgccccagccccagtctctgctgtgcccaccggcctacactccaagatggaccagctggaggggcagctgctggcccaggtgctggcactggagaaggagcgtgtggccctcagccacagcagccgccggcagaggcaggaagtggaaaaggagttggacgtcctgcagggtcgtgtggctgagctggagcacgggtcctcagcctacagtcctccagatgccttcaagatcagcatccccatccgtaacaactacatgtacgcccgcgtgcggaaggctctgcccgagctctacgcattcaccgcctgcatgtggctgcggtccaggtccagcggcaccggccagggcacccccttctcctactcagtgcccgggcaggccaacgagattgtactgctagaggcgggccatgagcccatggagctgctgatcaacgacaaggtggcccagctgcccctgagcctgaaggacaatggctggcaccacatctgcatcgcctggaccacaagggatggcctatggtctgcctaccaggacggggagctgcagggctccggtgagaacctggctgcctggcaccccatcaagcctcatgggatccttatcttgggccaggagcaggataccctgggtggccggtttgatgccacccaggcctttgtcggtgacattgcccagtttaacctgtgggaccacgccctgacaccagcccaggtcctgggcattgccaactgcactgcgccactgctgggcaacgtccttccctgggaagacaagttggtggaggcctttgggggtgcaacaaaggctgccttcgatgtctgcaaggggagggccaaggcatgaggggccacctcatccagggcccctcccttgcctgccactttggggacttgaggggggtcatattccctcctcagcctgcccacgcactggccttccctcctgccccactcctggctgtgcctcccatttcccctcacctgtacccacacctccagaatgccctgccctgcgagtgtgtcccctgtccccacctgagtggggaggagcgtctcaagtgaacagtgggagcctgcccacctggcactgcactggagttgtctcttaccccaccctccctgcccatcaactgtatctgatttcactaattttgacagcacccccagtagggtaggattgtgtatgagggggaccccactatctcagtggtgggggtggccgcccgcccccttgtcccccatgcaacaggcccagtggcttccccttcagggccacaacaggctgtagaaggggatgacgaggacatcagaggttagacttaccctcctccctctttccaccagctgccagtcaagggcagtgggatctcgatggagcctccccccccccccacccatgcctccctcttcctcctctttcctcctctctttgtgtgtagcggtttgaatgttggttccatgcctggcccagccccacctcagtctccaggacattcctttcccagctccagcctggagggaaggggacaaagaccccaggaggccaaagggctgcagtcaccccttgtgctcacccatagtgatggccactggtatagtcatcgctctccctccatgccaaggacaggacttggaccgcttcagcctgggctgggagcagccctaaggtagaggcctcatggcccaggagaccccacctctggcagagccacattacctaccctgtgcatggtcctggggcagcaaggaagaagctcagagggtggggagaagcatgaagcagtgagcagagcactgggtgagagggagaagaccttggttcctagccagccctgctaatgtgctgtgtggccttctgtaagtccctgccctctctgggcctggccttcctcattcgtgagctgaggccctcgctttggtcatttgctctccagattgggtgtgagcttctctgtgattccaggtggatatgtggggaaagctctggtgaccctgggcttcgcaggggtagatcccaggactcggcagtggatgggatgcagccagtcatgggttagggtcagcagagactcagagtccagggcaaggttcaaggcagactaacctcatgcatggattgtaaaaaaccagctccctttggatcaacccagcctggcacccttgcctgtctgagagtgtctcaaagggctgatggcttcctggtccccttgagtcatcaccagcttccccaagagagtgtcagaatcttaagagctgagaggccgggcacggtggctcacgcctgtaatcccagcactttgggaggctgagacaggcagatcacttgaggtcaggagttcgaagtcagcctggccaacgtggtgaaaccccatcttcactaaaaatacaaaacttagctggttaggtggtgcatgcctgtagtcccagctactcgggaggccgaggcagaagaatctcttgaactgaggaggtggaggttgcagtgagccgagatcacgccattgcactccagcctgggcaacagagcaagactccatctcaaaaaaataataataatcttaaagatgagaaaagccaccccatctggcaccacagctgcatcttgcttgtgagaaatggggaagagttcagggaggacacgtgacctgcacaggatcacagagcatggggcagagccaggactagagctcagggcatctgactccctcttcagtgttcttccccctccatgttgcctgcccctgaagacctttgagttcagtctacacctaagcaggtagacatccgcgaggtcagatgctttccaacatgacacctgaacatcttcctttatgcaacacccaaacatcttggcatccccaccccaggaagtgcggggaggaggttatgatccctgggcgcttcggcagaatggagagctgaggtgtccctcccctgctagtcacctaccaggtgtctgagcagctgcatgctccctggctcaagtgggcactgtaccttttgcctgcctttttgttccctatctccactccctgaggccacttagcctgagacatgatgcaagagctgcaggccggggggctcagtgccatggaagctactccaagttgcattgcctcccgcgcccagatcctgctttccatttcgagaacataaatagattgcccagcccctccagtacaatcccactggaagaaaaggcaatggcgggcttcagccagacctgctgagacctaggttgccacggtaacagccaaagacatcaacccaagtgctgggtcaagtgtctcatcatactggcactgttgctggggtgacggcagaattcagaacttcaatttcagtgacgccaagcttgatgtgtttctgttattgttttgaagaaggtagctcttgtggaggacttgggagaaggatggggtcttaggaaggaggtgacagcacttgcatggtcacttgagcccacacacacgctcaaccccaagtcctttatgctttgtcacagtgaagatgagacctctgacgtccaagccttgttcctgtgctgcatcacccactcagccttccaaagggaacaggaacaaatttccccagcaccactgtttgggtcccgcttttcctatcttctgctgcccctgagcacatccaagcagacagggaaagaggagtcagacatggcccagtcacatcctgagctgctcctggctgataaccacgatggagcccgtgtttgtcctgccatctggcactgcactgagtgtggcacaggcaccgtcctgttgatctcacaacacagttctaagttaggacgttcttggctccgttagacaggtgaggaaactggggcacagagaggtgatgtcatctgcctggtgtcaatcagctagcaagtgatggagcccagatttcaaaccaaagggggttacgtccaggggctgagttcccactcacctgtgtagagtgccatctgggcaccattgctccagacgtgttccgacccctttcccagcccacagggcttgaagtgaaggaacagaggcagggggtgggccagccccagggccagggtccccttggtgaagccgtgccagggggctcagctgcttcagggaatgtgtccctcccaccatgggccagagcttcagcccttctttagctcagctagagttcacaggagagccaaaaaagaaaaggaagctgagcatctcccgagtcctgggcagggaaggggagggaaattgctgcttctccaactcttgcttggggccaagccctgcaccagttgcttcccagctgttatctgccagatcttcccatcttgtggcatgtggtgcccccaccaacatcccaaggggaccaatccccttgccaccactttgcatcacctgggaccacagatttggacaggaagggctctgagaagaggccaaagccctcattttacagatgaggaagctgaagcccggggaggggagcgaccctcaaggccacccagctggacacgggagacttgagcccagccttctgactgcattcagccctctctaggacgcagcagcctctccccagcactgagtcccccctcctttgtgtgtcccagcacccttggcctgagtaaacttggaaaggggctccctcccagagaagggactactctcttcacccctttattccagctgcctgccaccccagacccccacctcccaccctgacccccgacccctgggtggggaaggggctcacatgggcccaggctgagtgtgagtgagcatgtcaagttgtctgacactgtgacattagtgcaccctactgacaacccctccccagccttgcccctttctcctctccctgttttgtacataaattgacatgagctgcaacatgtgtgcgtgtgtgtgcgtgtgtgtgtgtgtgtatgtgtgtgtgatctgtgtcatggttttgttacctttttgtttttgtaaacttgaatgttcaaaataaacatgctgtttactctga

SEQ ID NO: 53315 - DNA, 3747 bp, Homo sapiens
gaattcggccgctgagagaccctggacactgttcctgctccctcgccaccaaaacttctcctccagtcccctcccctgcaggaccatcgcccgcagcctctgcacctgttttcttgtgtttaagggtggggtttgcccccctccccacgctcccatctctgatcctcccaccttcacccgcccaccccgcgagtgagtgcggtgcccaggcgcgcttggcctgagaggtcggcagcagacccggcagcgccaaccgcccagccgctctgactgctccggctgcccgcccgcgcggcgcgggctgtcctggaccctaggaggggacggaaccggacttgcctttgggcaccttccagggccctctccaggtcggctggctaatcatcggacagacggactgcacacatcttgtttccgcgtctccgcaaaaacgcgaggtccaggtcagttgtagactcttgtgctggttgcaggccaagtggacctgtactgaaaatgggtccaataggtgcagaggctgatgagaaccagacagtggaagaaatgaaggtggaacaatacgggccacaaacaactcctagaggtgaactggtccctgaccctgagccagagcttatagatagtaccaagctgattgaggtacaagttgttctcatattggcctactgctccatcatcttgcttggggtaattggcaactccttggtgatccatgtggtgatcaaattcaagagcatgcgcacagtaaccaactttttcattgccaatctggctgtggcagatcttttggtgaacactctgtgtctaccgttcactcttacctataccttaatgggggagtggaaaatgggtcctgtcctgtgccacctggtgccctatgcccagggcctggcagtacaagtatccacaatcaccttgacagtaattgccctggaccggcacaggtgcatcgtctaccacctagagagcaagatctccaagcgaatcagcttcctgattattggcttggcctggggcatcagtgccctgctggcaagtcccctggccatcttccgggagtattcgctgattgagatcattccggactttgagattgtggcctgtactgaaaagtggcctggcgaggagaagagcatctatggcactgtctatagtctttcttccttgttgatcttgtatgttttgcctctgggcattatatcattttcctacactcgcatttggagtaaattgaagaaccatgtcagtcctggagctgcaaatgaccactaccatcagcgaaggcaaaaaaccaccaaaatgctggtgtgtgtggtggtggtgtttgcggtcagctggctgcctctccatgccttccagcttgccgttgacattgacagccaggtcctggacctgaaggagtacaaactcatcttcacagtgttccacattatcgccatgtgctccacttttgccaatccccttctctatggctggatgaacagcaactacagaaaggctttcctctcggccttccgctgtgagcagcggttggatgccattcactctgaggtgtccgtgacattcaaggctaaaaagaacctggaggtcagaaagaacagtggccccaatgactctttcacagaggctaccaatgtctaaggaagctgtggtgtgaaaatgtatggatgaattctgaccagagctatgaatctggttgatggcggctcacaagtgaaaactgatttcccattttaaagaagaagtggatctaaatggaagcatctgctgtttaattcctggaaaactggctgggcagagcctgtgtgaaaatactggaattcaaagataaggcaacaaaatggtttacttaacagttggttgggtagtaggttgcattatgagtaaaagcagagagaagtacttttgattattttcctggagtgaagaaaacttgaacaagaaattggtattatcaaagcattgctgagagacggtgggaaaataagttgactttcaaatcacgttaggacctggattgaggaggtgtgcagttcgctgctccctgcttggcttatgaaaacaccactgaacagaaatttctccagggagccacaggctctccttcatcgcattttgatttttttgttcattctctagacaaaatccatcagggaatgctgcaggaaacgattgccaactatacgaatggcttcgaggagataaactgaaatttgctatataattaatattttggcagatgataggggaactcctcaacactcagtgggccaattgttcttaaaaccaattgcacgtttggtgaaagtttcttcaactctgaatcaaaagctgaaattctcagaattacaggaaatgcaaaccatcatttaatttctaatttcaagttacatccgctttatggagatactatttagataacaagaatacaacttgatacttttattgttatacctttttgaacatgtatgatttctgttgttattcctattggagctaagtttgtctacactaaaatttaaatcagactagagaataatttttgtggcatgttgtaacatttcacagtatttacaagctatttttgcacaggtacatagctctcatgtatttaaagaacactgcagtgttattttctttgaaattcatcctccacggacccattcatactaaataaaacaatgtaattacattaaaatggacctatctgtaagaggtactaaaaacactggattcatttcatcttgcaaatgttgtatttcaaaccagtttcacataagttatttgtcttcttttcaaaataattagctatatttttatataatatgaatatatacataaaaattgtttctataaattgtagaacatagatgctacagtattttttatttaattatattatgaataaaattgttatttcaatagtacccaaccaaagatgcttaaaaaccttctatgttcataaaaaataacaactgagatgttaaaatagtcatacgtctttagatgctattaaagtttcattagtcatatttttgtaaatatgacagaatttgtgaatatatttttaaagcaaaaaacttcaacatgcatatgatatatagttacaacattaattttatgaactggagagctttactttgtggatatatttaaaattcatattatagctcctattaaattccttccatgatagatataaaggactggtttttaagtgcactgcacttctggaatactgaaaaagaatgaaaacaatatgttagattaggtgtaagactttaagaagcgaacaaaaagtaatgtatatctgtaatatataatcaaatgattcatttttctgttagactaggcaaattgttcaaaaataacctttttgtcttttaagtagcagtcactttgcttaagatgctaatagaaaactgtggttaaagatttaccctccctcttggtgaattattacactgtaagaaatgtatatgctactgtgttacatgttgtattagtaaattattagaatccaattaatgattcaattaacatatatcttatccaattcattatgtcaattcattaataaaataccttttatgtagaggctttatgttgcaattaaaaagttgggaaaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 53316 - DNA, 2821 bp, Homo sapiens
gaaaccgtttctacatggctggctctaagccagatgatatttcatagtgcaaagagggatagaacctcactggtggccaaatgtgattatatgctataaccctgtgcccctactctgacacccacccccaagcagttaccctctgttggaagcctgcagctttctttgtttgtttctttaattatacagacagtaggatctgcatccttactagcatatagaaaaatcagagaaacaatgcaaccaagagtgctgttttcatttgtttcttctgcatccttttaatggaattttgtaggtctcttgaaagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagaatgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacattcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgacttttaa

SEQ ID NO: 53317 - DNA, 8696 bp, Homo sapiens
aagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaagagctgaaccaagcacggtttccatttcaaaaagggagacagcctctaccgcgattgtagaagagactgtggtgtgaattagggaccgggaggcgtcgaacggaggaacggttcatcttagagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaagatttctcatggtttggatttgggaaagtaaaatcaagacaaggtgttggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatggcccagaggttcccccaagaccgcctgataataatttggtatttggaggctcctgtgtcactgcaggaactaaaggaggctaaatccatgcctgatggaggagaagagttctatggttatctgcaaattctggccagacaacatcttgacgtcactccttagcttccataacctagccaagcaagaagttgcctttccaagacaaagcagtgtgctctaatgactaacccctcaaagtactatgccactttaactatagacccatctcctcgatcaatcaggatggcaagatggagctgaggagctcagcaacatcaagtctggagttggtctttaactcaactagctcgtttagacgtgtctgaacaccacatcacctgacagcacggggtggtttcccagtaaaatttacaaactcagctcaagggcagctgtgttgctttcctttccttgactgctgagaaactttttgacagggaacaatggaaacacaccttctgagctgaaacaaacaaacagaaacaaaacatactaaccagcaaaatccccaaatcatcaatcttgggttctcttgaagggcaggagtgtgttttatcttctcccgtcggagcaaacactatagatgtcctccctaaaattctgtcttccctagagcagccttgtaaattagctagggtcctagggttgaggcctaaatcaacttaaaattgtctctaaatatgtacctggatgtgtttgtacttgcagagcatgccctcttcatgtgcctagggctagtaactccctgtggcagaggcatgtaaagtattctgactttttttttttcaacttaattccatttccaatgaaatggatttttaaaaattttctccagagtgtgccatacttctccagctattatagttaatgtgtgtgtatccttgtgtatatgtgtgtttgtgtgtgcatatgtgttttcctagtggttacatgcttactaggcaattatgtaaataagcacagattcataggccagctaggcctgaggaaagaagacattataaagggagggagtattttaacattagctaaagctatcacacaaggcacccattctgctcccctcaacagccacagcccacttcgtccttgtcttaccaataaggggaaaggctggaggtgatatttttcacagaaccgcagaggttttgaacatatttgcaacattactttgagtacacatgagcaaaaattctgaattacatccaggaccccagaagctcattagatcaaagagtgcggggcccctcagagttaccagagattatctgcagacttcagtgcaatcgaatgaccatggtccattttgatggtcagaggtaggactgaaaaacgggtagaaacaattgctttagcgcttccttctgtactttgcctattaatgttttgtctttcaaaaatatattttctcctaattgtttaattggccaaataatggctgctttgggagttgtttgtatgccttggaaggccatggcctgcactttaaaaataagctaagtccattctgcccagcacgagcattaggacagagaatgcacttattttaggatccttaaaaattgcttcttttatggcacactgggttgacgactcatctcgtgggagccttcatggcacattgctgctgttctgcaggtcccaatacaattccttccccctctcagtgccacggcccccccattgctagctacacaatttgatatcatattcccttttcaactccaaaggagatgataagaagctatcaaataatgctttaaaaaagcaacttgagtttcttaaaagaaaggaaatgaatacatgctgcataattacatttaaaatgtaagccatgttattataagccgcactgagatgaagatttgttagcaaaccagtttcaagcacactcacagtgaagtaaaatcatgtttttagcatctgaccattgggtaatattattctttgttatcaaaagagaaatatcacccaagtatagtatacttagacctcctagaggaaacactccagtcctaagcttggtgtctgaaaagaaaaacaaaaataaagattatggatttaggtcagggagacagagtgatattctgaagactgtgtttactccctcatcatcggccaaccaagatggagttctgcatcctgcacatatcagacatttcagtccaatttcaccaaagcatcagtgatgttctagaagcatcccagcagatggaggatcctaatgtatttgttctgggtatttcccaaggcccagcctgactggagtgtgtgtaccaacaggatgaatccaatcaagctacgcccccattttggtttcggattggccactcttgcatgtgctagtagattgtggaccaggaccagctgagcaaacacagttgcagagtagcctcctatgttgctaagaagctcctgctacccaggtgctttgaacaattgagtgctccctctggttaagtagagatggcaccaccggagtttttcttggatgtgaggctcaatcctttacggcagctattataacaaagtgaaggttttctccctgggaaatgcagcttttctctgtctttactaattctgccagcctgtgagagtaaccaccgtagctgggcttcttctcagattaattgtcatgccaggtctccttcctggggagctgtgatgctgctctgaggttgattgctgaggttgtagtgggtttttgtttgtttttgtttagtttttcttgattgttcttctttctcttgaatggcaagagaagaaacactttctctaacccacggccaggaaggaaatggggagagagctacttcttagttcaacctggttgccacataaaggaatctctctccttggactcagcccctaactggaagcaagagccactgccctctgagactgagagagcagcccgaggaggagatgaatccattctgccctttgtttgggtttgcttcctgtcagtgagagaatgctgaggcagttcctgttatgtgaaactttcatttttaaaaccaggacagtcctaaacagactggaatgagttggtcaatcccagttggtataggcccaatgatttttgctagtaagataggattgtcttcctcacccaaaatgccttcaagtgccctaaaatgggtattttaaaataagaataaataatgtagatttagtagaaaacctggaaaacataagaaacaaagatgaaacgaaaagtcccatgtaattccaccagttagagttaaccactgatatcgtttggatatatggctttctagtcttgtggatatccttttaatctcttgtaatataaagtctgaccatatgtgtccttgcatttgtttgtactggactctgttaatatttctatagtaatggctcactttggggagattgtgctgcacagtgtgtaggaagcacattgggtgtattattcccagttttgtattttgtatttccttggagatgtgcaggggttaagagcgggggtctggccatagctggccacgtcagactctcatatggtaagtatcacagagcacatgaggcctgtgttatgcgctggaaagactcaggaaatgagaggctctcttgttctgacaaggcaggctgagagctctcatttagggtcatcactccagataactccaaatgcagtttattgctcaactgaagcagatgatcactttttgcctccaagttcttcaccctagctagctcctttcaaagagccgagtatgctggatcttaaagggccaaactagttacatctcatacatttcctgatgtttagggatgccttcacttccatcaaggataccttggctgtgcaaggacctctgatagctggagtctccttttggtcactcccagctttgcttaaacttgatggagtttgctgtccagtgatccccggatctttcatcatgaaagccttccttcctctcctgatgtctcaggcctctagacctagactggggttctggcaaggaggcctctatcaatagtatgacatccaataatatgttagtgttgatattttgcacagtaatattaagtttaagagattataaaaatgagttcaaatgaataagttcctgtgatgtaagagattagatatgtgtgatttcagaaccaaagccaggggggaatcccagaaagaaaacaataatataatcctagtttctatatattatttttattcattactgtatatgggtagagatcaatattctttcttatgctgttactattaattaacacattttttaaccatgccattgaacttttgggtgcattaaagtggaacccaagctcctcattagataataatggcatttggactgagtgccatattcctaaatttccaataaagtggttgatatagagaggacaggataaagccctatagtgtgcagttatatcaaaacagctagtctccactttagggaatgcctttactagagattacatgaaatgtctgcttataaaataagcagagatggcaccactaagcagccacctgaattgttttcctacaggaatgattacttttcagatccatttatgttttcatgctcaatacttactccccttccctgcaacacccaaagagtttacttttgcaagtcatttggtcttcagtctactactgaggaatagagaggcactaactgctttacccaggatcagaactcatgttcttaccttctattaatagagtacttgagccagatggactaactggtctcacattttctctatcttggttttacttccataaacatcaatatctttacccacatgatttttccatcctcccatttttttccatatgtattagggttcaggaactatgatgctaatgatcacatttcttcctagttcctaatttcattagtgccatttcctgatatctacagaaacaattatcaatacatgtagctgcttgagccttatttagaaggctagcctttcttttccaagtgctgtcagaatgtatacatttagtctgtctttttcccttttaggagtctttgttctgggttgatggcaaaattcctctttttacatgtgagatttttgatttcactgaattctacctagatttttatggacattggattttaaagaggaaaacactcattttcttagtaagatattggtgatacatagctatgccattgatttccatactcctgagctttggggagggagacagtggccaagtagcaggcagaataagatcatcactcatgtcctgaatcaatcacactttccttctcggattgtgtatatgctctgccacttcctacatattacatcctgagtttttaagtaaagtggatcttagccagatttgagtctaatggctgattcatcggcatagttcttggcgttaacatctcagtgtcctctttagttctctttgaggattcatgtcattgagggcctttgtgcctccacttgtctcagtatgaggaagaactttggtgtgagggcggagctatgtgaagggttgctgggttgggggattagttcatatggtccccatgccatctatttacttttggagagaggggactttgagtgggtgggtatggatagatgttcctcaaggaaaccctgctggctaatgggcactacatctgtgtattactgtgattctctctgtaagctccccatgtggccaaggacccccctcctaccagggcacttcctgccacctcattgcactggtctcaaccattcagcctgctgctgctgcaccatgttgggctgcggtaggatagggaaggggttctgttgattgctaaatgttgcctaactttatttccctctcccacatttcatgcaagggagcggacctaacacatgacttgcattctcttcctatgttcagaaactccagggcttgcccacgtgtatgtatgagtgaccaatggagcttggaattctttatctatatgatctgtccgaaaatgagatcttttgtactggaatttgtgatgtagttgatcattcagagccaaacgcatataccaataaagacaagactgtcatataaaaaaaaaaaaaaaaa

SEQ ID NO: 53318 - DNA, 8648 bp, Homo sapiens
aagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaagagctgaaccaagcacggtttccatttcaaaaagggagacagcctctaccgcgattgtagaagagactgtggtgtgaattagggaccgggaggcgtcgaacggaggaacggttcatcttagagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatggcccagaggttcccccaagaccgcctgataataatttggtatttggaggctcctgtgtcactgcaggaactaaaggaggctaaatccatgcctgatggaggagaagagttctatggttatctgcaaattctggccagacaacatcttgacgtcactccttagcttccataacctagccaagcaagaagttgcctttccaagacaaagcagtgtgctctaatgactaacccctcaaagtactatgccactttaactatagacccatctcctcgatcaatcaggatggcaagatggagctgaggagctcagcaacatcaagtctggagttggtctttaactcaactagctcgtttagacgtgtctgaacaccacatcacctgacagcacggggtggtttcccagtaaaatttacaaactcagctcaagggcagctgtgttgctttcctttccttgactgctgagaaactttttgacagggaacaatggaaacacaccttctgagctgaaacaaacaaacagaaacaaaacatactaaccagcaaaatccccaaatcatcaatcttgggttctcttgaagggcaggagtgtgttttatcttctcccgtcggagcaaacactatagatgtcctccctaaaattctgtcttccctagagcagccttgtaaattagctagggtcctagggttgaggcctaaatcaacttaaaattgtctctaaatatgtacctggatgtgtttgtacttgcagagcatgccctcttcatgtgcctagggctagtaactccctgtggcagaggcatgtaaagtattctgactttttttttttcaacttaattccatttccaatgaaatggatttttaaaaattttctccagagtgtgccatacttctccagctattatagttaatgtgtgtgtatccttgtgtatatgtgtgtttgtgtgtgcatatgtgttttcctagtggttacatgcttactaggcaattatgtaaataagcacagattcataggccagctaggcctgaggaaagaagacattataaagggagggagtattttaacattagctaaagctatcacacaaggcacccattctgctcccctcaacagccacagcccacttcgtccttgtcttaccaataaggggaaaggctggaggtgatatttttcacagaaccgcagaggttttgaacatatttgcaacattactttgagtacacatgagcaaaaattctgaattacatccaggaccccagaagctcattagatcaaagagtgcggggcccctcagagttaccagagattatctgcagacttcagtgcaatcgaatgaccatggtccattttgatggtcagaggtaggactgaaaaacgggtagaaacaattgctttagcgcttccttctgtactttgcctattaatgttttgtctttcaaaaatatattttctcctaattgtttaattggccaaataatggctgctttgggagttgtttgtatgccttggaaggccatggcctgcactttaaaaataagctaagtccattctgcccagcacgagcattaggacagagaatgcacttattttaggatccttaaaaattgcttcttttatggcacactgggttgacgactcatctcgtgggagccttcatggcacattgctgctgttctgcaggtcccaatacaattccttccccctctcagtgccacggcccccccattgctagctacacaatttgatatcatattcccttttcaactccaaaggagatgataagaagctatcaaataatgctttaaaaaagcaacttgagtttcttaaaagaaaggaaatgaatacatgctgcataattacatttaaaatgtaagccatgttattataagccgcactgagatgaagatttgttagcaaaccagtttcaagcacactcacagtgaagtaaaatcatgtttttagcatctgaccattgggtaatattattctttgttatcaaaagagaaatatcacccaagtatagtatacttagacctcctagaggaaacactccagtcctaagcttggtgtctgaaaagaaaaacaaaaataaagattatggatttaggtcagggagacagagtgatattctgaagactgtgtttactccctcatcatcggccaaccaagatggagttctgcatcctgcacatatcagacatttcagtccaatttcaccaaagcatcagtgatgttctagaagcatcccagcagatggaggatcctaatgtatttgttctgggtatttcccaaggcccagcctgactggagtgtgtgtaccaacaggatgaatccaatcaagctacgcccccattttggtttcggattggccactcttgcatgtgctagtagattgtggaccaggaccagctgagcaaacacagttgcagagtagcctcctatgttgctaagaagctcctgctacccaggtgctttgaacaattgagtgctccctctggttaagtagagatggcaccaccggagtttttcttggatgtgaggctcaatcctttacggcagctattataacaaagtgaaggttttctccctgggaaatgcagcttttctctgtctttactaattctgccagcctgtgagagtaaccaccgtagctgggcttcttctcagattaattgtcatgccaggtctccttcctggggagctgtgatgctgctctgaggttgattgctgaggttgtagtgggtttttgtttgtttttgtttagtttttcttgattgttcttctttctcttgaatggcaagagaagaaacactttctctaacccacggccaggaaggaaatggggagagagctacttcttagttcaacctggttgccacataaaggaatctctctccttggactcagcccctaactggaagcaagagccactgccctctgagactgagagagcagcccgaggaggagatgaatccattctgccctttgtttgggtttgcttcctgtcagtgagagaatgctgaggcagttcctgttatgtgaaactttcatttttaaaaccaggacagtcctaaacagactggaatgagttggtcaatcccagttggtataggcccaatgatttttgctagtaagataggattgtcttcctcacccaaaatgccttcaagtgccctaaaatgggtattttaaaataagaataaataatgtagatttagtagaaaacctggaaaacataagaaacaaagatgaaacgaaaagtcccatgtaattccaccagttagagttaaccactgatatcgtttggatatatggctttctagtcttgtggatatccttttaatctcttgtaatataaagtctgaccatatgtgtccttgcatttgtttgtactggactctgttaatatttctatagtaatggctcactttggggagattgtgctgcacagtgtgtaggaagcacattgggtgtattattcccagttttgtattttgtatttccttggagatgtgcaggggttaagagcgggggtctggccatagctggccacgtcagactctcatatggtaagtatcacagagcacatgaggcctgtgttatgcgctggaaagactcaggaaatgagaggctctcttgttctgacaaggcaggctgagagctctcatttagggtcatcactccagataactccaaatgcagtttattgctcaactgaagcagatgatcactttttgcctccaagttcttcaccctagctagctcctttcaaagagccgagtatgctggatcttaaagggccaaactagttacatctcatacatttcctgatgtttagggatgccttcacttccatcaaggataccttggctgtgcaaggacctctgatagctggagtctccttttggtcactcccagctttgcttaaacttgatggagtttgctgtccagtgatccccggatctttcatcatgaaagccttccttcctctcctgatgtctcaggcctctagacctagactggggttctggcaaggaggcctctatcaatagtatgacatccaataatatgttagtgttgatattttgcacagtaatattaagtttaagagattataaaaatgagttcaaatgaataagttcctgtgatgtaagagattagatatgtgtgatttcagaaccaaagccaggggggaatcccagaaagaaaacaataatataatcctagtttctatatattatttttattcattactgtatatgggtagagatcaatattctttcttatgctgttactattaattaacacattttttaaccatgccattgaacttttgggtgcattaaagtggaacccaagctcctcattagataataatggcatttggactgagtgccatattcctaaatttccaataaagtggttgatatagagaggacaggataaagccctatagtgtgcagttatatcaaaacagctagtctccactttagggaatgcctttactagagattacatgaaatgtctgcttataaaataagcagagatggcaccactaagcagccacctgaattgttttcctacaggaatgattacttttcagatccatttatgttttcatgctcaatacttactccccttccctgcaacacccaaagagtttacttttgcaagtcatttggtcttcagtctactactgaggaatagagaggcactaactgctttacccaggatcagaactcatgttcttaccttctattaatagagtacttgagccagatggactaactggtctcacattttctctatcttggttttacttccataaacatcaatatctttacccacatgatttttccatcctcccatttttttccatatgtattagggttcaggaactatgatgctaatgatcacatttcttcctagttcctaatttcattagtgccatttcctgatatctacagaaacaattatcaatacatgtagctgcttgagccttatttagaaggctagcctttcttttccaagtgctgtcagaatgtatacatttagtctgtctttttcccttttaggagtctttgttctgggttgatggcaaaattcctctttttacatgtgagatttttgatttcactgaattctacctagatttttatggacattggattttaaagaggaaaacactcattttcttagtaagatattggtgatacatagctatgccattgatttccatactcctgagctttggggagggagacagtggccaagtagcaggcagaataagatcatcactcatgtcctgaatcaatcacactttccttctcggattgtgtatatgctctgccacttcctacatattacatcctgagtttttaagtaaagtggatcttagccagatttgagtctaatggctgattcatcggcatagttcttggcgttaacatctcagtgtcctctttagttctctttgaggattcatgtcattgagggcctttgtgcctccacttgtctcagtatgaggaagaactttggtgtgagggcggagctatgtgaagggttgctgggttgggggattagttcatatggtccccatgccatctatttacttttggagagaggggactttgagtgggtgggtatggatagatgttcctcaaggaaaccctgctggctaatgggcactacatctgtgtattactgtgattctctctgtaagctccccatgtggccaaggacccccctcctaccagggcacttcctgccacctcattgcactggtctcaaccattcagcctgctgctgctgcaccatgttgggctgcggtaggatagggaaggggttctgttgattgctaaatgttgcctaactttatttccctctcccacatttcatgcaagggagcggacctaacacatgacttgcattctcttcctatgttcagaaactccagggcttgcccacgtgtatgtatgagtgaccaatggagcttggaattctttatctatatgatctgtccgaaaatgagatcttttgtactggaatttgtgatgtagttgatcattcagagccaaacgcatataccaataaagacaagactgtcatataaaaaaaaaaaaaaaaa

SEQ ID NO: 53319 - DNA, 1700 bp, Homo sapiens
cgacgctaacgggctggcactcgcggtcccacgtggctcaggacaccctttcgggggcgtgtctcccagttctagaggttcccagagaagaggaggtgctcactaaccaggcagctcgcccagactccgggcagtgagagggagggagcgccggccgcgggagcgggatggaaaccagcagcccgcggcccccgcggcccagctccaacccggggctgagcctggacgcccggctgggcgtggacactcgcctctgggccaaggtgctgttcaccgcgctctacgcactcatctgggcgctgggcgcggcgggcaatgcgctgtccgtgcacgtggtgctgaaggcgcgggccgggcgcgcggggcgcctgcgccaccacgtgctcagcctggcgctcgcgggcctgctgctgctgctggtcggcgtgccggtggagctctacagcttcgtgtggttccactacccctgggtcttcggcgacctgggctgccgcggctactacttcgtgcacgagctgtgcgcctacgccacggtgctgagcgtggcaggcctgagcgccgagcgctgcctagccgtgtgccagcccctgcgtgcccgcagcctgctgacgccacgccggacccggtggctggtggcgctctcgtgggccgcctcgctcggcctcgccctgcccatggccgtcatcatggggcagaagcacgaactcgagacggcggacggggagccggagcccgcctcgcgagtgtgcacggtgctggtgagccgcaccgcgctccaagtctttatccaggtgaatgtgctggtgtccttcgtgctccccttggcactaactgctttcctgaatggggtcacagtgagccacctgctggccctctgctcccaagtgccgtccacttctaccccgggcagctccacccccagccgcctggagctgctgagtgaggagggtctcctcagcttcatcgtatggaagaagacctttatccagggaggccaggtcagcctggtgagacataaagacgtgcgccggatccgcagcctccagcgcagcgtccaggttctcagagccatcgtggtcatgtatgtcatctgctggctgccgtaccatgcccgcaggctcatgtactgctacgtacctgatgacgcgtggactgacccactgtacaatttctaccactacttctacatggtgaccaacacacttttctacgtcagctcagctgtgactcctcttctctacaacgccgtgtcctcctccttcagaaaactcttcctggaagccgtcagctccctgtgtggagagcaccaccccatgaagcggttacccccgaagccccagagtcccaccctaatggatacagcttcaggctttggggatcccccagaaacccggacctgaatgtaatgcaagaatgaacagaacaagcaaaatgaccagctgcttagtcacctggcaaagcaggtgagcaacctcatcactaatcattcaagcttcgcagccagggcgacttctatcaacccctgctctgctgagaaccatcaagcgcagggaagccacgtgacccctcctagcctcaggctccctcgtctgtgtagtggagataaagaacagcacccatctcttagtgttgcctgagactaaagtgcttagcacagaacctggtgcgtagtagatgctcaataaatttttgctggcacg

SEQ ID NO: 53320 - DNA, 2168 bp, Homo sapiens
ggcgcgcgtgaacgcggtccccgggaccatgctgcggccacagcggcccggagacttgcagctcggggcctccctctacgagctggtgggctacaggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgttgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttggggttctgggtcggttccagcggctttaggcagaaagtgctcgctctcacccagcacatctctctccttgtccctggagttgcgcgcttcgcggggccgatgtagaacttagggcgccttgccgtggttggcgcgccccgggtgcagcgagaggccatccccgagcgctatctccccggagcggagcacgccggctcccagtactaggggctgcgctcgagcagtggcgggggcggaggggtggttcttttccttctcctccgccagaggccacgggcgcccttgttcccgccggccaggtcctatcaaaggaggctgccggaactcaagaggcagaaaaagaccagttaggcggtgcagacggtctgggacgtggcagacggacggaccctcggcggacaggtggtcggcgtcggggtgcggtgggtaggggcgaggacaacgcagggtgcgctgggttgggacgtgggtccacttttgtagaccagctgtttggagagctgtatttaagactcgcgtatccagtgttttgtcgcagagagttttcgctcttaaatcctgggggtttcttagaaagcaacttagaactcgagattcacctttcgtttccctttccccaaaagtagcgtaaccaacatttaagcttgcttaaaaacgaaaaccaaccgccttgcatccagtgttcccgatttactaaaataggtaaccaggcgtctcacagtcgccgtcctgtcaagagcgctaatgaacgttctcattaacacgcaggagtaccgggagccctgaaccgcccgctgctcggcggatcccagctgcggtggcgacggcgggaaggcgctttccgctgttcctcagcgggccgggcccttgaccagcgcggcccgcaggtcttccttctcgccgtcttgcagttgaagagctacatacgtagtcagtttcgatttgttacagacgttaacaaattcctttacccaaggttatgctatgacctttccgcagtttactttgattttctatgtttaaggttttggttgttggtagtagccgaatttaactggcactttattttacttctaaccttgtttcctgacggtgtacagaatcaacaaaataaaacatttaaagtctgattttttaaaaaaaaaaaaaaa

SEQ ID NO: 53321 - DNA, 2505 bp, Homo sapiens
gtgcggatgcttattatagatcgacgcgacaccagcgcccggtgccaggttctcccctgaggcttttcggagcgagctcctcaaatcgcatccagattttcgggtccgagggaaggaggaccctgcgaaagctgcgacgactatcttcccctggggccatggactcggacgccagcctggtgtccagccgcccgtcgtcgccagagcccgatgacctttttctgccggcccggagtaagggcagcagcggcagcgccttcactgggggcaccgtgtcctcgtccaccccgagtgactgcccgccggagctgagcgccgagctgcgcggcgctatgggctctgcgggcgcgcatcctggggacaagctaggaggcagtggcttcaagtcatcctcgtccagcacctcgtcgtctacgtcgtcggcggctgcgtcgtccaccaagaaggacaagaagcaaatgacagagccggagctgcagcagctgcgtctcaagatcaacagccgcgagcgcaagcgcatgcacgacctcaacatcgccatggatggcctccgcgaggtcatgccgtacgcacacggcccttcggtgcgcaagctttccaagatcgccacgctgctgctggcgcgcaactacatcctcatgctcaccaactcgctggaggagatgaagcgactggtgagcgagatctacgggggccaccacgctggcttccacccgtcggcctgcggcggcctggcgcactccgcgcccctgcccgccgccaccgcgcacccggcagcagcagcgcacgccgcacatcaccccgcggtgcaccaccccatcctgccgcccgccgccgcagcggctgctgccgccgctgcagccgcggctgtgtccagcgcctctctgcccggatccgggctgccgtcggtcggctccatccgtccaccgcacggcctactcaagtctccgtctgctgccgcggccgccccgctggggggcgggggcggcggcagtggggcgagcgggggcttccagcactggggcggcatgccctgcccctgcagcatgtgccaggtgccgccgccgcaccaccacgtgtcggctatgggcgccggcagcctgccgcgcctcacctccgacgccaagtgagccgactggcgccggcgcgttctggcgacaggggagccaggggccgcggggaagcgaggactggcctgcgctgggctcgggagctctgtcgcgaggaggggcgcaggaccatggactgggggtggggcatggtggggattccagcatctgcgaacccaagcaatgggggcgcccacagagcagtggggagtgaggggatgttctctccgggacctgatcgagcgctgtctggctttaacctgagctggtccagtagacatcgttttatgaaaaggtaccgctgtgtgcattcctcactagaactcatccgacccccgacccccacctccgggaaaagattctaaaaacttctttccctgagagcgtggcctgacttgcagactcggcttgggcagcacttcggggggggagggggtgttatgggagggggacacattggggccttgctcctcttcctcctttcttggcgggtgggagactccgggtagccgcactgcagaagcaacagcccgaccgcgccctccagggtcgtccctggcccaaggccaggggccacaagttagttggaagccggcgttcggtatcagaagcgctgatggtcatatccaatctcaatatctgggtcaatccacaccctcttagaactgtggccgttcctccctgtctctcgttgatttgggagaatatggttttctaataaatctgtggatgttccttcttcaacagtatgagcaagtttatagacattcagagtagaaccacttgtggattggaataacccaaaactgccgatttcaggggcgggtgcattgtagttattattttaaaatagaaactaccccaccgactcatctttccttctctaagcacaaagtgatttggttattttggtacctgagaacgtaacagaattaaaaggcagttgctgtggaaacagtttgggttatttgggggttctgttggctttttaaaattttcttttttggatgtgtaaatttatcaatgatgaggtaagtgcgcaatgctaagctgtttgctcacgtgactgccagccccatcggagtctaagccggctttcctctattttggtttatttttgccacgtttaacacaaatggtaaactcctccacgtgcttcctgcgttccgtgcaagccgcctcggcgctgcctgcgttgcaaactgggctttgtagcgtctgccgtgtaacacccttcctctgatcgcaccgcccctcgcagagagtgtatcatctgttttatttttgtaaaaacaaagtgctaaataatatttattacttgtttggttgcaaaaacggaataaatgactgagtgttgagattttaaataaaatttaaagcaaaaaaaaaaaaaaaa

SEQ ID NO: 53322 - DNA, 4959 bp, Homo sapiens
agtgggagacgtgcgctgagaggcgggggctgcgctcggcggaacagcagccctcgggcggagagcggggccggggtccgagagcaggtgatgccaagagctgagcgggactcgtgagcgcgcggttcagcacctaccagggcgtcccgtaaaaaacctcgccttcgcctgtctctgggaaccatagcgccgcaggtgccgcctgtcctcgccttcctgctgcaatcgccccaccatggactccccgatccagatcttccgcggggagccgggccctacctgcgccccgagcgcctgcctgccccccaacagcagcgcctggtttcccggctgggccgagcccgacagcaacggcagcgccggctcggaggacgcgcagctggagcccgcgcacatctccccggccatcccggtcatcatcacggcggtctactccgtagtgttcgtcgtgggcttggtgggcaactcgctggtcatgttcgtgatcatccgatacacaaagatgaagacagcaaccaacatttacatatttaacctggctttggcagatgctttagttactacaaccatgccctttcagagtacggtctacttgatgaattcctggccttttggggatgtgctgtgcaagatagtaatttccattgattactacaacatgttcaccagcatcttcaccttgaccatgatgagcgtggaccgctacattgccgtgtgccaccccgtgaaggctttggacttccgcacacccttgaaggcaaagatcatcaatatctgcatctggctgctgtcgtcatctgttggcatctctgcaatagtccttggaggcaccaaagtcagggaagacgtcgatgtcattgagtgctccttgcagttcccagatgatgactactcctggtgggacctcttcatgaagatctgcgtcttcatctttgccttcgtgatccctgtcctcatcatcatcgtctgctacaccctgatgatcctgcgtctcaagagcgtccggctcctttctggctcccgagagaaagatcgcaacctgcgtaggatcaccagactggtcctggtggtggtggcagtcttcgtcgtctgctggactcccattcacatattcatcctggtggaggctctggggagcacctcccacagcacagctgctctctccagctattacttctgcatcgccttaggctataccaacagtagcctgaatcccattctctacgcctttcttgatgaaaacttcaagcggtgtttccgggacttctgctttccactgaagatgaggatggagcggcagagcactagcagagtccgaaatacagttcaggatcctgcttacctgagggacatcgatgggatgaataaaccagtatgactagtcgtggagatgtcttcgtacagttcttcgggaagagaggagttcaatgatctaggtttaactcagatcactactgcagtctgacatgaaaagatagaatttaaaataaacttttagagatctcatggtctgaagtcatcagatgcagaccacgttcgtgatcagtggaaacatcaaggacaaaaggtccacgcaacacatgcacctcttctctagggcacagaagcgaggcagagcctcagttcctctgatgaacaagggaacaggtcttttccttctggtttgctaggtaaggttcagcacccatctgctgtggccttcctatgaaacgtagtttcaaaagctcggtttaagaaaaaaggaaaagaaaaaacattgctttcagagctcaatgggcatccaatccagatgtttcacaatgacagcaacaacctccaacggaatgggaactatttccagggttcatgcccagctcactgtatgctgtgtggacatgcatttcatgtggctgtgtggtaagaattacagcttacatatggcttggacccacatctgaggaatctgatgttcacttataccagaacattatcttgctatttatgaaattatttaaacgttcaaaagattgtttttaacatggtttaatttcccaaaaactacagttttttttcttagcatgctattcaggtaaacagtcttataataaagcatgtcccattgtcaagaaacataaagtggtgtgaataccactgaaaatatatatatagtatcttctgtaaataatagtacctgtgtgaataaggaataggcttgcctcccagccaggcaatttcctgagggcacactaatgatatcccctgagttgctaagttgatgctgagacattttgctgggaattagtcatggcatgatctctttcagactccctgaataccatttagtcccgtaacagtgctcacaactcatgtgctaatgaatcacaaaggctttaactagctcccaggttgtagccttcgcaggatctagtttatttgccacatctctttatgaacatatagcgattcgcagatctctctattcacggagaggaaggtgttttgcttctgtagatctcaaggtactattttgtggctctcagcaggaagtagaattgttcctaaatgtgtgctgaatgaggacatgatgtccctcctggtgccaggacacatcctgcatggcattctgtgaagggcatacctgctgaggataatgccaggagcagcacatttagggtaattttgctaaaacttccagatgacatataaattccctctttttccccctgaaacttaccatttcagaggtaatggctttttctgtaatttgcctgagaagaaaaaagggataatttagaaataacactccaagcctatatattactagggctgcatcctctggaatttaatagaaaaattgaatatatagccctatgtaactacagacatcattacaactgttaagttctgttcaccatgcaagttctcggtggtgtatgtactctcaccttttggaaacaaaaccttgcattgaaggttttacacatggcttcagaatgttactctgaccatgtttgcctctactccagattatcatggcacctaacacagatgacatatggcagaatggaagtgatttctcctaatgaaaatgaagtgctcttttgagtatttcttgttttattgagattcctatctgcccttgtatttttataactgaatgtaaataggaattgcttaaatactggtttacactaatcccatagttaaaaatcttggctatggtacaggaaggatatctatatagaggatagttccagaaacaagccctggtgaaataggaaatataaaaacttctttatggaacaggaaaacccaagagactttctcgtcagattcctttccagtgcaaagtataacagagataggattatgagatgaaatcacagtagtgtgtttcctttaattttttctgtcttctttttttttttttttttttttgagacggagtctcgctctgttgcccaggctggagtgcggtagcacagtcttggctcactgcaacctccacctcctgggttcaagcgattctcctgcctctgcctcctaagtagctgggattacaggcgtgcaccgccaagcccggctaatttttgtatttttagtagagacggggtttcaccatgttatgcaggctggtctcaaactcctgacctcagaatattcacctgcctcggcctcccaaagtgctgggattacagatgtgaatggccacgcctggcctgtttcctttaagttagcacttcacgtgctcttacagcgttaattgccattattggtttgcctgattttcctgcatctcctcatatgtaagtctgcagcccaaggagagaatagtagctgtatgtgcccacaaggggtgtccaagcttcttgattcttgttaatatcgactccccaacattgaaaaaggagtgaagaagggaatatcattttagggtactgctttaaaggaatgataaagtaaacaacgtagcagggaaaataccacttgcacaaatgtatttctttgtcaaagtgtgtacacgctttctgtttgtcctgatgtcctgctgtgaagcagggaccacattgccatttattcattgttccaggcaatgcatttgtccaaacccctctggctctctgatatctctcatttcttgatgttcctattctctgacctcaacaaggaggacactgtctgttgtgtctctttgagactagaactccatgtgtttaaccttcagatccattctctacatgaaccctattctttccaccctggtaagaaggtctggaagacaggtcctaacgaggggtcagagaaggcacagagaaatgaaccagccatgcaggggcagcactgaggaggaaaccccccactctaactgggaggagagtggaaacactcttagtatctcagagtagttaccaatctaagagcatccttcgagtttaagtcaaaactctaggcttaataccaaaaataatacatcatttggaaaaatagcttggagaaaaaaaatcaataaagagtcacataaaatcttaagaaaatggttctattctgtgatatattactaagaaatacagttcttaaacgtgtataactattgtcagacaatttataggtgtttcatctagtcctgggatgaaatacgatgactcatgcaaattcagggagcacactggctgactttaaattggaacattgtaaagtgaaagctgtgaaaggttgtgtgtcctatcaatgagatttattttctaaccaagagctgttcggatgattcagtataaatacgaaaatcacatccaaaaacggtataacccagcttccttaaggcaattttcttctctgaaacaagaatatactcatatgttctttactataatgtatatgatttttatcttgtactttaaaagatgataattatgcattgtatatacgattgtgtgccttgcaataaaatcaaaactgtacctgctgaaaatcacaacagtc

SEQ ID NO: 53323 - DNA, 1913 bp, Homo sapiens
ccggaggacgcgctgctgcgagaccagccgcggcgtctttggcagtggtgggcgtgcttgcgggtccaggagggcccctctcccgcgaccgccgaccacgatgagagcgtgaagaccctctcgaaaggaagggctctgctctacacactggtgtctcctgcggaagggcagctgggcacgccttccagaccgagcaaaagttgaaaaatcagtaacccaagatgactaaccaaatcaatatgctgggcaggatgagacatcagtgtctgcctcagacagaagagcacacacaaaacatgacctctcactccaagcccagttacagcagaaagttttcatggagaaatggaatcacacttcaaatgatttcattttgttgggtctgcttcccccaaatcaaactggaatatttctcttgtgccttatcatcctcatattctttctggcctcggtgggtaactcggccatgattcacctcatccacgtggatcctcgtctccacacaccgatgtactttcttctcagccagctctcccttatggacctgatgtacatctccaccaccgtccccaagatggcgtacaacttcctgtccggccagaaaggcatctccttcctgggatgtggtgtgcaaagcttcttcttcctgaccatggcgtgttctgaaggcttactcctgacctccatggcctacgaccgttatttggccatctgccactctctctattatcctatccgcatgagtaaaatgatgtgtgtgaagatgattggaggctcttggacactggggtccatcaactccttggcacacacagtctttgcccttcatattccctactgcaggtctagggctattgaccatttcttctgcgatgtcccagccatgttgcttcttgcctgtacagatacttgggtctatgaatatatggtttttgtaagtacaagcctctttctccttttccctttcattggcatcacttcttcctgtggccgagtcctatttgctgtctatcatatgcactcaaaggaggggagaaaaaaggccttcaccaccatttcaacacatttaactgtagtgatcttttactatgcaccttttgtctacacctatcttcggcccaggaatctccgctcaccagctgaagacaagatcctggcagtcttctacaccatccttacccccatgctcaatcccattatctacagcctgaggaataaggaagtcctgggggctatgaggagagtgtttgggatattctctttcctgaaagaataatcatggccatccccactccctttgtatttcctctttccaagttgattccaacacgctagagcagggttgtccaatagaaatacaacataatttaaaattttctaataggtacatttaagcagtcaaataaatttaaataatatatttaattcaaaacaatgttataattaatattaatattaacaatattgatgttaattacatagcatactatttcaataaattatatgcaatatattatagtacatgtttgtacatatattactattaacgtgataatgtttattcttgtatattgacatagaatttcttcatgtaataacacaaatttgttaatgttgccttttactctgtttgcattctaagtcttcaaagtcttgtgtttgttttatagagtgcagtgcagcttggacaaaacacatttcaagtgcccagtagtcagtgtctatagtgttggacagcacattcttagagcatccccaatcaatagtttcagaagttatatatgcatgtgtatgtgcatgtatggtgtatacaaacatatttttgttatatacaatattgctgatgaactgaaaattaacaagtaaaatgcacatgctaaggtaaaaaaaaaaaaaaaaaaaaaaaaaaaaaa

SEQ ID NO: 53324 - DNA, 2138 bp, Homo sapiens
taactgcagaatgtacgctgtcttcagttaaggctgagagtgggaaggagttcctaatcagagatgacatggagatcccttaaagagaaccagattcatacacaaaatgtaagataatttattggctataaaatataaatgatggtatttctgaaaggttagcaatgcatgcctgtctcgtttccctctttctctctctctctctgatagtcacttcaatcaaatggaaccaggaaatgatacacaaatttcagaatttcttcttctgggattttcacaagaacctggactgcaacccttcctctttgggctgttcctgtccatgtacctggtcactgtgctcgggaacctgctcatcatcctggccacaatctcagactcccacctccacacccccatgtacttcttcctctccaacctgtcctttgctgacatttgtgttacttccaccaccattccaaaaatgctgatgaacatccagacacagaacaaagtcatcacctacatagcctgcctcatgcagatgtattttttcatactctttgctggatttgaaaacttcctcctgtccgtgatggcctatgaccggtttgtggccatctgtcaccccctgcactacatggtcattatgaaccctcacctctgtggactgctggttctagcatcctggaccatgagtgctctgtattccttgctacaaatcttaatggtagtacggctgtccttctgcacagccttagaaatcccccactttttctgtgaacttaatcaggtcatccaacttgcttgttctgatagctttcttaatcacatggtgatatattttacagttgcgctgctgggtggaggtcccctgactgggatcctttactcttactctaagataatttcttccatacatgcaatctcatcagctcaggggaagtacaaggcattttccacctgtgcatctcacctctcagttgtctccttattttatggtgcaatcctaggggtgtaccttagttctgctgccacccgcaactcacactcaagtgcaacagcctcagtgatgtacactgtggtcacccccatgctgaacccctttatctatagtctgaggaataaagacataaagagggctctgggaatacatttgttgtggggaacaatgaaagggcaatttttcaagaagtgcccatgattgcagggctctaagcttcagaggtagtaactgtcattcttcaatcagatagtggaaatagaacttgctccttctattaatacttattatatttctgggagtttcaatttgttgtgatttcaactggtcttgtagaatttaagcaactccttttattaagctttctgctctctgatatccaacagttttttctctttgttgttttcctactttctcaaggttatttccgactttggatcagaaacactttggagatttccatttgtctcatacagggaagagttgtatgtctcctgtggcatagactacacttggcaattggggtaattgatgtaaatttatagtggaatatgacctgagaccacaatttgttcacttttgtattcttcagtcctatgtctgtctctaccttcaatgctcctcctgataatgtagacctgaacatacttgtgtattttgcagctggtcatgagattgtgttgtcctcattaggacatcatgtctttgtcagtgccatgtccacagtatctgccatactccctggcatagtacggtaaggcaaaaattgtttatcaaaaatatgttccgagtgcaatgcccactgaaagacaaacttgcatatgttgattaacttaatatggacttacagtcagagatgaccttaaatatgatggagtaaaattgtcaatcatacattgaattgctatggaagacttgtttttatgatgtgcatggactcattgaagtatggaagcttagtgcccatatataagtttatttattggagtgatggatttggtgccatggtctataatgtttcatgcatccatacttctgtttttgcttcaaaatttttagtgctccctacaaatacgaatccttctatcccactaaccaaaatacctccttcattataaaattttgtcgtaaacattaaagtgcaggtcagtgaaca

SEQ ID NO: 53325 - DNA, 4970 bp, Homo sapiens
ccgtgagttctgcccaggccctgtgagctcaccagagccacagactcacagcccagaggtggcttcttccttcaggaactgaagaacccccatgaacaccaacatctccaggttctgagaacagaacctgggaaattgatgacttcctcatgatgaccgatactcaggatggccctagcgagagctcccagatcatgaggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacgggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacgagcttcatctggttcctgaaccctctcaagtcggctcgctacttcttgtggcacacgtatcgctggctgctcctcaaactgttgctgctcctgctgctgctcctcctcctcgccctgttcctctactctgtgcctggctacctggtcaagaaaatcctcggggcctgagcccagtggcctcctggccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccacttttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctttcttgccccacctggctgaggcgccacccttcttcaggcccaggctccagaggaagactcctgaaaccctccccaggttttccaagtacaggattgaagctttagtgaaattaaccaaggaccatgggtcagtgcccagggctttaaaaagaatgaacgagcaaaaggtatccccgccgtgacccctgcagatagcaccggtatttgatccgcagcaggggccagaccctgcccacaagtcccagcgcggatgtttctgccactgctgggctccacttggctcctctcacttcccagggggtcgcctgtcctgcctgtgggtttccatggcttcccagagttccctctgccccagccagcgcctccaggcccagctgaggagctgtgagaagcagcagaggggactccccatcccgggcacaccctgtcttcccacccctgcccccttgcccttccagccctttcagctgcaggtgggagctggcccgtcaagtgctgcccctgcctgtgtctgggtttctgttggctgtttttcttttcttggagtggtgatttttctctaaataaaagaagtcaagcactgaaaaaaaaaaaaaaaa

SEQ ID NO: 53326 - DNA, 7172 bp, Homo sapiens
atcggaggggggtcgggaggaggaggaggaggcagcggcagagaagagagaggcgtgtgagccgtgctccaccggctagctccttcccgctgctcctgcctggcagtgccaggcagcccacaccagcatggccttgctcatccacctcaagacagtctcggagctgcggggcaggggcgaccggatcgccaaagtgactttccgagggcaatccttctactctcgggtcctggagaactgtgaggatgtggctgactttgatgagacatttcggtggccggtggccagcagcatcgacagaaatgagatgctggagattcaggttttcaactacagcaaagtcttcagcaacaagctcatcgggaccttccgcatggtgctgcagaaggtggtagaggagagccatgtggaggtgactgacacgctgattgatgacaacaatgctatcatcaagaccagcctgtgcgtggaggtccggtatcaggccactgacggcacagtgggctcctgggacgatggggacttcctgggagatgagtctcttcaagaggaagagaaggacagccaagagacggatggactgctcccaggctcccggcccagctcccggcccccaggagagaagagcttccggagagccgggaggagcgtgttctccgccatgaagctcggcaaaaaccggtctcacaaggaggagccccaaagaccagatgaaccggcggtgctggagatggaagaccttgaccatctggccattcggctaggagatggactggatcccgactcggtgtctctagcctcagtcacagctctcaccactaatgtctccaacaagcgatctaagccagacattaagatggagccaagtgctgggcggcccatggattaccaggtcagcatcacggtgatcgaggcccggcagctggtgggcttgaacatggaccctgtggtgtgcgtggaggtgggtgacgacaagaagtacacatccatgaaggagtccactaactgcccctattacaacgagtacttcgtcttcgacttccatgtctctccggatgtcatgtttgacaagatcatcaagatttcggtgattcactccaagaacctgctgcgcagtggcaccctggtgggctccttcaaaatggacgtgggaaccgtgtactcgcagccagagcaccagttccatcacaagtgggccatcctgtctgaccccgatgacatctcctcggggctgaagggctacgtgaagtgtgacgttgccgtggtgggcaaaggggacaacatcaagacgccccacaaggccaatgagaccgacgaagatgacattgaggggaacttgctgctccccgagggggtgccccccgaacgccagtgggcccggttctatgtgaaaatttaccgagcagaggggctgccccgtatgaacacaagcctcatggccaatgtaaagaaggctttcatcggtgaaaacaaggacctcgtggacccctacgtgcaagtcttctttgctggccagaagggcaagacttcagtgcagaagagcagctatgagcccctgtggaatgagcaggtcgtctttacagacctcttccccccactctgcaaacgcatgaaggtgcagatccgagactcggacaaggtcaacgacgtggccatcggcacccacttcattgacctgcgcaagatttctaatgacggagacaaaggcttcctgcccacactgggcccagcctgggtgaacatgtacggctccacacgtaactacacgctgctggatgagcatcaggacctgaacgagggcctgggggagggtgtgtccttccgggcccggctcctgctgggcctggctgtggagatcgtagacacctccaaccctgagctcaccagctccacagaggtgcaggtggagcaggccacgcccatctcggagagctgtgcaggtaaaatggaagaattctttctctttggagccttcctggaggcctcaatgatcgaccggagaaacggagacaagcccatcacctttgaggtcaccataggcaactatgggaacgaagttgatggcctgtcccggccccagcggcctcggccccggaaggagccgggggatgaggaagaagtagacctgattcagaacgcaagtgatgacgaggccggtgatgccggggacctggcctcagtctcctccactccaccaatgcggccccaggtcaccgacaggaactacttccatctgccctacctggagcgaaagccctgcatctacatcaagagctggtggccggaccagcgccgccgcctctacaatgccaacatcatggaccacattgccgacaagctggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacggtcaggcttctccggcgctgccgtgtgctgtgcaatgggggctcctcctctcactccacaggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacgagcttcatctggttcctgaaccctctcaagtcggctcgctacttcttgtggcacacgtatcgctggctgctcctcaaactgttgctgctcctgctgctgctcctcctcctcgccctgttcctctactctgtgcctggctacctggtcaagaaaatcctcggggcctgagcccagtggcctcctggccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccacttttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctttcttgccccacctggctgaggcgccacccttcttcaggcccaggctccagaggaagactcctgaaaccctccccaggttttccaagtacaggattgaagctttagtgaaattaaccaaggaccatgggtcagtgcccagggctttaaaaagaatgaacgagcaaaaggtatccccgccgtgacccctgcagatagcaccggtatttgatccgcagcaggggccagaccctgcccacaagtcccagcgcggatgtttctgccactgctgggctccacttggctcctctcacttcccagggggtcgcctgtcctgcctgtgggtttccatggcttcccagagttccctctgccccagccagcgcctccaggcccagctgaggagctgtgagaagcagcagaggggactccccatcccgggcacaccctgtcttcccacccctgcccccttgcccttccagccctttcagctgcaggtgggagctggcccgtcaagtgctgcccctgcctgtgtctgggtttctgttggctgtttttcttttcttggagtggtgatttttctctaaataaaagaagtcaagcactgaaaaaaaaaaaaaaaa

SEQ ID NO: 53327 - DNA, 5124 bp, Homo sapiens
ccgtgagttctgcccaggccctgtgagctcaccagagccacagactcacagcccagaggtggcttcttccttcaggaactgaagaacccccatgaacaccaacatctccaggttctgagaacagaacctgggaaattgatgacttcctcatgatgaccgatactcaggatggccctagcgagagctcccagatcatgaggtccctcactcccctgatcaacagggaggaggcatttggggaggctggggaggcggggctgtggcccagcatcacccacactcctgattcacaggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacggtcaggcttctccggcgctgccgtgtgctgtgcaatgggggctcctcctctcactccacaggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacgagcttcatctggttcctgaaccctctcaagtcggctcgctacttcttgtggcacacgtatcgctggctgctcctcaaactgttgctgctcctgctgctgctcctcctcctcgccctgttcctctactctgtgcctggctacctggtcaagaaaatcctcggggcctgagcccagtggcctcctggccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccacttttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctttcttgccccacctggctgaggcgccacccttcttcaggcccaggctccagaggaagactcctgaaaccctccccaggttttccaagtacaggattgaagctttagtgaaattaaccaaggaccatgggtcagtgcccagggctttaaaaagaatgaacgagcaaaaggtatccccgccgtgacccctgcagatagcaccggtatttgatccgcagcaggggccagaccctgcccacaagtcccagcgcggatgtttctgccactgctgggctccacttggctcctctcacttcccagggggtcgcctgtcctgcctgtgggtttccatggcttcccagagttccctctgccccagccagcgcctccaggcccagctgaggagctgtgagaagcagcagaggggactccccatcccgggcacaccctgtcttcccacccctgcccccttgcccttccagccctttcagctgcaggtgggagctggcccgtcaagtgctgcccctgcctgtgtctgggtttctgttggctgtttttcttttcttggagtggtgatttttctctaaataaaagaagtcaagcactgaaaaaaaaaaaaaaaa

SEQ ID NO: 53328 - DNA, 4772 bp, Homo sapiens
ccgtgagttctgcccaggccctgtgagctcaccagagccacagactcacagcccagaggtggcttcttccttcaggaactgaagaacccccatgaacaccaacatctccaggttctgagaacagaacctgggaaattgatgacttcctcatgatgaccgatactcaggatggccctagcgagagctcccagatcatgaggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacgggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccacttttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctttcttgccccacctggctgaggcgccacccttcttcaggcccaggctccagaggaagactcctgaaaccctccccaggttttccaagtacaggattgaagctttagtgaaattaaccaaggaccatgggtcagtgcccagggctttaaaaagaatgaacgagcaaaaggtatccccgccgtgacccctgcagatagcaccggtatttgatccgcagcaggggccagaccctgcccacaagtcccagcgcggatgtttctgccactgctgggctccacttggctcctctcacttcccagggggtcgcctgtcctgcctgtgggtttccatggcttcccagagttccctctgccccagccagcgcctccaggcccagctgaggagctgtgagaagcagcagaggggactccccatcccgggcacaccctgtcttcccacccctgcccccttgcccttccagccctttcagctgcaggtgggagctggcccgtcaagtgctgcccctgcctgtgtctgggtttctgttggctgtttttcttttcttggagtggtgatttttctctaaataaaagaagtcaagcactgaaaaaaaaaaaaaaaa

SEQ ID NO: 53329 - DNA, 4282 bp, Homo sapiens
ggcgagatcccagagcgacgcggtggcggcggcagcgccagccccctcctcccccgggaagtcggccgggcttgaggccgggccccagacgtcccgcttcgccccgaggcgccgccgatggtccccggagctcctgcccccagtgcatgagcagccgagcctgctaaccgcagctccgcacttgtccatccccctgcggctacaccatgtccagctcctacgatgaggcctcactggcgccagaggagaccaccgacagcttctgggaggtggggaactacaagcggaccgtgaagcgcatcgatgacggccaccgtctatgcaacgacctgatgaactgcgtgcaggagcgcgccaagatcgagaaggcgtacgggcagcagctcaccgactgggccaagcgttggcgccagctcatcgagaaaggcccacagtatggcagcctggagcgggcctggggtgccataatgacagaggcagacaaggtgagcgagctgcaccaggaggtgaagaacaatctgctgaatgaggacctggagaaggtgaagaactggcagaaggacgcctatcacaagcagatcatgggtggcttcaaggagacgaaggaggctgaagatggcttccgcaaggcccagaagccttgggccaagaagatgaaggagctggaggcagccaagaaggcctaccatttggcttgcaaagaggaaaagctggccatgacacgggagatgaacagcaagacggagcaatcggtcacacctgagcagcaaaagaagctgcaggacaaagtggacaagtgcaagcaggatgtgcagaagacacaggagaagtatgagaaagtgctggaagatgtgggcaagaccacaccccagtacatggagaacatggagcaggtgtttgagcaatgccagcaatttgaggaaaagcggctggtcttcctcaaggaggtgctgctggacatcaaacggcacctcaacctggctgagaacagcagctacatccatgtgtaccgtgagctggagcaggccatccggggggctgatgcccaggaagacctcagatggttccgcagcaccagtggccccggcatgcccatgaactggccccagtttgaggagtggaacccagaccttcctcacaccaccaccaagaaggagaaacagcctaagaaggcagagggagtggcgctgaccaatgccactggggcggtagagtccacatcccaggctggggaccgcggcagtgttagcagctacgacagaggccagccctacgccaccgagtggtcagacgacgagagtgggaacccctttgggggcagtgagaccaacgggggcgccaacccctttgaggacgactccaagggagtgcgcgtgcgggcactctacgactatgacggccaggagcaggacgagctcagctttaaggccggagacgaactcaccaagctgggcgaggaggatgagcagggctggtgccgtgggcggctggacagcgggcagctgggcctctaccctgccaactacgtggaggctatctagaggccccctccctccatactcccgtcactcctccccactgccgcccctcccctcccactctcgtctccttcccctcgccatagagttccagacatattttccgatcaagcttttatttttttaaaagtcaaaacagaacaaaacaaagtatgcagagacagagcatttgcagggccacctggaggctggggtgctggggcttggggtggccccagggtaggtaacagtcttaggacttagcccaacatcacaacatctgctcttcgggttccaccaaagagtctcctgagccctgagggatggatgtctcctgacccttccaccccgcctcactccctccgtcccactccactccaggctgccggcacctgccccattccctggcctggtttcctaacctcttcttcctcccctgccctgcttcccttcctccaccaccctgctctcaaaggcctcctctccagacccctggaagggaggcttccccatctttagttttccactctgccccggggagcacccttctactcctagccacgtcccttgggaccggtgggactggaggaggaacggtcaccctcctcccccatggaggtttccaggggtcccccagacatgaaagaggggtgagctggaggaagtcatggtgtcactggggtacaggagggtgaatgaagggcatgcaggccctcagcccgggctgtgccagccctcccagccccaggcccatctgagggaccaagacgctgttacgcaggcccttctttccagctatcagcactttcagcatcggctcttcagcagatccaaaccccctcagcaacttgcagaggacctgtcccctctcaaaagtcccctggcctagggtggggacccccaaacctacggcaaagccagcaacagtagcagcctgctcccatttgctggggaggagatcatcttgttcccctggccccccactctccctccatgtccatccaaaaaccataaaatcactgggttccacatcagcctccatgaggccaagccttgtacctgcaaggctcttggcctaaccattcctctgtcctcttctctggcctgcctggggagcccgtgaaggccgcacgggtgcctccagcctgagacatcaggggagagcctgcagctgagttcagcagaaaggaggaatcctggccctcaggaagaagatagtcacatgtttttcttccttgtccccacagcccccagaacaacattctccctgctggcagcccttccatgtctccaaacctgggtcagagtgaaaggacctttgggggtgggtgggagcaaagggcccacctgctggttggtgaaagcagtggtgccggagtgctaggtaccgcacgagagggtgcgggggcttgggaagcagaccagggttggacaaaaccccatgagggcggggagctggaagaaaagtctcttggggacctctggggcaaggagctgagaagtcctgcagcaccaggtgagacttgcttacagtggatgccacttctaggcctctggaccgcagatgccctcctccctcctgcacacctggcctcctgggcctccaggtaaagagagagagccagcccagccctgtttcccctcagtcctcctttgctcctgctgcttctcccaacagcccactgttaggaggtagtagaccccagcctcaaggctctgaccttcttcatgtgggcacagagggtcctgacactctggcagggcctgagctggggcaggcctccctcagggccaggggcgatggcaccccggggacaggcagacctccttcctgccgtcagcacccccttccttatcactgtctggtctccgagcttcggctgcagcctgaggtgtgtcctgggctcctcagagcctgaagcaagcttttggaagcctgcagtcctcccagctccagtgcagaagcctctctctccagcctttccccaggcaggagttggggttgggggcctctgtccctcatcgcttaccttggaaaggtgggaagctggcaatctgcaccttggggcctgggctccccctctctgtgccagcggcttcccagcacctgggaggggctgcagccccagctggactccagcctgtccctcttagcactctagctgcccactccagggcagggactcgaaaccccctccgtcctgagcagccacctccagggccctgtttgggaccactctctcagtccccaggtcctcagggccccagagcgggagggtctcctacctggaagtccccctgagctccagggcccagccctacctgccagtgctggtgtcagggcactcaacaccgagtgtgggggccacgccccttgccatgcccacggcctcctcctgtagcccctgcctgcacccacgatgctgcacgggcccgccctggtggggctcggcgagtaatgtgttttgtccccagttaaccaccattctgcggcctggttctgcaaggaaccagggctgccccaccgcccgccgtctgccgccctaggcttcctgactccattagttccgacacttgtgaaactccgagaagtgctgtggtctcagcaatgcacctgttttgtacatgattgtgtaatttaaaggtatataaatacaaatatatatatatatcagttgtgattgtatgactgtggataaaatccagaactgtgtcaaaaaaaaaaaaaaaaaaaaaaaaaaaaaaaaaaaaaaaaaaaaaaaaaa

SEQ ID NO: 53330 - DNA, 2516 bp, Homo sapiens
gaggtagaggaaaggtcttgacggggtggctggatccgtggcagaatccagttccagattctagacttgagggttctgggctgttggtctgtagaagcgaaggagagaaggactcaaatccaggccaagtgtatggctgtctgaggtattggaacagaaggaggtccattcctgttggtgacaacaccgtggccctgttctgggatgagcaaggtgtaaaggtttcccccaagaaagagcagctgagtccttgcatcttgtggcagctggtgtgcccagcactgagtctgtaggagctgaagccagcccggacccttctcatgggcagtgcccacctgtgctgaagtcctgcagcggtggcggtgtgaggagctgtgaaattagttgtaactgaaaatgtctgacggtctggataatgaagagaaacccccggctcctccactgaggatgaatagtaacaaccgggattcttcagcactcaaccacagctccaaaccacttcccatggcccctgaagagaagaataagaaagccaggcttcgctctatcttcccaggaggaggggataaaaccaataagaagaaggagaaagagcgcccagagatctctcttccttcagactttgagcatacgattcatgtggggtttgatgcagtcaccggggaattcactggaattccagagcaatgggcacgattactccaaacttccaacataacaaaattggaacagaagaagaacccacaagctgttctagatgttctcaaattctatgattccaaagaaacagtcaacaaccagaaatacatgagctttacatcaggagataaaagtgcacatggatacatagcagcccatccttcgagtacaaaaacagcatctgagcctccattggcccctcctgtgtctgaagaagaagatgaagaggaagaagaagaagaagatgaaaatgagccaccaccagttatcgcaccaagaccagagcatacaaaatcaatctatactcgttctgtggttgaatccattgcttcaccagcagtaccaaataaagaggtcacaccaccctctgctgaaaatgccaattccagtactttgtacaggaacacagatcggcaaagaaaaaaatccaagatgacagatgaggagatcttagagaagctaagaagcattgtgagtgttggggacccaaagaaaaaatacacaagatttgaaaaaattggtcaaggggcatcaggtactgtttatacagcactagacattgcaacaggacaagaggtggccataaagcagatgaaccttcaacagcaacccaagaaggaattaattattaatgaaattctggtcatgagggaaaataagaaccctaatattgttaattatttagatagctacttggtgggtgatgaactatgggtagtcatggaatacttggctggtggctctctgactgatgtggtcacagagacctgtatggatgaaggacagatagcagctgtctgcagagagtgcctgcaagctttggatttcctgcactcaaaccaggtgatccatagagatataaagagtgacaatattcttctcgggatggatggctctgttaaattgactgactttgggttctgtgcccagatcactcctgagcaaagtaaacgaagcactatggtgggaaccccatattggatggcacctgaggtggtgactcgaaaagcttatggtccgaaagttgatatctggtctcttggaattatggcaattgaaatggtggaaggtgaacccccttaccttaatgaaaatccactcagggcattgtatctgatagccactaatggaactccagagctccagaatcctgagagactgtcagctgtattccgtgactttttaaatcgctgtcttgagatggatgtggataggcgaggatctgccaaggagcttttgcagcatccatttttaaaattagccaagcctctctccagcctgactcctctgattatcgctgcaaaggaagcaattaagaacagcagccgctaagactgcaagccttacacctcaccatctccctcatgagtaagactgaaataaaactctgctgcaggaaagatggaagaaaagacagtcaaatggggtgggggttctttacctttcaaatgaatagaaacttcttataagcctttttcctactccctcagattatgtaatttatttgtaagcctgaatcgcagcccaaacagggcagcaatgttgaagtgaccataaagtggtcacttccaccgtgaagcgaaagagccagtagtgaatcccctcattttgtgcattcactttgaagaaaaaggtttctcaaagatgcacactccctcttcatagtgttgtgtttgtttttaagttagagagtagtccctcttgcattcaaacctccttcaaaactccttacccaatgtgatgtttttcacttgcattgtcattagatgtccagaaaaaaaaaagatgtcaaaatgtttttctaaaaaaagaaagca

SEQ ID NO: 53331 - DNA, 4008 bp, Homo sapiens
ggggctcgtccgggggtagccgcctcctctgcagcctgccggcgcctcgaagcccggacctgcctccgcctcttcctccagcggctccatcccgcctcccgtgcctcgtcctcccgccgcctccgccgccgcgcccccggtggctgcctcggcggaccggggagggggcccaccgcgtcgaccgcccgctcggctcggctcggcccggcccgggaggcgtgcatgcccctgctgcccgcggcgctcaccagcagcatgctctatttccagatggtgatcatggcagggacggtgatgctggcgtactacttcgagtatacggacacgttcaccgtgaacgtgcagggcttcttctgccacgacagcgcctaccgcaaaccctacccgggcccggaggacagcagcgccgtgccccccgtgctcctctactcgctggccgccggggtccccgtgctcgtgataatagttggagaaactgctgtcttttgcctacaactagccacaagggattttgaaaaccaggaaaaaactattttaactggagactgttgctatataaacccgctggtgcgccgaactgtccgatttcttggaatttatacatttggactgtttgctacagatatctttgtaaatgctggacaagtagtcacaggaaatctggccccacatttccttgccctgtgtaagcccaattatacagcacttggatgtcagcagtatacacaattcatcagtggggaagaggcctgtactggcaacccagatctcatcatgagagcccgaaaaacctttccatccaaagaagcagctctcagtgtctatgcagctatgtatctgaccatgtacatcaccaacacaatcaaagccaagggaaccagacttgctaagccagttctatgcttgggcttaatgtgtttggcatttcttactggactcaacagagtagcagaatatcgaaatcattggtcagatgttatagcaggctttctggttggaatatctatagcagtatttctggttgtgtgcgtggtgaataatttcaaagggagacaagcagaaaatgagcatatacacatggataatctggcacagatgccaatgatcagcattcctcgagtagaaagtcctttggaaaagaaccacatcactgccttcgcagaagtcacatgatatcgaagcagatggtttttcactgcattggacatcatccctttttaccatccattcataacacccaaagtttgtttgattgcaagtgaagtttataaagttgtttaataatttttataattttaaaatcaatgtcaacctatctgtttcccccactagactgtgagctcctcgagggcaggattgtctttttttttctgtgtccccagcacttacaacaaagcctagcacaaagtaggtgttcaacaaaaatgtgatgaccaaatgaacaaaattcttaaataaaacattcactttagtttctcacagaatcattgcaattatgttaaaagaaatctctacataaatcgtatttgtgtatgaaaaccttctattttgggctagttatttttttaatcttcatatatctattcagcagtatgccatatttaatttgaagtggactttgaaagtcatgggggtttttattttgttattcagcatgacattatttccattctaacatttcagtgtgtgaaattactttatttttagaaagtatgttctatagtaaaataatgtttccacattatattatgttatatttcacttaaaatactattcatactatacattctaagactggtgcttctgcttttgaaggggaaaatgccaatttttactgtaataagtaatgtatcataattaaaaattatttatttggacttcttctcctgacaattgtggcttaattcatgacttgtttttgaatgcaggcagtatttagggtagtttaaatgagtaaattcagcactggtaccttattattgagtaatttcccatgggtagcagtgtctcaagagtggtcaaaagctccactcttaggcttttttactactaaagattccacataatttaaatgggaaagaactataccctgacacataatttaaattatataaatgctagaaatatggttaatgtattttactttgcatttgtgtagtactttatagtttacaaagcatatttacaccaattattttatgtaatcctcataataacctggtataaacatgaagggtatggctttatttttatagataagaaaaatgaagccaagacagggtaaataacatgccaaatcacaaactagtaagagacatagttgaagcttaaattcaagttttctggccctgaactcatattcctttctaatatagcacagctgtcatctcattttggacactgaggcctttcagagctcagtagaatcctgggcaactacctatggttcaaaaaataaagaaatgccagaatacaaatatgaaagctctgctgtattttaaatgtttatgttttaagaatgaacacttttcaaatataaaactatataataattataatccagttttaagataatatcaagagtctagatgtgaggctttttgtgaaagagaagcctaaattcagcatctccccttccaccctcacccccaggtcccagcctcccactcagcagagtgcccaagggacataccttacatttagcatgtagaattccagattacaatcgccataatataaggaaggtgagctcctcaacaataactttgcaataattaaaactaccctaagtaactttggcttatatggcaaagtaactttggcagtaattgactgaaatgaatctttctaaactttacagtactaaagaaagcaaacttttaatttcctctgtaatttcaacagagatcagcaaataaatataaccaaagattgtccattactccccaaatagatgttatttgcccatttctatcactgtggaagctaaaacacttctactagggccaaaaagagaaaagaaaagaaaatttctactaatttcagacctctagagcaattcagtcctgttggaaatttagaacatgaagaaactttgaatgtcttgaccctttttaaagattttttaggcaataacagtaatagggaattcacttattgagaatgaaagtgaaggggatgatcctaatgtcttagaaagctagattactagtaaggcttccagacttctatcagttctattgattctacatcagacttccaagcagccaagcaggaatgtttttcctgttggaagccttagccatatattcttatgtcaaggttgcttctttgcaccttgctaaacctgatacgaatgcaggagttttaaattcttcaaaaactcagatttaacccagaaccagagtaaagtcacctctactatttacacatcataggctcaagattgtacagtgagtgatgctgtcatgaagaaaattcagatgaaaaaggcaagatacatgtgaataaggcaaaagccagaaaatagcccttattcatgatgctgttactgagaataatgaaaatcatatttcagaaaatattaccatgtaaatatgtacatatgtagtctagtaaaagcaggcaaacacatatctttctgataaaaacatctcctttttattctacttacttggggcccaggtcagtataatttagtcaacttgaaaatttcggtagtctctgtttgcatggcagaaattctgcacatgttttatctgattcctgtgataacttaaaaggctcttttatgttaaaagagaggtgaatcttctttgacagactttgtattttccacttctaactgggcctctcttttctcaggatctatcctagccaaatatctcagttacatttaccatacagtttcctttgtgaaagaacagtaggggaggaaataattctctgctgtgtattgtatttttcaaataaaaatttaaaaattcaattgaaaactgaaaaaaaaaa

SEQ ID NO: 53332 - DNA, 4023 bp, Homo sapiens
ggggctcgtccgggggtagccgcctcctctgcagcctgccggcgcctcgaagcccggacctgcctccgcctcttcctccagcggctccatcccgcctcccgtgcctcgtcctcccgccgcctccgccgccgcgcccccggtggctgcctcggcggaccggggagggggcccaccgcgtcgaccgcccgctcggctcggctcggcccggcccgggaggcgtgcatgcccctgctgcccgcggcgctcaccagcagcatgctctatttccagatggtgatcatggcagggacggtgatgctggcgtactacttcgagtatacggacacgttcaccgtgaacgtgcagggcttcttctgccacgacagcgcctaccgcaaaccctacccgggcccggaggacagcagcgccgtgccccccgtgctcctctactcgctggccgccggggtccccgtgctcgtgataatagttggagaaactgctgtcttttgcctacaactagccacaagggattttgaaaaccaggaaaaaactattttaactggagactgttgctatataaacccgctggtgcgccgaactgtccgatttcttggaatttatacatttggactgtttgctacagatatctttgtaaatgctggacaagtagtcacaggaaatctggccccacatttccttgccctgtgtaagcccaattatacagcacttggatgtcagcagtatacacaattcatcagtggggaagaggcctgtactggcaacccagatctcatcatgagagcccgaaaaacctttccatccaaagaagcagctctcagtgtctatgcagctatgtatctgaccatgtacatcaccaacacaatcaaagccaagggaaccagacttgctaagccagttctatgcttgggcttaatgtgtttggcatttcttactggactcaacagagtagcagaatatcgaaatcattggtcagatgttatagcaggctttctggttggaatatctatagcagtatttctggttgtgtgcgtggtgaataatttcaaagggagacaagcagaaaatgagcatatacacatggataatctggcacagatgccaatgatcagcattcctcgagtagaaagtcctttggaaaaggtaacatctgtacagaaccacatcactgccttcgcagaagtcacatgatatcgaagcagatggtttttcactgcattggacatcatccctttttaccatccattcataacacccaaagtttgtttgattgcaagtgaagtttataaagttgtttaataatttttataattttaaaatcaatgtcaacctatctgtttcccccactagactgtgagctcctcgagggcaggattgtctttttttttctgtgtccccagcacttacaacaaagcctagcacaaagtaggtgttcaacaaaaatgtgatgaccaaatgaacaaaattcttaaataaaacattcactttagtttctcacagaatcattgcaattatgttaaaagaaatctctacataaatcgtatttgtgtatgaaaaccttctattttgggctagttatttttttaatcttcatatatctattcagcagtatgccatatttaatttgaagtggactttgaaagtcatgggggtttttattttgttattcagcatgacattatttccattctaacatttcagtgtgtgaaattactttatttttagaaagtatgttctatagtaaaataatgtttccacattatattatgttatatttcacttaaaatactattcatactatacattctaagactggtgcttctgcttttgaaggggaaaatgccaatttttactgtaataagtaatgtatcataattaaaaattatttatttggacttcttctcctgacaattgtggcttaattcatgacttgtttttgaatgcaggcagtatttagggtagtttaaatgagtaaattcagcactggtaccttattattgagtaatttcccatgggtagcagtgtctcaagagtggtcaaaagctccactcttaggcttttttactactaaagattccacataatttaaatgggaaagaactataccctgacacataatttaaattatataaatgctagaaatatggttaatgtattttactttgcatttgtgtagtactttatagtttacaaagcatatttacaccaattattttatgtaatcctcataataacctggtataaacatgaagggtatggctttatttttatagataagaaaaatgaagccaagacagggtaaataacatgccaaatcacaaactagtaagagacatagttgaagcttaaattcaagttttctggccctgaactcatattcctttctaatatagcacagctgtcatctcattttggacactgaggcctttcagagctcagtagaatcctgggcaactacctatggttcaaaaaataaagaaatgccagaatacaaatatgaaagctctgctgtattttaaatgtttatgttttaagaatgaacacttttcaaatataaaactatataataattataatccagttttaagataatatcaagagtctagatgtgaggctttttgtgaaagagaagcctaaattcagcatctccccttccaccctcacccccaggtcccagcctcccactcagcagagtgcccaagggacataccttacatttagcatgtagaattccagattacaatcgccataatataaggaaggtgagctcctcaacaataactttgcaataattaaaactaccctaagtaactttggcttatatggcaaagtaactttggcagtaattgactgaaatgaatctttctaaactttacagtactaaagaaagcaaacttttaatttcctctgtaatttcaacagagatcagcaaataaatataaccaaagattgtccattactccccaaatagatgttatttgcccatttctatcactgtggaagctaaaacacttctactagggccaaaaagagaaaagaaaagaaaatttctactaatttcagacctctagagcaattcagtcctgttggaaatttagaacatgaagaaactttgaatgtcttgaccctttttaaagattttttaggcaataacagtaatagggaattcacttattgagaatgaaagtgaaggggatgatcctaatgtcttagaaagctagattactagtaaggcttccagacttctatcagttctattgattctacatcagacttccaagcagccaagcaggaatgtttttcctgttggaagccttagccatatattcttatgtcaaggttgcttctttgcaccttgctaaacctgatacgaatgcaggagttttaaattcttcaaaaactcagatttaacccagaaccagagtaaagtcacctctactatttacacatcataggctcaagattgtacagtgagtgatgctgtcatgaagaaaattcagatgaaaaaggcaagatacatgtgaataaggcaaaagccagaaaatagcccttattcatgatgctgttactgagaataatgaaaatcatatttcagaaaatattaccatgtaaatatgtacatatgtagtctagtaaaagcaggcaaacacatatctttctgataaaaacatctcctttttattctacttacttggggcccaggtcagtataatttagtcaacttgaaaatttcggtagtctctgtttgcatggcagaaattctgcacatgttttatctgattcctgtgataacttaaaaggctcttttatgttaaaagagaggtgaatcttctttgacagactttgtattttccacttctaactgggcctctcttttctcaggatctatcctagccaaatatctcagttacatttaccatacagtttcctttgtgaaagaacagtaggggaggaaataattctctgctgtgtattgtatttttcaaataaaaatttaaaaattcaattgaaaactgaaaaaaaaaa

SEQ ID NO: 53333 - DNA, 2117 bp, Homo sapiens
ttcctccatcagcctggctggcagcagccttggactccgcccgtggagccctgggcctgttgacccaccagcttaggagcacccaccaagctctgggtaaggaagctcaccttctggggctcttctgggaaaatagaggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtgaggggaggctctgccccaggccgcggccttgagctcagagggggtacccaggcgggcagggaccgtccaggcccacgggctgcagcggcagtcgcgggggtccgcggcggcctgagcacgcgcccgccgcaggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggtgagggcacgcctggcccggcccgggaagaggcaggggcagatgccttcccagagcacagaatgaactgggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaatgttttctggaacaaggcaggtacaaataaaaaaataaaactttggaaagc

SEQ ID NO: 53334 - DNA, 1882 bp, Homo sapiens
tgggcctgttgacccaccagcttaggagcacccaccaagctctgggtcaacgtggaggtaccaggccaccatgctcagtctcaagctgccccaacttcttcaagtccaccaggtcccccgggtgttctgggaagatggcatcatgtctggctaccgccgccccaccagctcggctttggactgtgtcctcagctccttccagatgaccaacgagacggtcaacatctggactcacttcctgcccacctggtacttcctgtggcggctcctggcgctggcgggcggccccggcttccgtgcggagccgtaccactggccgctgctggtcttcctgctgcccgcctgcctctaccccttcgcgtcgtgctgcgcgcacaccttcagctccatgtcgccccgcatgcgccacatctgctacttcctcgactacggcgcgctcagcctctacagtctgggctgcgccttcccctatgccgcctactccatgccggcctcctggctgcacggccacctgcaccagttctttgtgcctgccgccgcactcaactccttcctgtgcaccggcctctcctgctactcccgtttcctggagctggaaagccctgggctcagtaaggtcctccgcacaggagccttcgcctatccattcctgttcgacaacctcccactcttttatcggctcgggctgtgctggggcaggggccacggctgtgggcaggaggccctgagcaccagccatggctaccatctcttctgcgcgctgctcactggcttcctcttcgcctcccacctgcctgaaaggctggcaccaggacgctttgattacatcggccacagccaccagttattccacatctgtgcagtgctgggcacccacttccagctggaggcagtgctggctgatatgggatcacgcagagcctggctggccacacaggaacctgccctgggcctggcaggcacagtggccacactggtcttggctgcagctgggaacctactcattattgctgctttcacagccaccctgcttcgggcccccagtacatgccctctgctgcagggtggcccactggaggggggtacccaggccaaacaacagtgaggccccatccctgaccctgtcctggagggggcagaggccaggccccagtgctgacgaggagcccagatttgggcctaatcaggtggggacgcatctcagcctggaaccaacaggggctgaggagagagggcacaggagagagggcagagaagaggaggggtgtctagggggactggcagagtgtgagagggaccgtgagggggctcttgatgggagtggaagaagtgctgagggtctgagaggggagatgcatgcgtgtccaggctgaagatgcccctatattctgtcaaaggttggcggggggaggtgttggggtcctttcatctggctccgtttctggtgcttctggaagtctctgctcagcacagggaagaactaacacgactaacctaggcctaccctgaatgcttcttgctaaccaggccgagaggccacacacttgcccccccatccccacaaaccaggtaatgccagtttgccagcagctatttgcctatagagatgagtctgtcctggtcataactgtgtgctcaaggtgtccaggcttttgggggtgggcctatctgggtgcattatggatggtttggtggattgaggtgtggggaggagggtcctaggctagagggggtatccctagttagactttgggaagccaccttcaatgttttctggaacaaggcaggtacaaataaaaaaataaaactttggaaaaaaaaaaaaaaaaaaaaaaaaaaaaaaaaaaaaaaaaaaaaaaaaaaaaaaaaaaaaaaaaaaaaa

SEQ ID NO: 53335 - DNA, 4076 bp, Homo sapiens
gcttctgtaagagacggagaggcgcagagtgagggcgggtccgcgcgtcctcagagcccgctggaggctcggagctgctacccgcagacttctcccgcacagggctcgcaaagagcgtgattccgagagcctgagactgacgcccgacctggaaaccagagaagacttccttagcctttcggatcgcacttgaggctggaggcatgagtcctgtgaggcgttggggcagcccctgccttttccccttgcagctcttcagcctctgctgggtgctctcagtggcccagagcaaaacagtccgatacagcaccttcgaggaggatgcccccggcacggtcatcgggaccctggccgaggacctgcatatgaaagtatcgggtgacacaagcttccgcctgatgaagcaattcaacagctctctgctccgggtgcgcgaaggcgacgggcagctgaccgtcggggacgccggcctggaccgcgagcggctgtgtggccaggccccgcagtgcgtgctggccttcgatgtggtcagcttctcgcaggagcagttccggctggtgcacgtggaggtagaggtgagggacgtcaacgaccacgcgccgcgcttccccagggcccagatcccggtagaggtgtccgagggtgcggcagtgggcacgcgcatccccttggaggtgccggtggacgaggacgtgggcgccaacgggctgcagaccgtgcgcctggccgagccgcacagcccctttcgcgtggagctgcagacgcgagcggacggcgctcagtgcgcagacctggtgctgctgcaggagctggaccgcgagagccaggccgcctacagcctggagctggtggcccaggacggcggccgcccgccgcgctccgccacggctgccctcagcgtgcgcgtcctggatgcgaatgaccacagcccggccttcccgcagggcgccgtggccgaagtggagctggcggaagacgcgcccgtgggctccctgcttctcgacctggacgcagccgaccccgacgagggacctaacggcgacgtggtgttcgcatttggcgcccgcaccccgccggaggcgcgccgcctctttcggcttgacccgcgatcaggccgcctcaccctggccgggcccgtggactacgagcgtcaggacacctacgagctggacgtgcgggcgcaggaccgcggacccgggccccgcgctgccacctgcaaggtcatcgtgcgcatccgagacgtcaatgacaacgcacccgacatcgccatcaccccgctggccgccccaggcgcgccggcaacctcacccttcgccgctgccgccgccgccgctgcactcgggggagcggacgctagctcgccggcgggagccgggacgccggaggctggtgccacttcgctggtgccggagggggcggcgcgcgagagcctggtggccctggtcagcacctcggacagggactcgggcgccaacgggcaagtgcgctgcgccctctatgggcacgagcacttccggctgcagccggcctacgcgggcagctacctggtggtgaccgcggcgtcgctggaccgcgaacgcatcgccgagtacaacttgacgctggtggccgaggatcgcggcgcgcccccgctgcgcacagtgcggccctacacggtgcgtgtgggcgacgagaacgacaacgcgccgctcttcacgcggccggtctatgaggtgtcggtgcgcgagaacaacccgccaggcgcctacctggccacggtggccgcccgcgaccgggacctgggccgcaacggccaggtcacctaccggctgctggaggccgaggtgggccgcgccgggggcgccgtgtccacttatgtctcggtggacccagctaccggagccatctacgcgctgcgcagcttcgactatgagacgctgcgccaactcgacgttcgcatccaagctagcgacggcggctcccctcagctttccagcagcgccctagtgcaagtgcgcgtgctggaccagaacgaccatgcgccagtcctggtgcacccggcgccagccaatggctccctagaagtggcggtgcctgggcgcaccgcaaaggacacggttgtggcccgtgtgcaggcccgggatgcagacgagggagccaacggggagctggcgttcgagctgcagcagcaggagccgcgcgaagccttcgccatcggccgccgcacgggggagatactgctcaccggcgacctctcgcaggagccacccggtcgcgtgttcagggcgctcctggtcatatccgacggcggccgtcccccgctcaccaccaccgcaactgtcagcttcgtggtaacagcagggggcgggcgtgggccggctgcgcctgccagtgcaggaagcccggagcgttcccgcccgcctggctctcggctcggggtgtccgggtcggtgctgcaatgggacacgccgctgatcgtcatcatcgtgctggccgggagctgcacgctgctgctggccgccatcatcgccatcgccaccacctgcaaccgccgcaagaaggaggtgcgcaaagggggggccctccgggaagagcggcccggggcggcgggcggcggagcctcggctcccggctccccggaggaggccgcccggggagccgggcccaggcccaacatgttcgacgtgctcaccttccctggcaccggcaaagcgccctttggcagccccgcggcggacgcgcctccgcctgcggtcgccgcggccgaagtgccgggctcagagggcggcagcgccactggggaaagcgcctgtcacttcgaggggcagcagcggctccgcggcgcgcacgccgagccctacggtgcctccccgggttttggaaaggagccggcgccccctgtggcggtgtggaaaggacactccttcaacaccatttctggcagagaagcagagaagttcagcggcaaagacagcggtaaaggggacagtgatttcaacgacagcgattccgacatcagcggggacgctctgaaaaaggatctcatcaaccacatgcagagtggactgtgggcgtgcaccgctgagtgtaagatcctgggccactctgaccgctgctggagcccatcctgcagcgggcccaacgcacatccatcgcctcacccaccagcccagatgtcaaccttctgtaagagcacgtcactgcctcgggatcctctgcgcagggacaattactaccaggcccagctgcccaagacagtggggctgcagagcgtctatgagaaagtactgcacagagactatgacaggacagtcactctgctctcccctccccgtccagggaggctcccagacctgcaggagattggagtacccctctaccagtcccctcctggcaggtacctgtccccgaagaagggagccaatgaaaatgtgtaatcccatgctgcatgtcttcacacatatacaggtcactccgagaagcccctaagttattgaccggtttcagtgttgtatatataaatatgcaagatgtgccttacaatgaagttgttggaagctatttccaatcacattggtactgtttggtatttgcaaacaaaaatgtagttaatgtaatttttatgaaatgtgtgcagtatttaatttttcttatgctattgactttgatttcaattgcggcttgccattttcttagtgtttttaacctgtacattgtgtaatgtaatgtttgtatataatgaaattttgttatatttttatataataaaagctaaagtggaagttattgccaaaggaactgtctgtaagacaaaaaacaaaacatgttggaattacttaattgaaatttatctttcacctgaaacaacctagtgtttgagaaattttgccttgccaagtataacttgtatatcttgactctgtggtagatttcaagttcaatgttatttaattacatttggttttccgtaaaccgtgtcacttataagcacagtaataaaagatttgtcatgtgtttgaagaaaaaaaaaaaaaaaaaaaaaaaaaaaaaaaaaaaaaaaaaaaaaaaaaaaaaaaaaaaaaaaaaaaaaaaaaaaa

SEQ ID NO: 53336 - DNA, 3785 bp, Homo sapiens
gcttctgtaagagacggagaggcgcagagtgagggcgggtccgcgcgtcctcagagcccgctggaggctcggagctgctacccgcagacttctcccgcacagggctcgcaaagagcgtgattccgagagcctgagactgacgcccgacctggaaaccagagaagacttccttagcctttcggatcgcacttgaggctggaggcatgagtcctgtgaggcgttggggcagcccctgccttttccccttgcagctcttcagcctctgctgggtgctctcagtggcccagagcaaaacagtccgatacagcaccttcgaggaggatgcccccggcacggtcatcgggaccctggccgaggacctgcatatgaaagtatcgggtgacacaagcttccgcctgatgaagcaattcaacagctctctgctccgggtgcgcgaaggcgacgggcagctgaccgtcggggacgccggcctggaccgcgagcggctgtgtggccaggccccgcagtgcgtgctggccttcgatgtggtcagcttctcgcaggagcagttccggctggtgcacgtggaggtagaggtgagggacgtcaacgaccacgcgccgcgcttccccagggcccagatcccggtagaggtgtccgagggtgcggcagtgggcacgcgcatccccttggaggtgccggtggacgaggacgtgggcgccaacgggctgcagaccgtgcgcctggccgagccgcacagcccctttcgcgtggagctgcagacgcgagcggacggcgctcagtgcgcagacctggtgctgctgcaggagctggaccgcgagagccaggccgcctacagcctggagctggtggcccaggacggcggccgcccgccgcgctccgccacggctgccctcagcgtgcgcgtcctggatgcgaatgaccacagcccggccttcccgcagggcgccgtggccgaagtggagctggcggaagacgcgcccgtgggctccctgcttctcgacctggacgcagccgaccccgacgagggacctaacggcgacgtggtgttcgcatttggcgcccgcaccccgccggaggcgcgccgcctctttcggcttgacccgcgatcaggccgcctcaccctggccgggcccgtggactacgagcgtcaggacacctacgagctggacgtgcgggcgcaggaccgcggacccgggccccgcgctgccacctgcaaggtcatcgtgcgcatccgagacgtcaatgacaacgcacccgacatcgccatcaccccgctggccgccccaggcgcgccggcaacctcacccttcgccgctgccgccgccgccgctgcactcgggggagcggacgctagctcgccggcgggagccgggacgccggaggctggtgccacttcgctggtgccggagggggcggcgcgcgagagcctggtggccctggtcagcacctcggacagggactcgggcgccaacgggcaagtgcgctgcgccctctatgggcacgagcacttccggctgcagccggcctacgcgggcagctacctggtggtgaccgcggcgtcgctggaccgcgaacgcatcgccgagtacaacttgacgctggtggccgaggatcgcggcgcgcccccgctgcgcacagtgcggccctacacggtgcgtgtgggcgacgagaacgacaacgcgccgctcttcacgcggccggtctatgaggtgtcggtgcgcgagaacaacccgccaggcgcctacctggccacggtggccgcccgcgaccgggacctgggccgcaacggccaggtcacctaccggctgctggaggccgaggtgggccgcgccgggggcgccgtgtccacttatgtctcggtggacccagctaccggagccatctacgcgctgcgcagcttcgactatgagacgctgcgccaactcgacgttcgcatccaagctagcgacggcggctcccctcagctttccagcagcgccctagtgcaagtgcgcgtgctggaccagaacgaccatgcgccagtcctggtgcacccggcgccagccaatggctccctagaagtggcggtgcctgggcgcaccgcaaaggacacggttgtggcccgtgtgcaggcccgggatgcagacgagggagccaacggggagctggcgttcgagctgcagcagcaggagccgcgcgaagccttcgccatcggccgccgcacgggggagatactgctcaccggcgacctctcgcaggagccacccggtcgcgtgttcagggcgctcctggtcatatccgacggcggccgtcccccgctcaccaccaccgcaactgtcagcttcgtggtaacagcagggggcgggcgtgggccggctgcgcctgccagtgcaggaagcccggagcgttcccgcccgcctggctctcggctcggggtgtccgggtcggtgctgcaatgggacacgccgctgatcgtcatcatcgtgctggccgggagctgcacgctgctgctggccgccatcatcgccatcgccaccacctgcaaccgccgcaagaaggagccctacggtgcctccccgggttttggaaaggagccggcgccccctgtggcggtgtggaaaggacactccttcaacaccatttctggcagagaagcagagaagttcagcggcaaagacagcggtaaaggggacagtgatttcaacgacagcgattccgacatcagcggggacgctctgaaaaaggatctcatcaaccacatgcagagtggactgtgggcgtgcaccgctgagtgtaagatcctgggccactctgaccgctgctggagcccatcctgcagcgggcccaacgcacatccatcgcctcacccaccagcccagatgtcaaccttctgtaagagcacgtcactgcctcgggatcctctgcgcagggacaattactaccaggcccagctgcccaagacagtggggctgcagagcgtctatgagaaagtactgcacagagactatgacaggacagtcactctgctctcccctccccgtccagggaggctcccagacctgcaggagattggagtacccctctaccagtcccctcctggcaggtacctgtccccgaagaagggagccaatgaaaatgtgtaatcccatgctgcatgtcttcacacatatacaggtcactccgagaagcccctaagttattgaccggtttcagtgttgtatatataaatatgcaagatgtgccttacaatgaagttgttggaagctatttccaatcacattggtactgtttggtatttgcaaacaaaaatgtagttaatgtaatttttatgaaatgtgtgcagtatttaatttttcttatgctattgactttgatttcaattgcggcttgccattttcttagtgtttttaacctgtacattgtgtaatgtaatgtttgtatataatgaaattttgttatatttttatataataaaagctaaagtggaagttattgccaaaggaactgtctgtaagacaaaaaacaaaacatgttggaattacttaattgaaatttatctttcacctgaaacaacctagtgtttgagaaattttgccttgccaagtataacttgtatatcttgactctgtggtagatttcaagttcaatgttatttaattacatttggttttccgtaaaccgtgtcacttataagcacagtaataaaagatttgtcatgtgtttgaagaaaaaaaaaaaaaaaaaaaaaaaaaaaaaaaaaaaaaaaaaaaaaaaaaaaaaaaaaaaaaaaaaaaaaaaaaaaa

SEQ ID NO: 53337 - DNA, 2571 bp, Homo sapiens
tttgaaggggctttggtggtgttcacagctgcctctttggcacctcctcccaagccggagtcaaggaggcccctgagccttggaccagccactgccacctccgacctgctcggccagaagctgcccagggacaaagcagagtgcaggtcatttatcttcaggctttgagatctgcgtggggggagctgttgcagcagcccaagccgcaggaattgctgagacaggatggcctggcaggggctggtcctggctgcctgcctcctcatgttcccctccaccacagcggactgcctgtcgcggtgctccttgtgtgctgtaaagacccaggatggtcccaaacctatcaatcccctgatttgctccctgcaatgccaggctgccctgctgccctctgaggaatgggagagatgccagagctttctgtcttttttcaccccctccacccttgggctcaatgacaaggaggacttggggagcaagtcggttggggaagggccctacagtgagctggccaagctctctgggtcattcctgaaggagctggagaaaagcaagtttctcccaagtatctcaacaaaggagaacactctgagcaagagcctggaggagaagctcaggggtctctctgacgggtttagggagggagcagagtctgagctgatgagggatgcccagctgaacgatggtgccatggagactggcacactctatctcgctgaggaggaccccaaggagcaggtcaaacgctatgggggctttttgcgcaaataccccaagaggagctcagaggtggctggggagggggacggggatagcatgggccatgaggacctgtacaaacgctatgggggcttcttgcggcgcattcgtcccaagctcaagtgggacaaccagaagcgctatggcggttttctccggcgccagttcaaggtggtgactcggtctcaggaagatccgaatgcttactctggagagctttttgatgcataagcacctcttttcatggagtagagtcaggagaaacccctgacaccttttcaggttggagtgcattcattcatcctcttatatgtgccccttccccatgctcagctcagcattgtgtacaaaatatccaagcccagcctatctctcttctgcgtgggagtatgttatttctctggggtctgtgatggggaagggtggatgtcccttccccacaataggcttagtgcttggctcagacacctagactctaaaactatcagcagcggcagcagcagcagcagcagcagtttgtgatctgtccttccaacctgttcacgtgactcctcaattccagggaaccagagcgatgtgttctttgtacctgtaggtctatgatgtccaaacttaacagatcacatgcccctcttagaagaaatatgagcatgctccctcatgcagatagtatacacatcataaacaaagagtagaactttaaaagaaggtaaataatcatacacagaaatcctaacattatattcccaaatctcaaaagatctcctgtgcacctgactttggagacgatgctttaggtaaaaagcttaaacattgccttatattggatcaggaacccttacagtagagggtccagtcttctagtgggtttaatgtttagtcagtgtactctgagtcctcattgttcagaaaagcacctcttgaagaactgacttcctgaactcccagtcatgttggtaccctggacagtgcctaactccttacagaagggagtgaaaacctctttcggaaatgattgagagcagcctcttgaatgcttaaatgatcaaggagggagaaaggcaaaccaatttgttctgtgcaacaaactcaaaatgtggaccagttccctcagccctcattaaactaattaaactgatgggtatcatgcttctactccatggtgaactgaagcagagtcaagctgatgaagttaagcacaaccatgttcttgagcagctgaattggctgccaagagtccaagccatctggcccaacatacgcactgggcattgggtaagggactccagaagcagcagctagaaagagaaaaagccctcttcaatccccataatgcttctttcctcttaatgtctcaaaataaaaccagaaagaggaataaaatgattaagtgcttgaggccaaatgagttcccttgattcaaataaccctgaatcagaggcagagacctcctgatgtcttggtttccatcaaagccctccctgtctgtctgtctctcttttgctctctcattcccaggcactctcttttggtttgtgggtccaggagatgaggctggataggagaggaaaaggcttgagtctggataatttgtataagatgctgctgagcacatctcttcatgcgcagtccccaggtatctgatgatgttctgaaatggatagattgttttagagttattttgtgtcctttaaaaaaatcccatttatgcaatttacttggaatttgcttagcctttaataggcttgtgtaatttcctgctcctccagtacaataaataaaagaaagatgctgatgaaaaaaaaaaaaaaa

SEQ ID NO: 53338 - DNA, 3745 bp, Homo sapiens
cgctgccctttttctcctggccgggtgcgagggagcatgcccgcgcctggcctcggccagcgaagagttaacctgaggggcgagccgctgcccccacctcgggggcgtgcccccctcccccgctaggcggcccgccccccgcgccagggtatggcccctggccccggcccgggacccgaggtcccgcgcccgggtcagtgaaaggcgtcttcccgttcccgccctccgcctcctctcgccggccagcaacatgggatgtaatatgtgcgtggtccagaaaccggaggagcagtacaaagtgatgctgcaggtgaacgggaaggagctctccaagctgtctcaggagcaaactctgcaggccctgcgctcctccaaggagcccctggtgatccaggtgctgagacgcagcccccgcctccggggggacagctcctgtcacgacctgcagctggtggacagtggcactcagaccgacatcaccttcgagcatatcatggcgctgggcaagctgcgtccgcccaccccgcccatggtcatcctggagccccccccaatcagccatgagtattatgacccggcggagtttatggagggcggcccgcaggaggcagaccgcttggatgagctggagtatgaggaggtggagctgtataaaagcagccaccgggacaagctgggcctgatggtttgctaccgcacggacgacgaggaggacctgggcatttatgtcggagaggtaaatcccaacagcattgcagccaaagacggccggatccgtgagggagaccgcatcatccagattaacggtgtagacgtccagaaccgggaagaggcggtggccatcctgagccaggaagagaacaccaacatctccctgctggtggcccgacctgagagtcagctggcgaaaaggtggaaggacagcgaccgggatgacttcctggatgactttggctctgagaatgagggggagctgcgtgctcgtaaactgaaatcaccccctgcccagcagcccggaaacgaagaggagaagggggctcccgatgccggcccaggcctgagcaacagccaggagctggacagcggggtgggccggactgacgagagcacccggaacgaagagagctctgagcacgacctgctgggggacgaacccccgagctccaccaacaccccgggaagcctgcgcaagtttggcctgcaaggggacgccctgcagagccgggacttccatttcagcatggactctctgctggccgagggggcggggctgggagggggcgacgtcccgggcctcacggatgaggagtatgagcgctaccgtgagctcctggagatcaagtgccacctggagaacggcaaccagctgggcctcctctttccccgggcctccggaggcaacagcgccctggacgtcaaccgcaacgagagcctgggccacgagatggccatgctggaggaggagctaaggcacctggaattcaagtgccgcaacatactgcgggcgcagaagatgcagcagctgcgtgagcgctgcatgaaggcctggctgctggaggaggagagcctctacgacctggcggccagcgagcccaagaagcacgagctgtccgacatctccgagctgcccgagaagtcggacaaggacagcaccagcgcctacaacactggggagagctgccgcagcaccccgctgcttgtggagcccctgcccgagagccccctgcggcgggccatggccggcaactccaacttgaaccggacccctcccggccccgctgttgccacccccgccaaggcagctcctccaccggggagccccgccaagttccggtccctctcccgggatcctgaggccggccggaggcagcacgcggaggagcgcggccgccgcaaccccaagacggggttgaccctggagcgtgtgggccctgaaagcagcccttacctctcgcggcgccaccgcggccagggccaggagggcgagcactaccacagctgcgtgcagctggccccgacgcgaggcctggaggagctgggccacggccccctgagcttggccggtggccctcgggtgggcggggtggcggccgcggccactgaagcaccgcgcatggagtggaaagtgaaggtgcgcagcgacggaacccgctacgtggccaagcggcccgtgcgagatcggctgctgaaagcccgtgccctgaagatccgggaggagcgcagcggtatgacgaccgacgacgacgcggtgagcgagatgaagatgggccgctactggagcaaggaggagcggaagcagcacctgatccgggcccgtgagcagcggaagcggcgcgagttcatgatgcagagccggctggagtgcctgcgggagcagcagaatggcgacagcaagcccgagctcaacatcattgccctgagccaccgcaaaaccatgaagaagcggaacaagaagatcctggacaactggatcaccatccaggagatgctggcccacggcgcgcgctccgccgatggcaagcgggtctacaaccctcttctctcagtcaccaccgtgtgagctgcccgggcgggtacacggcccaggcccagggaaccccctggggccccggccctcactctcctatagagattgtgtgtgtgtgtgtgtgcgcgcgcgcgtgctcgctgtgcgcacgcacacatctcctcgtctgggtgtgcgcacagggctttgttagcagagagaagcccctgaggagaagggacgcttttcttccttctgcccaagtaaagtgaccatgccagtggccagcactgggggcacacctgtgatgggcaccccttcagctgtgcgtgtgcattccccatcccccatgctcttgcgtgtgcttgcacgtgcacgcacacacacacccagtgctctctccacccgacccgtgtacttgcagacagggaagctgagctgaaaggagcacaagagagtgtccggcttcgctgctgagcgcggcctctccccgccgctgcgcactgcagttatttgtagacaaaggcacccctgatttttgtggtttttctccctttctgtgcttgccaatagttgttttgttttgtggacctgccctgggggctggcagctccttcaggcagcctggcagaagtggaactcccctctccactgatggctgggaagggagttggggaggaagagtgggagggagggctggggatggatgggagggaaggggagggaaaggtgggaggaatgggaagcagctgttctggtggcttccactctgaggtgtgggaacggggagcctctggggggcacctgtttccccagtgactcagagagagcaagactgcaggaacggaggggtcctgcagggtgtccaccaagaagtcacagagcccgttctgcgccccacaccatctggagcaggggcttctcttctgagtgaactgaggaaggtgcttagatggtgagggctctagaaaccaagccccatgagcagcagtggaagacctcgggccatgcggcctggggaggacttggtggcgatccgcaacctggaccccagtgagaggcggtgggctgactgggaaggagaggcccccaacctcctcaggatttgcacgtgtgaactacgctgcctgtggggtgccccttaggcttggagagccccagattggaggcagacagactgcaccaccccttccccccctgcatctcaagaataaagcaagctgcctttgtacttggttg

SEQ ID NO: 53339 - DNA, 8519 bp, Homo sapiens
cggcggcggagccaggacccagacatctgggactgttgttctctcgcggcgcgaccgcctcagtcacttcgcccagagacccggacctggtccgctggggagcaggcggccataaaccccctctctcccggttccctgacgccgcggcaggagctgttacaaacaccctgcggttggtctccgatgcccttcagtgaggtggggacgcctggaccctggtgagcgaaccccaagccaccccccaccccaactcagtgtcttcgccggcccccggcccgtacgcctgtctggtcgccatggctgaaaacacagagggggatctgaactccaacctgctccacgccccctaccacaccggggaccctcagctggacacggccatcgggcagtggctccgctgggataagaatcccaaaacaaaagagcagattgaaaacctgttacggaatgggatgaacaaggagctgcgagatcgtctttgttgccgaatgacttttgggactgcaggacttcgttctgccatgggggcagggttttgctatattaatgaccttacagtaatacagtcaacacaggggatgtacaaataccttgagagatgtttctcagacttcaagcagagaggctttgtggttgggtatgacactcggggtcaagtaactagcagctgcagcagccagaggcttgctaaactcactgctgcagtcttgctggccaaagatgttcctgtgtaccttttttcaagatatgttcctacaccttttgtaccatatgcagttcagaagctcaaagcagttgcaggtgtgatgattactgcctctcacaaccgcaaggaagacaatggatacaaggtttactgggaaactggtgctcagatcacatctcctcatgataaagaaattctaaaatgtatagaagaatgtgtggaaccctggaatggttcctggaatgataatttagtggataccagcccgctgaagagagaccctctgcaggacatttgcaggagatacatggaagatctgaaaaagatctgtttttacagggagttaaactcgaagaccaccttgaaatttgtgcacacatcttttcatggggtcggacatgactatgtgcagttggcttttaaagtgtttggttttaagcctccaattccagtaccagaacaaaaagatcctgatccagacttttctaccgttaaatgtccaaatcctgaagaaggagaatctgtgctggaactttccttgagactggcagagaaagaaaatgcccgggtagtgctagccacagatcctgatgcagacagactggcagcagcagaacttcaggagaatggttgttggaaagttttcacagggaatgagttggcagctttgtttggatggtggatgtttgattgctggaagaaaaataaatcaagaaatgctgatgtgaagaacgtttatatgttagccaccacagtctcttctaaaattctgaaggcaattgcacttaaagaaggatttcattttgaagaaacattaccaggttttaaatggattggaagtaggataatagacctcctggaaaatgggaaagaagtcctttttgcatttgaagagtctattggttttctctgtggaacttcagttttggataaagatggggtgagtgcagctgttgtggttgctgagatggcatcttacctggaaaccatgaatataacattgaaacagcaactggttaaggtttatgaaaaatatggttatcatatttcaaaaacttcctatttcttgtgttatgaaccacctaccatcaaaagtatatttgaaaggcttcgtaattttgattctccaaaagaatatccaaaattttgtggaacatttgctatattgcatgtacgggacgttaccactggatatgacagtagccagcctaataagaaatcagtgctgcctgtgagtaaaaacagccaaatgattacatttacttttcaaaatggctgtgttgctacccttcggacaagtggaacagaaccaaagataaagtattatgcagagatgtgtgcgtcacctgaccagagtgacactgctttactggaggaagaactgaagaaactcattgatgctctgatagagaattttcttcagcctagtaagaatggactgatctggcgttctgtttaggggtacaccaatatgtcatgacactgtgtgggcatatggaacagagcaaccgagaactgcatacattgaaccttgtgttagcattctctctctatctcatctggccgagtatctttttccttttattttctttctttttggtcaactggctagactaaacaaagtataagtttgaaatgaaatggtctagagggaaatgattcaaattttttcataattcaaacaaaagttattacactaaaagtattatagtaacgtattgtccttccgttaacagaaacatcacaattcaaaagtgagttttcttattatagtgtgattaagcctagttctgtatctcgtaattgtgtatagcatggtaaaagaaaaaaaaaaagacaggtaaatgttatataattgtagggttagttaaggaaattagtccataaaattggcaagaaaatggtactttccttgattgttatgaaaaagtgtcattgtgacatcacaggtattaatttacaaattagagtatttgaaataggatatttagcatttctgtagtttagaacagatgttacagtgtgtggttttggcatgtctgtttcaggtgcccttggtgcagtataaatttactgtatgtatttaaaattctgatgtttactgaacataaaacaatagtggcaacactcctattggctttgttcttatcaaatttctcagtgccttctcagggtctggtatgaacagaaaaaacagtgttcctgcatttaccataatttaatcagtcaatttgcagatagctaaggaaaatcttccaaaatctgtaggtgcttcctctatatcaagtgagtttgctgattttaaaatcttaggaatataaataaagatcttaataaaagcaagcttaatgtagttaaggatcttcatattagaattgtgtcatttatcaaaccttttattacagaaaaaaatctgaactgagaaaggagctctgaatttatttgacagtctaacttttgaattacatttttgtaagtagatttattcttttattttatgaagtaatgttaattttactaagaataaaacatccaaattttaagtattatgaaatactaaaactacatgttttaaaacagaggtccagtttattctaacatcttgctgacttctgtagaatttctgattgcatgactattatttatcttcttttagtgtagaaaataattttttacaaaaagtcacttttgggctgggcgcagtggctcacgcctgtaatcccagcactttgggaggctgaggcaggtggatcacaatgtcaggagtttgagactagcctggccaatatggtgaaaccctgtctctactaaaaatacaaaaattagccgggtgtggtggtgggcacctgtagtcccagctactcgggaggctgaggcaggagaattgcttgaacctaggaggctgagattgcagtgagccgaaatcacgccactacactccagcctgggcaacagagggagactccatctcaaaaaaaaaaaaagtcacttttggctaatcatgcagtcttctgaaaaggtttaatagagaaatgctgtttaggctgggcttggtggctcacatctgtaataccagcgctttgggaggctgaggcaggaggattgcttgaggccaggagtttaagttacagaactatgatcacactgccgcactgaagcctggatgacagagtgagaccttatctcaaaaaaaaaaaaaaaaagagagagagagagaaaaagaaatgctgtgtttaatcttcttaaaatgtatcttgtcctacatagttctcagaatacatatggggtatagttaggagataacaataacaagacctaaacaaattgcttatgggagatagcactgtaattagagaatttatttcatataaaataataatataaagtttgaactgattagaatgttccttaaatcatggtttcgtttgttgcagctgtcagctaacatttggttgagctcatataatccaaacctaattgtccaactattgtattgccactattgttaatttgttccttccttactttcttattgttggatcttatatgactgtatgactgtagataatagacagctagctaaatgtagagcaccatttttctcaatgagtttgttttcaaaggctttgcactggagaagatatgtgtagaatttttgttttatttttaaaatgtgtaaaacatcttttgttttatatgcttttaagaatgtagattgtaatttaggaaatggcatatattctgcaaagtggtataatgttgtatatatgaaaaacaggtatatttggtttagttctgtgtttcagtgactgataaacaaaaatgaagctaaaatgaatcaacggctcattcatagttactaaagccatgtcatgactgtcattctattatgaagaaaacagttttatttgagtgctttaatataatgcaacatttaagtcatcttaaggtgaaaagttattgaagtgttcttctctcaagttaacaaaattttacaaatgttcctgaagtgtatcgattgagggaattattttattctagcctgtcatgagtctgtctgagcatgatacttaacatgaacttgatgtagtaggtgcacatttgcctaacaggataaattcagtgatagcccaagctggtcaggagagacagaagtgctggctaggaggtctcagcctcgggcactacaatgtttatctttttctttttgaacaatattgtgaaaatgattgcattctcattgagcatgaaagtcaaaactggaattttctaaagctttggagaaaaggagagaattagtagggcaagatcaaagcatacattggaaataaacagtagaaataagcaaacaatataaagagacacgggaaatgcttctcgtgaagggcaaatgtaacaccataacagtagggaataaactgtgtcccacctgtttacttgtgtttatttgttgttatgatgagtatgcacctaccattttcctttattgtgatcactaaaatgaggccaaggtttaggaggtgagaaaaagtatcccttttacggattcagttcctgctaggatgttgtatcagaatcatgtgagaactcaggaagaggtagagcagaaataaaaaggaagaaaatgtagattagaaaataagacttctgagaaaaagttcaaggaataaagattgtttgactctggagaggagaaagctgttgagatagtttgctaagtttgctaataaagctttattgagtcttttattgaagggttcaaagtaagaaatactatgccatagtgttctccatctctagtgaagacagaaccagagggaataaggatcttttttttaaagacagcatggaaagtttaagatttaggaacttcttgagaaatcttcataatatcttctattcaaaatcttttttttatttttaagggaataaaaattttaaaaattaagagatatacagatgactttttaagggtccttctttccagcacattttttttaaaaactcaggttagaataaaaatgtcataaagggcactaaaagtaacatttgggtttcactccatatctagaagaatttagctcacaaaacaatttttgtgtgttttgagtaactgatgcataagtgcaatgaataattttcctgcttcactgttatttttaatttaacctggcaaattaagtgagacttgaacaaaattttgttcatcttgaagaatgtatagtggcttaggttatttgaggttttcgttttgaatatatatgttgttattttgatgtagatacgttagcagatggagaggttctaagagattggatactttggaatgtctttatataggaaatagacctcccatttcttaagcaagttgcttctggaattgatgcaacagggatattagctgtagtttaatggataagttgttctatgagctgctgctatcagtacttttttccacattttccattgatatttgtgatgcttgaaaaatccaaacttcacttggatacatttaattttatgcctttttctctctacctcccacttttcctaggcacccttgcacattttgttactgtgaaggactattgccctgttacctcactgataagaaatctcaactgtattcattcagaatgctttaagcttagtcataaactacatttgcctatggacctttggttattttgttaatgttgtcattatatttaagacttattgtaggaagtaattttaaatctatttcataacctgttttgatctgtctgcatactgctatatgttaatttattacggccttttacaattcacttgtcatctgagattgttctagaaactgatgaggaaagagtcgtactaaccaaaatgaatgggcaattgacataacattctatttcaggtttccttgtacttggggagccaaagcacaagatctaaggaaatcttattcacatttgtccctcagagcatcttaccctaagccatagaggtataaatagtaagatgagaattgctcattgtctgactccttgcacagcatgaatttaattctagttggaaacaaagttagtgttgactactggttaccttaaagtattcaccatactatatatttattagaccatctttcctctttgtttattcaagactatgtacttataaaagagaacctataagaatgtgtagagtgaccaaatagggacaaagtgacatacctagagtttgctgctcaaatttttccactagcgtaaccctaaagcagaggggcatgatgaagggggaaggggttctgagagcaaaatcagaatcagcctaccactgacatgaagtgtgttctgtctttaaaatgtaagtgaattttgcattctttataataaaacttttaatataaaaatgatatgtttaatctttactgaaacttatgccaccacaaaggagcaccatgttcatcacgtggctgctcagttttctcccccagtgccctcacccccagtggaggcaagtccttgagctacacacactggctgtagtgcaagatatataaacataggccgggctcggtggctcatgcctgtaatcctagcactttgggaggccgaagcaggtggatcatctgaggtcgggagattgagactagcctgaccgacatggagaaaccctgtgtccactaaaaatacaaaattagccgggtgtggtggcacatgcctgtaatcccagctactcgggaggctgaggcaggagaatcacttgaacccaggaggtggaggttgtggtgagccaagatcgcgccgttgcactccagcctgggcaacaagagtgaaactccatctcaaaaaaaaaaaaaaaagatatataaacatagaacatatccagactatttcctgcccttggaatctgaccttcagaaggattaatgccaaactaaactgacctgaaacagttttgttactattggcattccttgactaaaaaggaccacctgatgctcagtcccgagagtaggaatcgtggtttattatttttcatatccataccacctagttcagtacctgttatagagtgtttaattgctgatactaggaattaagggattttttaaaagtagcaaatagtttaaggaacaatcaaaaaatgaattttctaattcagttttttcaatgaagtcccatcactgaactttataatgtaatgtttattaagcagacatccccttaaatactcagtttctttggagagagcaaagcatatctctctgtggaaattatatataatgcctggtattttacactcaaagcaaggtgttggccaggaaggtaaagaaatggtgtctatgtagacttaatatcactagtctaagtgtcattttgagcctagtagcactaccttccaagtgagtcacaacaaatttgatcctatttggtatgtttttgtccactgttatgattcatcatgtatcttacaagagccactcaagcaagactctgcttctatgtatggtgaggccttgttgttctaggctagaataaactctttgtatgcctcattgaatatgccaggtaaaatatatgcagtcaagaatgaattatttttctgactaaagtgtgtagcagtagttcaaaattgtgcccttgttttaacagtttctgtcaacatcttctcatttttccctacaaaaacaccagggtgtattataagtactgcctgtgagaatttgcactttatgtatttgtgtgtggatttcttgtggttttagccaaatgaagtgttatcagtaataaacaggtctcttcataggaaaaaaaaaaaaaaaaaa

SEQ ID NO: 53340 - DNA, 4788 bp, Homo sapiens
accgcccctagccccgcgctccggaagtgaagcggccagaccaccagctaatggatgcggagcggagggcccgctgaccgctctccgcgcctggagcagcttggcttggctggagctaagagccagacacaccactgtgtggaggtgggtgatgtcttcctgtgctaaaaggtgaataaataagctcctcacctctcgcggaacactcgggaacacatcaacaggggtccaagccgccctgctgggaggcttctcttcaagagttctgggtcccagagtggaaggcattttcccatcaactggagagagacgaaacatcagagaccaggaggctgtggagaaagcagctgtcccaggtgcctcaactatcagagaagggtcagcgtcacgtggctgccagcatctttgagaaaatcactggcaatcggacttcagagctgcgggcacaggtgtggttagaactgagatacgacctgcccacctgggtcaggcctaaagacaagaagtcctgagttcttgccactgagtaggccagggtcatttgtccagaaaactttgtgactgtctttgagtgacctagtctgggacccattcattggtgggttctaaggttagaagctcatccaggatattttcaatattaagtcagtgcatagctgcaccactaacaaattggtgcctgtagagtcagagtgggtcaattcttaggacaatggcgctggcactgttagaggactggtgcaggataatgagtgtggatgagcagaagtcactgatggttacggggataccggcggactttgaggaggctgagattcaggaggtccttcaggagactttaaagtctctgggcaggtatagactgcttggcaagatattccggaagcaggagaatgccaatgctgtcttactagagcttctggaagatactgatgtctcggccattcccagtgaggtccagggaaaggggggtgtctggaaggtgatctttaagacccctaatcaggacactgagtttcttgaaagattgaacctgtttctagaaaaagaggggcagacggtctcgggtatgtttcgagccctggggcaggagggcgtgtctccagccacagtgccctgcatctcaccagaattactggcccatttgttgggacaggcaatggcacatgcgcctcagcccctgctacccatgagataccggaaactgcgagtattctcagggagtgctgtcccagccccagaggaagagtcctttgaggtctggttggaacaggccacggagatagtcaaagagtggccagtaacagaggcagaaaagaaaaggtggctggcggaaagcctgcggggccctgccctggacctcatgcacatagtgcaggcagacaacccgtccatcagtgtagaagagtgtttggaggcctttaagcaagtgtttgggagcctagagagccgcaggacagcccaggtgaggtatctgaagacctatcaggaggaaggagagaaggtctcagcctatgtgttacggctagaaaccctgctccggagagcggtggagaaacgcgccatccctcggcgtattgcggaccaggtccgcctggagcaggtcatggctggggccactcttaaccagatgctgtggtgccggcttagggagctgaaggatcagggcccgccccccagcttccttgagctaatgaaggtaatacgggaagaagaggaggaagaggcctcctttgagaatgagagtatcgaagagccagaggaacgagatggctatggccgctggaatcatgagggagacgactgaaaaccacctgggggcaggacccacagccagtgggctaagacctttaaaaaatttttttctttaatgtatgggactgaaatcaaaccatgaaagccaattattgaccttccttccttccttccttccctcccttcctccttctctccttctctcctcctctctcctctcctctcctctctttccttccttccttccttttttctttttctctttcttctttatttcttgggtctcactctcatcacccaggctagagtgcagtggcacaaaaatctcggctcactgcagccttgacttcccaggctcaggctcaggtgatcctcacaccttagcctcccaagtacctgggactacaggcacgcaccaccatgcctagctattcttttgtatttttggtagagacagggttttgctgtgttgctcaggctggtctggaacccctaggctcaaatgatgtgcccaactcggcctcccaaagtgctgggattacaggcatgaaccgccatgcctggcccttgatttttctttttaagaaaaaaatatctaggagtttcttagaccctatgtagattattaatgaacaaaagattaaactccaaatattaaatagtaagcctgaaggaatctgaaacacttgtacttccaattttctttaaataatcccaaatagaccagaattggcccataccatagaagaaagaattggcagtcaaaaaaaaaaataccttttgtaatgtttgaaaaataaagctgtttgacttgtcaggtgttttcctttctcaaatcagcaaattctctctgagtgcctggctttgtgagacactgtacaaggagttacaagactacagctataacctgcagttgagcagttataaacctacaaaatgggccctgccctcagagaggttccagtctagatgaggagctgatctagacaggtaaaaggctaactaaccctttgtgtaaataagttcatcaccccagtaaaagtgtcatcacccagtgaataggaccacctctgcctgcagatttttgttgttgttgttgtcattgttgttgttgttttaacctgggaagtgttcttcctgcctttctgctaggtgtcagatagatggtcccagagctaggtgctgtgtcaggccctgaagacacagatgactcaacctaagctttactttccagaggtccacagcctgagaggtgtccccaaagaaagggggacatgaggggactgcatgcttgagagcagggttgtttagggcaggtttggatttagtgagcaggctggtttgcttagagaaggcttttagtggcaacaaaggatgaagaggagagaaaaggaactcacatttattgagggcctactgtgtgcaaagtgtttcatgtatatctcattgaatgtatacagccaccctgttgtggtataattttgctctttataaagagaaagaccgaagctcagatgagttaagtggtctcctcaacaccaaaatgccaagaagtgatggagcctagacagaagcccagaactttctgactcacactagtccatcctctaccatcacgatgactttcaaattgtgctctgcagttctgcagattttctagcagtgccatctccaaaatgtgttttaaactctttatttttttaattattattagtattattttgagactgagtcttgctctatcacccaggctggagtgcagtggtgcaatctcagctcactgcaacctctgcctcccaggttcaagcgatttcgtgcctcagcctcccgagtagctgggattacaggcacccaccaccacgcccagctaatttttgtatttttagtagaaatggggtttcaccatgttggccaggctggtctcgaactcctgacctcaagtgatccactcacctcggcctcccaaagtgctgggattacaggtgtgagccaccatgcctgggctaaactctttaagtctctagtaaatgcagctagattcaaatgggctgataaccaaattttaacacatcagcattcaccaccaggtttacttttattttcagattggctcattttgtgcagaccttagagcaaagtttcctttatggtatctgtgtacgtatccaaacttcttttaattgttcacagattttaaaagcggtagcaccacatggttgtgtagatcagacctgtgtatttagatcagacctgtgtatcacgtaagtgtgtgagtgcagtgcagatgagcaccatttagttatatgtgctaggcaaatctccaacacagttgatgtgtagtcttgtggtagatttgtgcatactgtaagcaaattgcttagcttctctagacatcagtttccacatctgaaaaataagaagatgagagtacacggttgttatgaacaaatgacttaatgctttttaagcacgttgcatgacatctggaacacagaaagccctcaatacattgaagctcttaggattttcacgatgttcctgtctgctcaatgcatgctttctttattgttctgacagttgtgtggtaacaagctaatatgcttccagttgacttccagtctaccctggtgttagaaaccgtttcatctcttattgtaaatttgagtgcttgttgttttttatatttgtgatgactcttccagcagttgttgacaattgttagaggtttgacttttaaataattacttattttttctgattgtggttcagtttaactgaagaatatcctgagattgtaagaaaagcattttttaaaaggtatcacttgtgatcatttatctttctaaattctatttttaatactgttccaccaaagtgatgcagtggttaccatgacaccctaatttcatgtgtttttgtatttatgaaaatagtttcattgtcatttattggcggtatacaaagtaaaatgttataaatgtgaagttataaaataaatatatgctaataaaatcctgagtttttctgattcct

SEQ ID NO: 53341 - DNA, 3530 bp, Homo sapiens
gaacgtccgcgctgggagccaggggtgcccgacccccgtccgccgccgccgccgccgccgcgcatagcccccggagagccctctggggaccccgaccagaagggaccttgccctgggagaaggctgtggagacctgggccttctgcgatcaccctaggagttgatccagatatgtgcctcacgccctgatcactccccccaaattagtatccgcagagattcgaggacatgccgttgaccttgttacaggactggtgtcggggggaacacctgaacacccggaggtgcatgctcatcctggggatccccgaggactgtggcgaggatgagtttgaggagacactccaggaggcttgcaggcacctgggcagatacagggtgattggcaggatgtttaggagggaggagaacgcccaggcgattctactggagctggcacaagatatcgactatgctttgctcccaagggaaataccaggaaagggggggccctgggaagtgattgtaaaaccccgtaactcagatggggaatttctcaacagactgaaccgcttcttagaggaggagaggcggaccgtgtcagatatgaaccgagtcctcgggtcggacaccaattgttcggctccaagagtgactatatcaccagagttctggacctgggcccagactctgggggcagcagtgcagcctctgctagaacaaatgttgtaccgagaactaagagtgttttctgggaacaccatatccatcccaggtgcactggcctttgatgcctggcttgagcacaccactgagatgctacagatgtggcaggtgcccgagggggaaaagaggcggaggctgatggaatgcttacggggccctgctctccaggtggtcagtgggctccgggccagcaatgcttccataactgtggaggagtgcctggctgccttgcagcaggtgttcggacctgtggagagccataaaattgcccaggtgaagttgtgtaaagcctatcaggaggcaggagagaaagtatctagctttgtgttacgtttggaacccctgctccaaagagctgtagaaaacaatgtggtatcacgtagaaacgtgaatcagactcgcctgaaacgagtcttaagtggggccacccttcctgacaaactccgagataagcttaagctgatgaaacagcgaaggaagcctcctggtttcctggccctggtgaagctcctgcgtgaggaggaggaatgggaggccactttaggtccagatagggagagtctggaggggctggaagtagccccaaggccacctgccaggatcactggggttggggcagtacctctccctgcctctggcaacagttttgatgcgaggccttcccagggctaccggcgccggaggggcagaggccaacaccgaaggggtggtgtggcaagggctggctctcgaggctcaagaaaacggaaacgccacacattctgctatagctgtggggaagacggccacatcagggtacagtgcatcaacccctccaacctgctcttggccaaggagacaaaagagatattggaaggaggggaaagagaagcccagacaaacagcagatgagttgagtggggcagagggacagggcagccagaccaaggccaagccttctcacccttggccagctggaagggacttcagcaaccaagaccacctggcaacaggctcagtgggggtcaggtccaggtccccgaagaggtgctggagaggaaagcagggagccactgcatccagcacatggggtgcctgggcctcagatggggaccccaaagaagcagaagctgaagaaggtacggctgggggttctgtcctgctcatccaaccacccctaaatacccaccctgtggactttgagctgaacatgcccactggcccccaggccacatgggacctggaggagcctacctggggcctgcccctgccagcaggtgccagggctggtgaggaagagctggggggcagaggtaaagccctgcaggggaggccacagggtccatcccgtcttcaggatcatctacactgcactaggggagccccaggaaggcagcaccctggaggccctgtgccagtgaggacaggagaccctaaggccccgggagcccagtgccagccagaggttgtgcaggcaaggagaccaaagattgatgagaagacccccagcaggggtactgggtacccggcaggccagtgccctcacagttgacttggaccagggtggctgtgaagggaagtctttgttgcaaaggaggaggaggaaaagggaggacttggtagggttttgtttcttctgcttgtttctgtacagggccaccagactcctggagagatcaagcaaggagaacctggggctgccatggccaaagcaactcaacagatgccaatgccaattccaaggccagccacaaccctgccaccttggggaatccagcctggaggcatcccctaagcagccagccatggcctgggtggaggcacctgaagacgtctgtcccaaactcccccagccctgagctgggagatgacagggggaaagaggccctctcaagggtgccagatgcctgggtctcccaagaggggtcccccaactcaccgttcccgggacaggctgccccctgttccaggaagctcatcctcacctgtgtaggcccctgtagtgacccacgcgtccagcagacgcccacccaccgctagccgttgttcctgtgcaaagtagtgtgctatgcacccacccaggtggccgcctctgggcccaaggcacatgctgtgagcttcctgtgagcccaggctctgctcactgctgtcccgcgtcatgagcaccacctctgctttccctgtgtagatctaggccagtggctgcttgttcttgtggagctgtgtgtgttcttctctgagcagctcctccccggagtcccccagcacagtcccaggagatgacaggaaggaagcaccagggcaaggcggacgctcaccctgtgaccacgatggtgaccgtgactgtgggaggaagaactggacccaggacggagcggggctgccctgcctgaggctcccgaggagctttgtgctttggtgttccacccctgttgttactcatgactcagtttccttgacctggtagggtgttccctgctgtgttttccagtgtcctgtgactgtcctgtgcgggccatagggcagggccctgtcccagcagatgggcttgggagggggctccctaaagccagtggacactgccagagtctaccttcctggcaagaggcagaccccggggccctcaggaaggagggagttggcagcgggggctgcagcaggagtaggagcagatgaggcgtcttgccaggaacctcaggaggagggggcccgggacctgtgtgggacctgtgtcctgtggtggccgtttgcagtttctctctgtgttgtgattcccttctcttcaacgttttcagtacgtgtttctcttcaataaacttcattcagtgttccaaaaaaaaaaaaaa

SEQ ID NO: 53342 - DNA, 4172 bp, Homo sapiens
agtaatagcaggagcagcaacagaaggcgtcggagcgggcgtcggagctgcccgctgtgggagagagaggagacagaaagagcgagcgaggagagggagcccgaggcgaaaaagtaactgtcaaatgcgcggctcctttaaccggagcgctcagtccggctccgagagtcatggcgaccgcagcgtctaaccactacagcctgctcacctccagcgcctccatcgtgcacgccgagccgcccggcggcatgcagcagggcgcggggggctaccgcgaagcgcagagcctggtgcagggcgactacggcgctctgcagagcaacggacacccgctcagccacgctcaccagtggatcaccgcgctgtcccacggcggcggcggcgggggcggtggcggcggcggggggggcgggggcggcggcgggggcggcggcgacggctccccgtggtccaccagccccctgggccagccggacatcaagccctcggtggtggtgcagcagggcggccgcggagacgagctgcacgggccaggcgccctgcagcagcagcatcagcagcagcaacagcaacagcagcagcaacagcagcaacagcagcagcagcagcagcaacagcggccgccgcatctggtgcaccacgccgctaaccaccacccgggacccggggcatggcggagcgcggcggctgcagcgcacctcccaccctccatgggagcgtccaacggcggcttgctctactcgcagcccagcttcacggtgaacggcatgctgggcgccggcgggcagccggccgggctgcaccaccacggcctgcgggacgcgcacgacgagccacaccatgccgaccaccacccgcacccgcactcgcacccacaccagcagccgccgcccccgccgcccccgcagggtccgcctggccacccaggcgcgcaccacgacccgcactcggacgaggacacgccgacctcggacgacctggagcagttcgccaagcagttcaagcagcggcggatcaaactgggatttacccaagcggacgtggggctggctctgggcaccctgtatggcaacgtgttctcgcagaccaccatctgcaggtttgaggccctgcagctgagcttcaagaacatgtgcaagctgaagcctttgttgaacaagtggttggaggaggcggactcgtcctcgggcagccccacgagcatagacaagatcgcagcgcaagggcgcaagcggaaaaagcggacctccatcgaggtgagcgtcaagggggctctggagagccatttcctcaaatgccccaagccctcggcccaggagatcacctccctcgcggacagcttacagctggagaaggaggtggtgagagtttggttttgtaacaggagacagaaagagaaaaggatgacccctcccggagggactctgccgggcgccgaggatgtgtacggggggagtagggacactccaccacaccacggggtgcagacgcccgtccagtgaactcgagctgggggaggggcagagcgcggggctccccctccccttcggtccttggccctttcccggccctcttgttccctctctaacttctgattgttcttttatttttaattattatttccccgtcccttaaaaagacaaaaaaaataaggcaaaaggaaagcaactaagacactggactatcctttaaaggtagcaggtgtaatgatgtgttttgacctttgcaggcgagtaaccaggcaatggagtggagtgtctcctggagagagtgaggagagtgtgtgatagctagaaagagagagagacagagagatggcaagcactgagataaatacctggcaaaactaaataaattaccaaaaaggaaaaaaaatccaccaaaccatgataaacacaaaatgcagcttcctgatgcttagagttggcacatgctgctgtgtttatttattgtggattcccatcaggaaagaggaaaaaatacacatgttctttcatataggcaaaatttaaccacataaatttgcactgcaagaaaattgaagtttacgtgaacaaattcatgagcatattttctctttctccccaccgttaatttgggagttgccgttttgggggattttgttttgctttgctttattcatcggagagagttgaagccagctcttggccactctccatttctaatgttcttgtgttgccccttcttcgtactgtttgtgaactttggttaccttcacattccccttacgagggtgtaacatctatttgttcctcttaccaaagcaaaaggattggcttcatacaaaatagacaattctctgatttcaggaaatgtgcatggtctacccgctttatcgaaggcaagaatccggtttggaatataaaaataagcattggttgttcttaccagccacaaagtaaacttcattttcaggcagtgtttctgggggaggttatggagggaagaaaaaagaaaaatcgatagtgagtgactgattgcttcattttatcaggcgggcccattgtgaaagagctcaggggaaatgtggaggttaaatatatttccagagttgtccagcagaaagaaagtggcactttgaagagaactagggaagtacatatcttcagatatccctatatagttctctaccttcagttttagtaacaattatgaagaattatttgtgctgacagcagcagttaaactttgtttctctaatagctttttttttacataaaaaaagacccaggaacttaatagtgtatgcataagactgtgttttttagcacacagatacccacagcatacactgacgatctccacgcagtagacaggttttgtcttcactagctcatttgtttatcaagtcatatttagggtcccacaccctcttttcctgtaatttattgcagaatacaccactttgacttggacagctttctgccccctctttcactaaggaaggcaaatgaagtgaaaaaaaaaaatgccattttcaatccttcctttctcccctttgttaatagttttaagtgaatttttgaccttatcttaatggaaaacggttaactccaaacacaaaagactctactggaaagtgtaggtgaaaaaacttgtaactgtattgaaaataaataccattaaactgtgatcagttaaaatttaaaagaaaaatcagcacaaaagggcgctaaaagggaaaacactttttattaatcttaaaagtttgggggtttttttccagttaggtattagataaatttttattttaaaaaatgaaagtctcactaccataaaattatggttcagcatcagattagcattgcactcagtagtctttaaggttttaggaaatatgctttatattgtcttttcaaacacctgtgattgtttcattttccatgtttttgcaagataaatggtgacttataatgggcatatttatttgcctgtatttcatttcccccaatgaatgtcacaaggagatgggcacggagctgcttcgggtgcatcacgctgctcgttcctgaggtatgggaactggcctttagtgaagctatccagagcagggcaaatagccactggtaaagggaggaaatgaatttccagatacttattaccaagtaggtaaggtcagaagctggagttcagagaatgtgtctacagcttctctgactcttataggtttactaagatgaaagttaccactgaaccttaccactatgtatatatgtttaatatctgtcttttgaaatgcagaaatagtttaaatgtttctttgtctatttttctttttttttaatgctacccagggaaatattttcatatcatttttaagtggcctgcctcaatgtatatttatttcttttgaaacaaaaaggttctggaaactgtttttctgtagctttaaatgaataggtgagcaaaatctatatgggatgtaatttttttgttcagtctcttaaaaaatactttgttttggtacatttggttgtgcttgtggggaaaataaaaacgcagagatccttatatatttatgttaaagtaatattttattatctacataaaacagaaatgcacaataaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 53343 - DNA, 6540 bp, Homo sapiens
tgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagctattcctgggcgagtttcgcggaccgtgcggcggcggcgagccggagccggaacccgaacccgaacccgaacccgaacccgagtccgagcccgagcccgaacctgaactggtagaagctgaggcggccgaggcttcggtagaggaacccggggaggaggcggccacggtagccgcgacggaggagggggaccaggagcaagacccggagcccgaggaggaggcggcggttgagggtgaggaggaggaggagggcgcggcgacggcggcggcagccccggggcactcggccgtgccgccgccgccgccccagctgccgcctttgcccccgctcccgcgaccgctgtcagagcgcatcacccgcgaggaggtggagggcgaaagcctggacctgtgcctgcagcagctctacaaatataattgcccttcctttttggctgctgctttagccagagccacatcagatgaagtccttcagagtgatctttctgcacattatatcccaaaggaaacggatggcacagaagggactgtggagattgagacagtgaaattggcccgttctgtcttcagcaaactacacgagatttgctgcagctgggtgaaagacttccccctccgcaggagaccccagctttattatgagacatcaatccatgccatcaaaaacatgcgcaggaaaatggaggacaaacatgtctgcattcctgactttaatatgctcttcaacctagaggaccaggaagaacaagcttactttgcagtgtttgatggccatgggggagtagatgctgctatttatgcctccattcacctccacgttaacttagtccgccaggagatgttcccccatgatcctgctgaggccctgtgcagggccttccgggtcactgatgagcggtttgtgcagaaagcagccagggagagcttaagatgtgggaccacaggagtggtgactttcatcagaggcaacatgctacatgtggcctgggtgggtgattcccaggttatgcttgtgagaaagggccaagctgttgaactaatgaagccacacaaaccagacagagaggatgaaaagcagagaattgaggcccttggaggttgcgtagtctggtttggtgcctggagggtgaatggaagtctgtcggtttccagagctattggagatgctgaacataagccatatatctgtggggatgcagattctgcctccactgttctggatgggaccgaagactacctcattctggcctgtgatggcttctatgacaccgtgaaccctgatgaggcagtgaaagttgtgtccgaccacctgaaagagaataatggagacagcagcatggttgcccacaaattagtggcatcagctcgtgatgctgggtcaagtgataacatcacggttattgtggtattcctgagggacatgaacaaagctgtaaatgttagtgaggaatcagattggacagagaactcttttcaaggagggcaagaagatggtggggatgataaggagaatcatggagagtgcaaacgcccttggcctcagcaccagtgctcagcaccagccgacctaggctatgatgggcgtgtggattcattcactgatagaactagcctgagcccagggtcccaaatcaacgtgctggaagacccaggctacctagatctcacacaaatagaagcaagcaaacctcacagtgcccagtttttgctaccagttgagatgtttggtcctggtgcaccaaagaaagcaaatcttattaatgagttaatgatggagaaaaaatcagttcagtcatcattgcctgaatggagtggtgctggagagtttcccactgctttcaatttgggttcaacaggggagcagatatacagaatgcagagcttgtctcctgtctgttcagggttggaaaatgaacagttcaaatccccgggaaacagagtttctagattgtctcatttacgccaccactactcaaagaagtggcacagattcaggtttaatccaaagttttattcatttctctctgctcaagagccttcccacaaaataggcactagcctgtcctcacttactggaagtgggaagagaaataggataagaagttctctgccatggaggcaaaatagttggaaagggtacagtgaaaacatgaggaagctcagaaagactcatgatattccatgcccagatcttccttggagctataaaatagaataatttttctttcaagtaggttagctagctctcccccaataaaaataccactatcagagtagaaacaaggtagacatttctaaaacatatgtgcttcattatgaatccatggatggctcaattcttaaatgtaaatagatctctaggaaactcaaagtacagtgttttcaatctaaaaagaagtattggcagtttcacttgcaaaattacacagctggtccctgtgatgtgtctcgacaccaatacacaacccccttcccaccatccttcatgtcactagatacacaacccccttcccaccatcccttcagtcactagtggaagctttcaagttagttatttcagtcaggatatacagtgttgaaatctcaatgcagttgaaatctggtctgatgtgcctaatttatctgtggaaaatttaatgctgaattacatttggttgggaaatgtccctcaaaatcctgggcactatgaaggaaccccctgccccctcacctttttgggtaggtaaaagactaaaagccatatggattttaactgataacaatgaaagtggtaaatcagtgtaaaagtgtcatattctcagacttgtgaggcggtttatagtcagaaagatttacggatttttttcctgtaacataaaagattgtgaactttttttaattaaaaaatatttcctagggctgtagttatttgggagtttcataacctgttatggtgcttttggtggaaatttttattatttagcattttaggagaccgctgtcaactggttttaatctatgatgctaatgtgttttccactgtaccctcatctcaggaataaaactgctttaacggagatgatgtcaggtacaaatacactatagagtcaaaataccatttacaaagaaaatcaaaagcatttctatattttgtctttttttagttcagacagcaaaggcatgtactactataaaatacaaagtgattttagagaatgaaaaatgctacttttatcttctctaaaattatttcccccaaggtagtgaagtaattggaatgaaggaggctgaaagtattgtctaaagtgagcccagaggccactgagaatgcagattactgacagccaggtctgtttagttgtaattggaagacacatgagtgtcctgcttacatgtagcttcagactgcagagacaggacgtgtgcttttcatttcaatatttagttatatttgatattttgaaactgtctgctttttgctatttctgcagtttcaagttagttagaagcatgttgtcaactaaagacaacaaactatcagattcattcattcagtgaagcagcctctgattctctaagagtcacgaatgtcttagtgttaccctcccctagtcaacagcagaccagcctggccaatgcctatgggtggcccctctggagtgctcactaacaagggtgagtgctctcgctaagaagtgtcccccgcctaatcatgtgtttataggatagtacacgttccccaggcccataacagaggactaaaatctctgaattttaaagacacagatgactggcatattttggataccagtatagctatatcaaatagacaaaaacagcttcactttagcaatgatcagattgttaatctacagattttattttttaaaatttggatgtaagtagagactttcagtatttgttttctcttgattttgaagtcatttcttcttctcacgtctgtgacaaatggttgaaaaggagtcaacatggccccaactatagtgccggaaccttttcatcattctgaggctttgccccacacatggtcctcactcatatctgtcaccttctgaagcctagatcttgttaacccatcaggtgcagtgtcagtttcaaatcaaattatctaagaaaacaagaaaacaaaggcagcagactattggtacacattatagtccaaagtgcttagcgaagtaaaaaaaaaagctttttaaaatttctattgttgtctattggtaatgtttttgatcagaataaagagggtaaagggaaaaagttactacacatgctaggctttctcagtggggaaaaaaatggctggatagaactgggacaaacacagacccatctttaggggtctggattttgtaggtccgactacacagcagtgttaactcatttctcatgccattagctctctacaaaataaagcaaagtagttctagtgtggtcgttataaaccaatattgtgaaaaatagcaactattcatttgttcacaacatgcgtatttatagagtagttaggtaccatttgtaaggtaaatcctttaaaattctataatacatactaaaatagtggttattggtctgatatatgctgctcttggttctataaactagataaaagcagtgctttgtgaaatgcagtgttctctcttaacgccactggtgataggaagtagttcccttcagttcaaatcctgtgcccttatttgctgcttgctgacgtaagcaataagtaaccctctaactaatggtatctacatatttctgtaacttgtatttaatgatggtgtacctggtgattgtaaaaatattagacagatataaaagtatctatataatatctataaactgttaatgctgaggtatagtctgtgaattatgtgttttgtatttttattcattgtgtaatttagtggtggtgaaagttctacactcaatccttaaagagtggcagtatccctttttcaatttaacatggtctgcatcaatctgtttgcctgctaaacaagttagaataggaaatagtaaaataaatccaaacaagagtgtaatattggttagggaaacaaacttcaggtcaccaactgaagtcattacaaactccttgtacattcactgtgagtttcaaagggagtcagtccctaatttacaggtttcctttgttcactttctagatgtgtacttttgagggacatgaggttaggcaacattacagcaacacacactggggctattaatcccatttaggtctgtactaaagaggatgggtagaaacacatatgtatataccttttctttacctagaagtgccatccattgtccttgaattattatgattaaagttactgttgcatttaggaggctccttgaaagtaacaccttttccaaggacaatggcaacaatgtcaatgtcaacactgagtctaattttgaccacatttatagtggtatagtgtcaatactgcattttcatgacaaccacactccactgttgaaacactgtgccagtgagaagtgcaacatccagtgggcagatgaaaatgatgcatggccaagttcagtgtttacagataaaactgctgtggttcaagtgcttccttccccatcaaatccttgataaggctttgtgggaaaatgatctaaattattgttttaatttttaaacctaatttattcactcagtgaacattcttacctaagcaaggctataaaagggaatactacagttttgtccacactttaatttgagaccatttttctttgaatcgtaagttagcaaaagaaatttttttcacctttgaaaatcacgtgatgttaaaggacaaatgcccactcttctattctgatctgcaaatagcttaaatgtctcttgcaaaacaaagtaagataccaccagtattacaacacaatgattttccagacaaatggtatggtgttgaaaaataactgttacttcttaaagcagcattttatcttctattttgaagactatttattgtaataattagaaaacatgaaatagggaactccagactgacacagcagttgtttttgaaaaggaaataaactttgatgaattagataatccagatacatcattgtaaactcttactctaggtgctctttggtgagagacaggctttgttctcttgttcataacatttctctgcaaagaattctctatggagtgaagcgaatgaagtgaataatttcttaccaaataaatttatcaatttacaaatctgctctacatctcacttttgagttcagttgtagtcatgagtgatccttcatattttattaaaagtgttcattcaggtaaggtgtatgttgaaattttgccaattatcttaataaaacctggcaatttaaaaa

SEQ ID NO: 53344 - DNA, 2357 bp, Homo sapiens
gaggagacgcgctttgtgctgggcgccggccgcgccagccacggcctgcggcgcccgcggcaccatgatctccaccaaggagaagaacaagatcccgaaggacagcatgacgcttctgccctgcttctacttcgtggagctgcccatagtggcttcttccatcgtatccttgtacttcctggagctgaccgacctcttcaagccggccaaggtgggcttccagtgctatgaccgcactctctccatgccctacgtggagaccaacgaggagctcatcccgctgctgatgctgctcagcttggccttcgcggcccctgccgcctcgatcatggtggccgagggcatgttgtactgtctgcagtcccggctgtggggccgtgccggggggcccgccggggcggagggcagcatcaacgccggcggctgcaacttcaactccttcctgcggcgtacggtgcggtttgtgggtgtccacgtgttcggcctgtgtgccacagccctggtgacggacgtgatccagctggccacgggttaccacactcccttcttcctcaccgtctgcaagcccaactacactctcctgggcacgtcctgcgaggtcaacccctacatcacgcaggacatctgctccggccacgacatccacgccatcctgtctgcacggaagaccttcccgtcccagcacgccacgctgtcagccttcgccgcggtctatgtgtcggtgagtccggcacctcactgcccttcccaggccctcttgctgacccgtggggagccctccctgaccccaacccccatgccccagatgtacttcaactcggtcatctcggacaccaccaagctgctgaagcccatcctggtcttcgcctttgccatcgccgcgggcgtatgcgggctcacgcagatcacgcagtaccgcagccaccctgtggacgtgtatgccggcttcctcatcggggcgggcatcgctgcctacctggcctgccacgcggtgggcaacttccaggccccacctgcagagaagcccgcggccccggcccccgccaaggacgcgctgcgggccctgacgcagcggggccacgactcggtttatcagcagaataagtcggtgagcaccgacgagctggggcccccagggcggctggagggcgcgccccggcccgtggcccgcgagaagacctcgctgggcagcctgaagcgcgccagcgtggacgtggacctgctggccccgcgcagccccatggccaaggagaacatggtgaccttcagccacacgctgcccagggccagcgcgccctcgctggacgaccccgcgcgccgccacatgaccatccacgtgccgctggacgcctcgcgctccaagcagctcatcagcgagtggaagcagaagagcctggagggccgcggcctggggctgcccgacgacgccagccccgggcacctgcgcgcgcccgccgaacccatggcggaggaggaggaagaggaggaggacgaagaggaagaggaggaggaggaagaggaggaggacgagggcccggccccgccctcgctctaccccaccgtgcaggcgcggccggggctggggcctcgggtcatcctcccaccgcgcgcggggccgccgccgctggtgcacatcccggaggagggcgcgcagacgggggccggcctgtcccccaaaagcggcgccggggtgcgcgccaagtggctcatgatggccgagaagagcggggcggcagtggccaaccctccgcggctgctgcaggtcatcgccatgtccaaggctccgggcgcgccgggccccaaggcggccgagacggcgtcgtcgtccagcgccagctccgactcctcgcagtaccggtcgccgtcggaccgcgactccgccagcatcgtgaccatcgacgcgcacgcgccgcaccaccccgtggtgcacctgtcggccggcggcgcgccctgggagtggaaggcggcgggcggcggggccaaggcggaggccgacggcggctacgagctgggggacctggcgcgcggcttccgcggcggggccaagcccccgggcgtgtcccccggctcgtcggtcagcgacgtggaccaggaggagccgcggttcggggccgtggccaccgtcaacctggccacgggcgaggggctgcccccgctgggcgcggccgatggggcgctgggcccgggcagccgggagtccacgctgcggcgccacgcgggcggcctggggctggcggagcgcgaggcggaggcggaggccgagggctacttccgcaagatgcaggcgcgccgcttccccgactagcgcggcggggccgggggcgggcggggggcgggccgagggcgcgggcggccgc

SEQ ID NO: 53345 - DNA, 1932 bp, Homo sapiens
gacccgctcgctcgctcgccagccgtccccgcgccccgcgtccccgcgccagccgcctcctggcctcgggcgccgcgcatccaggaaggaagcagccaccctcgccatggcctccccgcccgcctgcccctcggaggaggacgagagcctgaagggctgtgagctgtacgtgcagctgcacgggatccagcaggtcctcaaagactgtatcgtccacctctgcatctccaagcccgaacgccccatgaagttcctccgggagcacttcgagaagctggagaaggaagaaaacaggcagattttggcgcggcaaaagtcaaactcacagtcggactcccatgatgaggaggtgtcgcccacccccccgaaccctgtggtgaaggcccgccgccggcgaggaggcgtgagtgccgaggtgtacaccgaggaggacgccgtgtcctacgtcaggaaggtgattcccaaggactacaaaaccatgactgcgctggccaaggccatctccaagaacgtgctcttcgctcacctggatgacaacgagaggagtgacatattcgatgccatgttccctgtcactcacatcgctggggagactgttatacagcaagggaatgaaggagacaacttctatgtcgttgatcaaggggaagtggatgtgtacgtgaacggagagtgggtgaccaacatcagcgagggaggcagcttcggggagctggcgctcatctacggcacccccagggctgcgaccgtgaaagccaagacggacctcaagctctgggggatcgaccgggacagctaccggcgcatccttatgggcagcacgctgaggaaacgcaagatgtacgaggagttcctcagcaaggtctccatcctagagtccctggagaagtgggagcgtctgaccgtggcggatgcgctggagcccgtccagtttgaagatggagagaaaattgtggtccagggagagcctggggacgacttttacatcatcacggagggcaccgcgtccgtgctgcagcgccggtcccccaatgaggagtacgtggaggtggggcgcctgggaccctctgactacttcggggagattgcactgctgctgaaccggccccgggcggccactgtcgtggcccgggggcccctcaagtgtgtgaagctggaccggccccgcttcgagcgtgtgctggggccctgctctgagatcctcaagaggaacattcagcgttacaacagcttcatctccctcaccgtctgagcacagctcccgccctgcagccccagctccccagtgtggtggccgtgccctgctcgtctgtgtcgggggcccgggagccgctgtgtgaggtgtgggccgggtggggctgggtcccggcagcgtgaggactgccccttccccggactcactttttggaataaatgatcaccttgtgcatttccaaatcaaaggacaagcggacaaaatgcatcccaagatcaaggaagggacaggccagcttcctccccacacgcctccccggctgcctctgtgggcttctcctggggggcccaccccacccctgccagtctcctggagatgcttgaggatcggtcctccccagaaccaggccaggacgttgcccctggggcctggtgaccctgtgaggtcaggtcccccagattgaggtctgagtgtgggcaagtgtgtcaaaaggggctgccccccaggggagatgaggctgagagcagggagttgaggccgaagaagtcaaggcccctcccgcaaatgtgtacccctgcccgcgccactgcaccccgccgcacccccacctcccccgggggccctgctgcggatgccggagtgggagagtctctgagctgtgagattgatcttgcccctaattggagaggaagccgggcgccaagacacacggggctcctgccttgggagccagggcc

SEQ ID NO: 53346 - DNA, 3143 bp, Homo sapiens
cggagctggagctcccaccgccgccgcccgtgcctccggctgccggcgcccctgcctttggctcttcctccccactcgcccgctccccctggcggagccggcgcgcccggggtgccgctccctgcctggcgcgctccgcacctggaggtgccttgcccctctcctgcccacctcggaatttccctgtggctcctttgatccttcgagtctccagctcctctcccttccacctgtttcccccaagaaaggcaggatcctggtccctgctacgtttctggggccatggctggtctgggccccggcgtaggcgattcagaggggggaccccggcccctgttttgcagaaagggggccctgaggcagaaggtggtccacgaagtcaagagccacaagttcaccgctcgcttcttcaagcagcccaccttctgcagccactgcaccgacttcatctggggtatcggaaagcagggcctgcaatgtcaagtctgcagctttgtggttcatcgacgatgccacgaatttgtgaccttcgagtgtccaggcgctgggaagggcccccagacggacgacccccggaacaaacacaagttccgcctgcatagctacagcagccccaccttctgcgaccactgtggctccctcctctacgggcttgtgcaccagggcatgaaatgctcctgctgcgagatgaacgtgcaccggcgctgtgtgcgtagcgtgccctccctgtgcggtgtggaccacaccgagcgccgcgggcgcctgcagctggagatccgggctcccacagcagatgagatccacgtaactgttggcgaggcccgtaacctaattcctatggaccccaatggtctctctgatccctatgtgaaactgaagctcatcccagaccctcggaacctgacgaaacagaagacccgaacggtgaaagccacgctaaaccctgtgtggaatgagacctttgtgttcaacctgaagccaggggatgtggagcgccggctcagcgtggaggtgtgggactgggaccggacctcccgcaacgacttcatgggggccatgtcctttggcgtctcggagctgctcaaggcgcccgtggatggctggtacaagttactgaaccaggaggagggcgagtattacaatgtgccggtggccgatgctgacaactgcagcctcctccagaagtttgaggcttgtaactaccccctggaattgtatgagcgggtgcggatgggcccctcttcctctcccatcccctccccttcccctagtcccaccgaccccaagcgctgcttcttcggggcgagtccaggacgcctgcacatctccgacttcagcttcctcatggttctaggaaaaggcagttttgggaaggtgatgctggccgagcgcaggggctctgatgagctctacgccatcaagatcttgaaaaaggacgtgatcgtccaggacgacgatgtggactgcacgctggtggagaaacgtgtgctggcgctggggggccggggtcctggcggccggccccacttcctcacccagctccactccaccttccagaccccggaccgcctgtatttcgtgatggagtacgtcaccgggggagacttgatgtaccacattcaacagctgggcaagtttaaggagccccatgcagcgttctacgcggcagaaatcgctatcggcctcttcttccttcacaatcagggcatcatctacagggacctgaagctggacaatgtgatgctggatgctgagggacacatcaagatcactgactttggcatgtgtaaggagaacgtcttccccgggacgacaacccgcaccttctgcgggaccccggactacatagccccggagatcattgcctaccagccctatgggaagtctgtcgattggtggtcctttggagttctgctgtatgagatgttggcaggacagcctcccttcgatggggaggacgaggaggagctgtttcaggccatcatggaacaaactgtcacctaccccaagtcgctttcccgggaagccgtggccatctgcaaggggttcctgaccaagcacccagggaagcgcctgggctcagggcctgatggggaacctaccatccgtgcacatggctttttccgctggattgactgggagcggctggaacgattggagatcccgcctcctttcagaccccgcccgtgtggccgcagcggcgagaactttgacaagttcttcacgcgggcggcgccagcgctgacccctccagaccgcctagtcctggccagcatcgaccaggccgatttccagggcttcacctacgtgaaccccgacttcgtgcacccggatgcccgcagccccaccagcccagtgcctgtgcccgtcatgtaatctcacccgccgccactaggtgtccccaacgtcccctccgccgtgccggcggcagccccacttcacccccaacttcaccaccccctgtcccattctagatcctgcaccccagcattccagctctgcccccgcgggttctagacgcccctcccaagcgttcctggccttctgaactccatacagcctctacagccgtcccgcgttcaagacttgagcggagcccgatattctccctgaccttagcgttctggactctgccccaatcgggtccagagaccacaccactaaccatccccaactccatggggttcgagactccatcttggtagttctgtgcctccccccagaccccgcccctggggaaatagcctcacggggttggctgttccagactcaggttccagaacagccctcggcctccgaggctccccgcctccactctagttctagatgagtgggaggcgtgcccccctcctccagtacgtcccgctgctgtgctctggggatttctgggatatatggaggattctttccccagaggctcccaatcagcttttgttctagacttccccatcccgaagccatcacttctccccgcagcccgcctgccgtgcatggctcctgtctggctcggacccaccccaactctccccagtgcctgccactctctgggactctcctcctcccctcctcttcccttagcctctcccacccggccacagctgctggagaataaatttgggatgctgatgaaaaaaaaaaaaaaa

SEQ ID NO: 53347 - DNA, 2356 bp, Homo sapiens
ccggactttgcgagcagcctggagaggatccgcgaccgccgccgccgccgccgcggaggcttcggggctgcttccctcgagcttagcccgcagcgcgggtggagaggggcggggagggggtcgggggcacgagaagaacttgaaaccgtgtgaaggaatccggagcagatgagaagggaggaaaataaaagaaagtggagactgcagaacagactccgctgtggctgactgtgccggccgacgctccagctgaggggctgggttggatttttttttttctcccatcctctcgctctctcttttaaagcgacaccagctctctctcctcctctactatctcggtatcaccaaacccttgccggctcttatgggcatgaaacactcctcccgctgcctgctcctgaggaggaaaatggcggagaacgcggccgagagcaccgaggtgaacagccccccctcccagcccccccagcccgtcgtccctgctaagcccgtgcaatgcgtccatcatgtgtccactcaacccagctgcccaggacggggcaagatgtccaagctgctgaacccagaggagatgacctcgagagattattacttcgactcctatgcccactttgggatccacgaggaaatgctgaaggatgaggtgcggactctcacttaccggaactccatgtaccacaacaagcacgtgttcaaggacaaagtggtactggatgtggggagtggtactgggatcctttccatgttcgctgccaaggcaggggccaagaaggtgtttgggatcgaatgctccagtatttctgactactcagagaagatcattaaggccaaccacttggacaacatcatcaccatatttaagggtaaagtggaagaggtggagctgcctgtggagaaggtggacatcatcatcagcgagtggatgggctactgtctgttctatgagtccatgctcaacacggtgatctttgccagggacaagtggctgaaacctggagggcttatgtttccagaccgggcagctttgtacgtggtagcgattgaagacagacagtacaaggacttcaaaatccactggtgggagaatgtctatggctttgacatgacctgcatccgggacgtggccatgaaggagcctctagtggacatcgtggatccaaagcaagtggtgaccaatgcctgtttgataaaggaggtggacatttacacagtgaagacggaagagctatcgttcacatctgcattctgcctgcagatacagcgcaacgactacgtccacgccctggtcacctattttaatattgaatttaccaagtgccacaagaaaatggggttttccacagcccctgatgctccctacacccactggaagcagaccgtcttctacttggaagattacctcactgtccggaggggggaggaaatctacgggaccatatccatgaagccaaatgccaaaaatgtgcgagacctcgatttcacagtagacttggattttaagggacagctgtgtgaaacatctgtatctaatgactacaaaatgcgttagcacacgtgggaagctgcagagagcaacgagaaaaggaactctcacctcgatctgccgtgccgtcccaaagaataccgtttgcaggactacacacttgaaaaccagagttttcaactctgccttgaagattggtgaactccccagggctcccgtgggctctgccactggacagaaggcctccagctcctccgctctgccctggtagcccttcacgaaggctttgtgttgccaacaaagagcgacctggcgtgctgtggctgggccccgagggtggaaacgtattcgcgtctccccgtctcctccttaactgtgactctccgggtcttctgagttttgcatgctgcgggtgtctaggacagattgcttccactagaacctggagacatagcatctttgatagcataagccagattatctgtgtgtgcggtggtgtgcgtgtgcgtgcatgtgtgaatgtgagcagcatagttgatatttacccacaaacacctgtatatgcgtgcatatacaaccaagtgggtagacctaggtgttctctcagaggggtgtgtgtgtgtgtgcgtgcgcgtgtgcctagaatatatattactctcagaggagattctgttgcttttgaataggaatttgttttgtgattagttcgccccttccccaccccttaccagatgttaagcagctatgaaacattctctgtactagttctggtctccttttgactggactgtggctctgaaccttgagcatagtaccacggactccgtgggcgctcaataaacacacatgagaacaaaaaaaaaaaaaaaa

SEQ ID NO: 53348 - DNA, 4528 bp, Homo sapiens
ctcgctcagcctctccacatcgcggctccggcacctgaagggacgcgggcgggcgcgggcagctccgaccggcggcggcggggcgggacaggcagcccggcggcctccgatggccccgccgtgagaggccggacccgcggcggggaccagcagcggtctagaggagtcccaggagcagccaggacaggcggaagcagtggctgccatggaggaggacaagctcttatctgcagtgcctgaggaaggcgatgccacccgtgaccccggtccagagcctgaagaggagccaggggtccggaatgggatggccagtgagggcctgaacagcagcctctgcagcccagggcacgagcgaaggggcaccccagcggacactgaggaacccacgaaggacccagatgtggccttccatggcctcagccttggcctctctctcaccaatggcctagccctggggccagacttgaacattctggaagattcagcggagtccaggccctggagggctggcgtgctggcagagggggacaatgcttccaggagcctctacccagatgctgaggaccctcagctggggttggatggtcccggggagccagatgtgcgggatggcttcagcgccacgtttgagaagattctggagtcagagctgctgcggggcacccagtacagcagcctcgactccctagacgggctgagcctcacggatgagagcgacagctgcgtcagcttcgaggcccccctcacacccctcatccagcagcgggcccgtgacagccctgagccaggggctgggttgggcattggggacatggcgtttgagggggacatgggggcagctggtggtgatggggagctgggcagccccctgcggcgctccatctccagcagccgctctgagaatgtcctgagccgcctgtctctcatggccatgcccaatggattccatgaagatggccctcagggcccagggggggatgaggatgatgatgaggaggacacggacaagttgctgaactcagccagtgaccccagcctgaaggatggcctgtcagactcagactctgagctcagcagctcggaggggttggagcctggtagtgcagaccctctggccaacgggtgccagggggtcagtgaagctgctcatcggctggcacgccgtctctaccacctcgagggcttccagcgctgtgatgtggcccggcagctgggcaagaacaacgagtttagcaggctggtggccggggagtacctcagtttcttcgacttctcgggcttgactctggacggagcactcagaacattcttgaaggccttcccgctgatgggggagacacaagagcgtgagcgggtcctcacacacttctcccgccggtactgccagtgcaaccctgatgacagcacttcggaagatgggatccacacgctcacctgtgccctgatgctgctcaacacggacctgcacggccacaacattggcaaaaagatgtcctgtcagcaattcattgccaacttggaccagctgaatgatggccaagactttgccaaagacctgctgaagaccctttacaactccatcaagaatgaaaagctggaatgggccattgatgaggatgagctgaggaaatccctgtctgagctggtggatgacaagttcgggacaggcacgaagaaggtgacgcgaatcctggatggtggcaaccccttcctggatgtcccacaggcgctcagtgccaccacctacaagcacggcgtcctgacccggaagactcacgctgacatggatggcaagaggacgccccgtgggaggcgtggctggaagaaattctacgcagtgctcaaagggaccatcctgtacctgcagaaggatgagtacaggcctgacaaagctctatcggagggtgacctgaagaacgccattcgcgtgcatcacgctctggccaccagggcctctgactacagcaagaagtccaacgtgctgaagcttaagacagccgactggagggtattcctcttccaggcaccgagcaaggaagaaatgctgtcctggatcctcaggatcaacctggtggcagccatcttctctgccccggccttcccagccgctgtcagctccatgaagaagttctgtcggcccctgctgccctcctgcaccacccgcctctgccaggaggagcaactgcggtctcatgagaataagttgaggcagctgactgcggagctggccgaacacaggtgtcacccagtcgagaggggcatcaagtccaaggaggccgaggagtaccggttgaaggagcactatctcaccttcgagaaaagccgttatgagacctatatccacctcctggctatgaaaatcaaagtgggctcagatgatctggagcggattgaggcccggctggccactctggaaggggatgacccttctctccggaagacacattcaagccctgccctcagccagggccatgtgactggcagcaaaaccacaaaggatgccactgggcctgatacttagctgacatggatttgcagaccccagggtgggcagatgtctccagtggggtcagtgagcacaattccagccaggggccacttggaccaagctccagtcagttgatgggcagctagaggggtgcagaaagcctgtgggcccaggagatggagatgccgtttgtggcgttgatctccttgcgtccttgggcatctccgggcatcagaccctctccctggcccttgttttcctctccaccatggagcctcattttgtaggccagttgtgtgcatgctctagacaccacctcgctggagaagctggaagggctgttgtcttcccaggtctttctcttctcatcaagctcctctcctcatcttttttgtgtgtgagggcaggtcttgactctaggtctcagctggaaccccaccctttctcctcctccttcctctgagttgaccagcagcaggtctgccgaccaccagcaccatcctctcctcccagcagcctccagaaccatgcccaggtctcctgcctcacatcacaataatctgggacccaggcttgtgccctttcagtgtaaagctgactccatcacatgtgcatccacttcttttcatccattgagatcacactgcctcctttttatacagacacaaatatacatctataagaataatatatacataaggaacccctgaaagatggttttggaactggaatcagttagaggatgaaatcagataaaggaaaagcctattttggagcttcccctgttaggaaggatggctgcacctggccccctggcattcctgacgctctaggagggaagggggaggcagtgctggcctcccttgccctgtttttccctcttccagctgacctgtgacttatactgctcttaccgatgatacttttggaaaaaatagagcgtgtatgcaccgccccgtttgtcccatggatatcctggggtgtgagtcggatgggaccacggccctgtttatatttgggtctttatgttggtgctgccaggtctctgagctccagaggtggcctcttggacagatctactgctataggaataaaagacactctgtctcgcaaatggctgcttgtcaacaagcccaaagatgcttgtcggaggacggttatggaagcccttaattcttggttgtgggaaaaggtggaatgacaagttattgattgtttttctgtcgctatttctttcatttgtctagtgaatcagaaaggcttagccaaggccacatctgggaagagtggagaaatttgccacttgacgatcacggattagctagcacctttaagccctgcatttctccaactgacaagtgggtgggggtgatggcacattcagtgtggctatgaagagcgaatcctctctattgtttaaatagattactgtagtttggccaggaatttggcgtcagtggtaacacacttagttaataaaataagccaggcttgcaactaagtatctaactttacaggcccactcacatttgaggcaaggggctattgagtatgtggagagatgtagtgatttaaattcagattatttaagttggatcagctgaagtgtgttttagacccaaaccatctggccccttcgttttgctcagaggaagtaaatgttcacttaaatgaaattgaaaacgccatgtggcaccacaaaagagctctctgtactttccccatgctgcctcaaaagttctgtgagtttcggggtcagtgtcccacccttcacttcccgagggcgggtgagtggagagcagagccaggagctctggcagctgtggacagatgtgcttcctgagcatgggttgtgcctcccatcagtaaaaaaatgtttagttcacttccttaattgtataattatttatttgtaaattatatacatgtactactgtactaaaatattatgtacattataaaacatacacaaaaatagaaatttaaaaaagatgagatgaaaataaatctaagtcaaagttccaaaaaaaaaaaaaaaaa

SEQ ID NO: 53349 - DNA, 3492 bp, Homo sapiens
cagctaagacccggagaggtggaatttcactttgaaattcccttgcctcgtgagggccggcgctgggcatgctcagtagccgcggcgctgctgctgggctgctgggctggcgcggagtccaccctgccgtctccgccttggcttctgggcgtccagaaggccaggcatttgccgcctctgagcgcttctgttccccttacccgcaacctcctactgctcttcctctctccctctcttagggaggttgaagctggtgctggtttctgtcggcgccacagactgactgctctgcaaaccccagccgaggacctgaatcccggagactagaagacccttggcggtggctctttctaatagcactttacctgaagtggggtcgtggtggagtttctcctccacctctcaatgcaaacactatgcggagagcagtctgcttccctgcgctgtgcctgctccttaatcttcacgctgcagggtgcttttcaggaaacaatgatcattttttggcaattaatcagaagaagagtgggaagccggtattcatttataagcattcacaagacattgagaagagcctggatatagccccacaaaaaatctacagacatagctaccattcctcttccgaagctcaagtaagcaaacgccaccagattgtcaattcagcatttcctagacccgcatatgacccgtctctcaatctgctggccatggatggtcaagatcttgaagtggaaaatctcccaatcccagcagcaaatgtaattgtggtgacactgcaaatggatgtaaacaagctgaacataaccttgcttcggatcttccgccaaggagtggctgcagctttaggactcttaccccagcaagtgcacatcaatcgcctcattggaaagaagaacagtattgaactgtttgtgtctcccataaaccgaaaaacaggaatttctgatgctctgccctctgaggaagttcttcgttcacttaatatcaatgttttgcatcaaagtttatcccagtttggaattacagaagtctctcctgagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcagagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagccaaaaaaaattaaaataactaccctcagcaaacactagctgttctgctcatatatgaatttttaatgcagcaatgttgactttgtttcatactgccaataaactcttaatact

SEQ ID NO: 53350 - DNA, 2733 bp, Homo sapiens
ggtagtttccaagagagacgctgagggatgtttagaaagcctgggacctgcagatgccatgtcaggcacgcttgctcctgcataggagactaaataatctcgatatataaggatggcagtctgttgtcttagatcagtttgagaagcagctctggcagcggggggtgtaggtgtgttgcactacactgaatggaataaggctaaaaatatgtttagtgtctgataagaacgccagttttctcaagctctcatttaacgtcggactttctgttttgcttttaaagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcagagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagccaaaaaaaattaaaataactaccctcagcaaacactagctgttctgctcatatatgaatttttaatgcagcaatgttgactttgtttcatactgccaataaactcttaatact

SEQ ID NO: 53351 - DNA, 3821 bp, Homo sapiens
atgagttctgcaccgaatgggcgcaaaaagcgccccagccggtccacccgctcctcgatcttccagatcagcaagcccccgctgcagagcggagattgggagcgcaggggcagcggctccgagagcgcccacaaaacccaacgagccctggacgactgcaagatgcttgtccaagagttcaacacacaagtggccctgtaccgagagctggtcatttctattggggatgtctcggtcagctgcccctcactccgggcggaaatgcacaagacaagaaccaaaggctgtgaaatggcccgtcaggcacaccaaaaattggctgccatctcaggcccggaagatggtgagatccatccagaaatctgtcggctttacatccagctgcagtgctgcttagaaatgtataccacagagatgctaaaatccatatgtctgctggggtctcttcagtttcatcgaaaaggaaaggaacctggcgggggaaccaagagtttggattgcaaaattgaggagagtgctgaaacacctgccctagaagactcctcatcatcccccgtagatagtcagcaacattcctggcaggtttccacagacattgagaacactgaaagagacatgagagaaatgaaaaaccttttaagcaaactcagggaaactatgcctttaccattgaaaaatcaagatgacagcagccttctgaatctaactccctaccccctggtgagaagacggaagagaaggttctttgggctgtgttgtctcatctcaagctaggtggctcctcctggaaacccactgagaacatctgaaaaaaaatcacaaaacccgaggacctccagacagctgaaccacacagttattggtttttgactatgttttctatgcttccttattacttttatctgcctccccctgcccttttaaatgattttacacttgaaagcagctgccgtcaagaaaaaaaagaacagattcaaaaaccaggctgtttttaaaagggaattttaaagctgacattgtgcatgtctgctccaaaccacgccatgacagatgcaagaattatgatttttaaattatttaaaggttttttaaatgtattatacagaggaaaaatatttcacatataatagtatatctatagctcttgctgatctcatgttaaaatttatcgtatatgaaagaagtctttaaacatagaaatctatttaaaactgaaaaactgtgttcaaaaatccaatctatcaatatcattagaaataatattataagcaaacatataccacctcacctattgctttctctgcactcatttacatttagtcttccattctgtcagaatctaagagcttcaacataaaagtatcttaatttataaagcaacaaaaaccacatatgaaaagtactaaaattttgtaaatacacaataatcctaataccttcgtacaaatgcatatgggcaactaatttctttttgatccaatgatgtctttttcagcttcttggagaatgaagtaatccagttaggaaatggtgtagtaacatatacaattgccctcaaatgtaaaatcaaatattattacattttgttctaattgaaatctgaagcatggtgtctgcacatcagcatagtgttaaatcttatagggcatgctggaattagctcagattataaaaatatttaacattttacattgttaataaagttttttagttaagctaagcttgtctcattttagatgactatgcagataagatttttccaacgtgtacttggtgtcttgtcttatgcttagactcttgaaagcaggacacattaagcaatactatattttagaaaggaggaagccacatgctttgtttttctgctcacagctttgttgtgatcttccttcactaaacttgtaacatggtacaaattttgttataccgtctcctgttcttcctttggcccatttcccagacagaatttcccatgggttgagagatcaagtctttgcactttttttcttgttttccatagtctgaaaaaccttcaagtcagacaggaggcaccagtgtccagtacaatagaaggatgagctagatgccgataagtggtttatccaagacacatctttagtcccaaccctgttctttaccaatacttatgtgcacaggcatttatatgtataccaatatttttacctaaaaactaaatatattaaggccttttgctttagtgaagatgaactactgtaataattattgtattaggttgaattatatgaaatttcctatatgtgactgttttgacctacaaaatggcaatttcttatagttcaccctaatatccaatgtggaaattatacttggaattgtcttctagctcttttgattgaaagtgaaagaattaaagggttggaagagaacgttatacaggtctctatttagatcataccagctggtttttggccttattctttgaatctagagttgtgttccaaggaaccagtaattaatgcatggttataggtatacctggcttcaaaaaaaagaagtagccgtggaaagctatatgagaaaatcacaattttctgaatcaaatatttgtaaaacaatttggctatttaaagactcttagggtaaatactccctggaaaagcaagcaatccagacttatctggtctgcaaaccttgatttcagcttaatatcctttcctgaatctaattcattttcacccactaaggtcatttcatttaagatccattgtttttgaaattttgaagtagcccagtttggcagctctcagcacctgcctctgccctctcctatacttcaactatattgaactctagcttcaatctagttcctactaatccatgcaaaagttattaactgataagcccaatcttgttcagcacgttcttctaaatgcctgacctaaataacttctgcttggttaacttgtgttcattctcaccttagcctcagtgtgaaagtaacacttaccttctgtgcaattgtcctttgtacaactgaagactgttaataaattcaggtctcacctccatgtctgaaaaggctatagtagctattcatggagatgggaatttgtctaattacctagccagagtttgcatatttaaggtaatatattcagctaccgtatcttttattcatagtgcctgttttccagcctttgatcagttttgtagttcccgtggataaactccaagatctaaagatcctctttcagtagcatatactaaaattaagtttagtgctcaaaaccctggtaacctacactggcccaaggttacagtaggtaattcaccgtctcacattagacaggccaatgcatcccttaggagctgccccactctcctctcacctaccaaaggattttctcaggtgtggttccaagcgataaagttctactgtctcggcttcctgctggtaattcgctttcagattagcaataacactgagctgatctctagggttaagaagagaacattgaactcattttgtcgcatgtacccacaggcttgaaacagaaaatgatgtaaacttttgtggcatacattcacccattttcccaccatatctttactatcctgtgttgatttttttttcaaattacaaagacaatacatgttctttgtgggaaatctgaaaaatactaccaaatagaaaataaaaatcacctgaattccaccacgaccacattgtttaaaaccacatttctgggttttaaatcagtcagtggctgggcccaaaggcacttttgggtaagataagtgaagaaatgcccacaaggccaaggtgtcacttaaaaaaa

SEQ ID NO: 53352 - DNA, 1491 bp, Homo sapiens
gaggactgcaggggcctgagccgctgctgccgccgccgccgcgcagccccacatcaacgcaccggggtcctgtcaccgccaccgccaaaaaagtcaccgccgctagggtcgccgttgcatcggtgcagggcaagatggcatccgccacagactcgcgctatgggcagaaggagtcctcggatcagaacttcgactacatgttcaagattctcatcatcggcaacagcagcgtgggcaagacgtccttcctcttccgctatgctgacgactcgttcacgcctgccttcgtcagcaccgtgggcatcgacttcaaggtcaagaccatctatcgcaacgacaagaggatcaagctgcagatctgggacacagcagggcaagagcggtaccggaccatcaccaccgcatactaccggggcgctatgggcttcatcctcatgtatgacatcaccaacgaggaatccttcaatgcagtgcaggactggtccacccagatcaagacctactcatgggacaatgcccaggtgctgctggtaggaaacaagtgtgacatggaggatgagcgggtggtgtcatcagaacgtggccggcagctagctgaccaccttgggttcgagttctttgaggcaagcgccaaggacaacattaacgtcaagcagacctttgagcgcctggtggatgtcatctgcgagaagatgtccgagtcgttggacacggcggaccctgcggtcacaggcgccaagcagggcccacagctcagtgaccagcaggtgccaccgcaccaggactgcgcctgctgagagccatcccactccctttcccctcttccctgtcttccccaccttcccccaactacccgggcctgacccggcccctaccagccacgggcacaagacccctgctcctgacttagcccgtcacccttatttattattgtagctatttatttatttattgaagatgtcccccaggggcccaggctcccctgcccgccccaagccctgcccctcctgtacatatagccctttccccactcagctgtggtgtctcgtggccccgtgaactcaccgctcaccctcctgaaccccccccccgcctttttttaaaattcacccccatccacagttgtcagttgtgaagaggggccagatgacaccctaaagcaggctgatcgggcaatgggaggtggccaggcctgccagcccctcggctctgccgcggtgggccgaggccgctgttgggggtttccctgtgtggaccatggggatcagagtctggcctgccaggctcctctccccgttttctcttttggtgggggggtgtgctgtgggtattcaccaccctgggaccccccccccccccgcccaccagacctgttctgacctcatgagtgtcaaacgtgccccccagttccttaggagatgtcatgacaacactacacgcacccaataaagcgaatggaccatcaaaaaaaaaaaaaaaaaaaaaaaaaaa

SEQ ID NO: 53353 - DNA, 6065 bp, Homo sapiens
tccttttccctgcctgccttcccttcccttgctccatctcactcgctctctgcctcctctaccctccctccctctcttttctctccgcctctccagcgttctagctgactgcagagctcttagcagccagatggactcagttcccagtgaaaggacagggatggcaagatcttttagcatttaggggatgcctttgttagtaaccgttcacaatgggcagctcccggctgagggtctttgaccctcatttggagaggaaagattccgccgcggcgctctcagaccgagagctgcccttgcctaccttcgatgtgccttatttcaaatacatcgacgaggaggatgaggacgatgaatggagcagccgctcgcagtcttccaccgaggatgactcagtggactctctgctctctgacagatatgtggtggtgtccgggaccccggagaagattttggagcaccttttgaatgacttgcacctggaagaagtccaggacaaagaaacagagaccctcctggatgacttccttctcacgtacactgtcttcatgacaactgatgacttgtgccaggctctgttaaggcactattctgctaagaagtatcaaggcaaagaggaaaactcagacgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcaccacaaaaaaagaataaagcccttttccaccaattcagtcttaaggagaactggctccagcatagaggaactgtgactgaaacggaggaaattttctgccacgtgtatataacagagcactcctatgtcagtgtgaaggcaaaagtttccagtatagcccaagagatcctaaaagtcgtggcagaaaagatccagtatgcagaagaggatctggctctggtggccatcacattctctggggaaaagcatgaacttcagccaaatgacttagtcatctccaaatccctcgaggcatctggtcgaatatatgtctaccggaaagacctggcggacactttgaacccatttgcagaaaatgaggaatcacagcaaaggtcgatgaggattttgggaatgaacacttgggatcttgctctggaattaatgaattttgattggagtctattcaattcaattcacgagcaagagctgatctacttcacgttcagcagacagggaagtggggaacacactgcaaatctcagccttctgctccagagatgcaatgaggtccagctttgggtggccacggagattctgctctgcagccagctgggcaagcgagtgcagctggtgaaaaaattcatcaaaattgcggctcactgcaaagcccagagaaacctgaattctttctttgccattgtgatgggtctcaacactgcttctgtcagtcgactgtcgcagacctgggagaaaatccctgggaagtttaagaaacttttctctgaacttgaaagtttaacagatccttccctaaatcacaaagcctacagagatgcattcaaaaagatgaagccaccaaaaatccctttcatgcccttattgcttaaagatgtaacatttattcatgaaggaaataaaacttttttggataatcttgtcaattttgaaaagctgcatatgatcgcagacactgtccgaaccctgagacactgcaggactaaccagtttggtgacctgtctccaaaagagcatcaagagttaaagtcctatgttaatcacctgtatgtcattgacagccagcaggctctgtttgagctctcacacaggatcgagcctcgggtgtgagccccactgcctcacctcccctgtatctgcagcactttgagctacgggaatgtctatgccaagcacgttgctttcctgtgagaaaagaagttgctgagttttatcagtataacccaagacattcacaggaaagccagccaaagcgtgttcaggaagtgatgtcagccaccagagagggggagaggtttctccatgctactctcgggacaagaaggcagaaggagagtcagaagcattcttgagatggagaaggctggtttcttatgatcacattgttgatccagtccagttttcaatatgagatgtgccagcatcaagacaagacaacgtcttgacatgcaatgaccaaatatttcattaagagcgtgcatgaaacaggaaggagtttttactttgcctagttttagattactgtccataagctgtcaaagaagtcattcttttgaacacctgatgacagagacagcatctctagatctccagggaggagaggtttctgttgatacaacctgtgacatcaccaaaagccacttgtgtctagggagttagtgaggactgcagctagcatccatgctctgatgggcagatgaacaatgtcaaggtgtgcatcactttgcaccacaatcaactattgacacatgcttgcaggtgaaattagtttctgtacaactgatttgcagctataggcaaggtagatgaagttgctttgccagtaaggaaaaatagtaatctttaagaaattgactcattgtttaatttctggggattttctttatacttctaagcaggctcttatcttttattggacataatatgattttgaaaaagcacagtgcctgacacattgcaaacactcaccaactgcttgctgaggtgacagagtcacaaaagtctgcattcttgtgcctgatgatgcattttgcgtacctcatacaggctccttgcccacactatggaatgacagcagccagtgcagggaggttaagtgacatttaatgagtgaagcacttagcactctctaggtaataagatagtggtaattactagtgttttggcaaatgaaaaatgccctgaaatagccaaatgtctgattaatgttggcaacttagaagtcctataatccaactaccagccaaagcagggagcctttctataatttgcctttttttttttttttttcaaaatctgagtcttctaaaatcttattattcccatttttaccaattgaggctcctgtagcaaataagacctcttgatattttcaaggactggttagaggatttctttcaaccttcacatgaacaaaacagcctatgggtcaaaataatgaaatccacccctgcctgctagatacttgtcaccttgctaaaatgcaagggcctggtccattcattttccaaatgcaggagtcttggtgcacttctcactcttcctgcctgttcatctctttcatgcccacacagacctgtttcctttttgtctcatcaacgcctcattcatcctcattactgaggcgtgtccaatgctttttgacatctttatagcagtgctgtttcctgggctcaggaaccacactgagcttgagatactgctggaaggaaccatgtggagagaaggtttgggagaactttgagagagacttagtttggcccagcatgtaaaacttcagtcctgaacatttatagggttttatagaagggcatcctccagggctggtccattcagagaaatgctgcatgctgccgtcatggaatgtggcccacaggacaccagagccgtgagaaccggagagcagacttccctcacggctgggctgagcaaaccctccaaagccctcctcacgcagttactaacaatagcatgggcttacagcacaagcacgtgttctcacctttttcctatgccctggactaaggtttggccagtgtaatcatataaggccatcctgacattgtttctgtgtttcaaaatttggatttttatttacattagaactacattgctcctagtagaacattacctttaggggactaattttccatggagaactatttcagcatattgcatgctgctcagaccccaagtcagatatgcccaccaagccagatgaagctacacaaatgtggtatttaaatgcattttgtacagtgacttcagagtatctcacatgacatgggtgtaaactggctggggagaaaatgatgcttgttcacctcttcctccagccgtggttaggtggtcctaggggtagcagagggaagggaggattttgtgcagtcaagatttgcttttccatccttgtcttctgaatgtctaaaatctctgcatctttctgaagtttaacaactgtctccagaggtttgccaggcagcagctctcagaagtttccaaagctttgcagaatcttagatctggaattaaagaattcaagcccgaattgtgagaaccagatattactcaacagaaagctctttctaaggaatctgagctgttcactggtggacagtggtggggcttgagtgctccttgttaataggatgggccatgcaccctctctggatattcaccaaggcctcttcagaatagggtttgttctggctagaagcgtggtctagaagatggctaagctctttgccagctctcatttggagttttattattgcataaaatcttcgctcactctgcaaatcttacgtaatctggcaccttcggcaccaggtggtgcaggggcacttctaagtgggctctttttgttacagcacaactctcagacagtcctgtgggtctttggattcgtcagcattccagcaaactagccctgcttagaagttagcacaagacagcagaatgcaggaccccgtaggcaaaatcacaaccttgctattaaaaaaaattttgttttacatacacatttgcaggtgttccctagagtgtggtgttttgaatttgctctttgtcatctgtataattgccaaatgattatagtgatacacatgacctgcattcacttttttctagtttccttaattatgtttagaataaattcatttccctagaccgagaaccacaaacaggtagtgtggagcatacaccgaatttagaagcatgtggataaggtcagtgctcacactgcctagtccacagggagaggatgctgcatgaatatatacttgcctctgagtggaggagaaatcgtggcatgaaagagagagtaccagtgatgacttcttatccctggagctgggctttcactgctacccatatcccagccctgcgagtctgttctagccagcacagacaccgcagatccggaactgaatgttcctaaatggcgcagccaatccaggcttttcagaaactgggcaaaaacattaaaatggggacgatcgggtcttccgcagtggtccaacacaggatttcttttaaatgtttcaaaaacatgtccttaaaatttcagcctgcttcttagcgagtgggccagttttgcttaaaactggtgggggggcgggggggaagtttttaaaaattgccaaaaagttagatgcaaatgtattactgtataaagcaaagctgtatatactaaacattttttagcagagtaatatttatttgcatagtctatttattgtattcgtatcacactgttattaaatactgggatgaaatcagtgacctgaagcaagaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttgttgagttaccagaattgccattaacagtgttttctttcccatattccatgctttctgcctctgtgtatatatataatatatatgtatatgactgtgctgtgtatttatcgaagctagtaagcaataatttatatgtaaaaatggccaagcaatataaggttaaaacttatataagtaacccttaccttatcttgtattttcaatttttttttaaaactgcttttccaaatatgagactatgttaaagacactattcatgc

SEQ ID NO: 53354 - DNA, 5657 bp, Homo sapiens
tccttttccctgcctgccttcccttcccttgctccatctcactcgctctctgcctcctctaccctccctccctctcttttctctccgcctctccagcgttctagctgactgcagagctcttagcagccagatggactcagttcccagtgaaaggacagggatggcaagatcttttagcatttaggggatgcctttgttagtaaccgttcacaatgggcagctcccggctgagggtctttgaccctcatttggagaggaaagattccgccgcggcgctctcagaccgagagctgcccttgcctaccttcgatgtgccttatttcaaatacatcgacgaggaggatgaggacgatgaatggagcagccgctcgcagtcttccaccgaggatgactcagtggactctctgctctctgacagatatgtggtggtgtccgggaccccggagaagattttggagcaccttttgaatgacttgcacctggaagaagtccaggacaaagaaacagagaccctcctggatgacttccttctcacgtacactgtcttcatgacaactgatgacttgtgccaggctctgttaaggcactattctgctaagaagtatcaaggcaaagaggaaaactcagacgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcaccacaaaaaaagaataaagcccttttccaccaattcagtcttaaggagaactggctccagcatagaggaactgtgactgaaacggaggaaattttctgccacgtgtatataacagagcactcctatgtcagtgtgaaggcaaaagtttccagtatagcccaagagattctgctctgcagccagctgggcaagcgagtgcagctggtgaaaaaattcatcaaaattgcggctcactgcaaagcccagagaaacctgaattctttctttgccattgtgatgggtctcaacactgcttctgtcagtcgactgtcgcagacctgggagaaaatccctgggaagtttaagaaacttttctctgaacttgaaagtttaacagatccttccctaaatcacaaagcctacagagatgcattcaaaaagatgaagccaccaaaaatccctttcatgcccttattgcttaaagatgtaacatttattcatgaaggaaataaaacttttttggataatcttgtcaattttgaaaagctgcatatgatcgcagacactgtccgaaccctgagacactgcaggactaaccagtttggtgacctgtctccaaaagagcatcaagagttaaagtcctatgttaatcacctgtatgtcattgacagccagcaggctctgtttgagctctcacacaggatcgagcctcgggtgtgagccccactgcctcacctcccctgtatctgcagcactttgagctacgggaatgtctatgccaagcacgttgctttcctgtgagaaaagaagttgctgagttttatcagtataacccaagacattcacaggaaagccagccaaagcgtgttcaggaagtgatgtcagccaccagagagggggagaggtttctccatgctactctcgggacaagaaggcagaaggagagtcagaagcattcttgagatggagaaggctggtttcttatgatcacattgttgatccagtccagttttcaatatgagatgtgccagcatcaagacaagacaacgtcttgacatgcaatgaccaaatatttcattaagagcgtgcatgaaacaggaaggagtttttactttgcctagttttagattactgtccataagctgtcaaagaagtcattcttttgaacacctgatgacagagacagcatctctagatctccagggaggagaggtttctgttgatacaacctgtgacatcaccaaaagccacttgtgtctagggagttagtgaggactgcagctagcatccatgctctgatgggcagatgaacaatgtcaaggtgtgcatcactttgcaccacaatcaactattgacacatgcttgcaggtgaaattagtttctgtacaactgatttgcagctataggcaaggtagatgaagttgctttgccagtaaggaaaaatagtaatctttaagaaattgactcattgtttaatttctggggattttctttatacttctaagcaggctcttatcttttattggacataatatgattttgaaaaagcacagtgcctgacacattgcaaacactcaccaactgcttgctgaggtgacagagtcacaaaagtctgcattcttgtgcctgatgatgcattttgcgtacctcatacaggctccttgcccacactatggaatgacagcagccagtgcagggaggttaagtgacatttaatgagtgaagcacttagcactctctaggtaataagatagtggtaattactagtgttttggcaaatgaaaaatgccctgaaatagccaaatgtctgattaatgttggcaacttagaagtcctataatccaactaccagccaaagcagggagcctttctataatttgcctttttttttttttttttcaaaatctgagtcttctaaaatcttattattcccatttttaccaattgaggctcctgtagcaaataagacctcttgatattttcaaggactggttagaggatttctttcaaccttcacatgaacaaaacagcctatgggtcaaaataatgaaatccacccctgcctgctagatacttgtcaccttgctaaaatgcaagggcctggtccattcattttccaaatgcaggagtcttggtgcacttctcactcttcctgcctgttcatctctttcatgcccacacagacctgtttcctttttgtctcatcaacgcctcattcatcctcattactgaggcgtgtccaatgctttttgacatctttatagcagtgctgtttcctgggctcaggaaccacactgagcttgagatactgctggaaggaaccatgtggagagaaggtttgggagaactttgagagagacttagtttggcccagcatgtaaaacttcagtcctgaacatttatagggttttatagaagggcatcctccagggctggtccattcagagaaatgctgcatgctgccgtcatggaatgtggcccacaggacaccagagccgtgagaaccggagagcagacttccctcacggctgggctgagcaaaccctccaaagccctcctcacgcagttactaacaatagcatgggcttacagcacaagcacgtgttctcacctttttcctatgccctggactaaggtttggccagtgtaatcatataaggccatcctgacattgtttctgtgtttcaaaatttggatttttatttacattagaactacattgctcctagtagaacattacctttaggggactaattttccatggagaactatttcagcatattgcatgctgctcagaccccaagtcagatatgcccaccaagccagatgaagctacacaaatgtggtatttaaatgcattttgtacagtgacttcagagtatctcacatgacatgggtgtaaactggctggggagaaaatgatgcttgttcacctcttcctccagccgtggttaggtggtcctaggggtagcagagggaagggaggattttgtgcagtcaagatttgcttttccatccttgtcttctgaatgtctaaaatctctgcatctttctgaagtttaacaactgtctccagaggtttgccaggcagcagctctcagaagtttccaaagctttgcagaatcttagatctggaattaaagaattcaagcccgaattgtgagaaccagatattactcaacagaaagctctttctaaggaatctgagctgttcactggtggacagtggtggggcttgagtgctccttgttaataggatgggccatgcaccctctctggatattcaccaaggcctcttcagaatagggtttgttctggctagaagcgtggtctagaagatggctaagctctttgccagctctcatttggagttttattattgcataaaatcttcgctcactctgcaaatcttacgtaatctggcaccttcggcaccaggtggtgcaggggcacttctaagtgggctctttttgttacagcacaactctcagacagtcctgtgggtctttggattcgtcagcattccagcaaactagccctgcttagaagttagcacaagacagcagaatgcaggaccccgtaggcaaaatcacaaccttgctattaaaaaaaattttgttttacatacacatttgcaggtgttccctagagtgtggtgttttgaatttgctctttgtcatctgtataattgccaaatgattatagtgatacacatgacctgcattcacttttttctagtttccttaattatgtttagaataaattcatttccctagaccgagaaccacaaacaggtagtgtggagcatacaccgaatttagaagcatgtggataaggtcagtgctcacactgcctagtccacagggagaggatgctgcatgaatatatacttgcctctgagtggaggagaaatcgtggcatgaaagagagagtaccagtgatgacttcttatccctggagctgggctttcactgctacccatatcccagccctgcgagtctgttctagccagcacagacaccgcagatccggaactgaatgttcctaaatggcgcagccaatccaggcttttcagaaactgggcaaaaacattaaaatggggacgatcgggtcttccgcagtggtccaacacaggatttcttttaaatgtttcaaaaacatgtccttaaaatttcagcctgcttcttagcgagtgggccagttttgcttaaaactggtgggggggcgggggggaagtttttaaaaattgccaaaaagttagatgcaaatgtattactgtataaagcaaagctgtatatactaaacattttttagcagagtaatatttatttgcatagtctatttattgtattcgtatcacactgttattaaatactgggatgaaatcagtgacctgaagcaagaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttgttgagttaccagaattgccattaacagtgttttctttcccatattccatgctttctgcctctgtgtatatatataatatatatgtatatgactgtgctgtgtatttatcgaagctagtaagcaataatttatatgtaaaaatggccaagcaatataaggttaaaacttatataagtaacccttaccttatcttgtattttcaatttttttttaaaactgcttttccaaatatgagactatgttaaagacactattcatgc

SEQ ID NO: 53355 - DNA, 6065 bp, Homo sapiens
tccttttccctgcctgccttcccttcccttgctccatctcactcgctctctgcctcctctaccctccctccctctcttttctctccgcctctccagcgttctagctgactgcagagctcttagcagccagatggactcagttcccagtgaaaggacagggatggcaagatcttttagcatttaggggatgcctttgttagtaaccgttcacaatgggcagctcccggctgagggtctttgaccctcatttggagaggaaagattccgccgcggcgctctcagaccgagagctgcccttgcctaccttcgatgtgccttatttcaaatacatcgacgaggaggatgaggacgatgaatggagcagccgctcgcagtcttccaccgaggatgactcagtggactctctgctctctgacagatatgtggtggtgtccgggaccccggagaagattttggagcaccttttgaatgacttgcacctggaagaagtccaggacaaagaaacagagaccctcctggatgacttccttctcacgtacactgtcttcatgacaactgatgacttgtgccaggctctgttaaggcactattctgctaagaagtatcaaggcaaagaggaaaactcagatgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcaccacaaaaaaagaataaagcccttttccaccaattcagtcttaaggagaactggctccagcatagaggaactgtgactgaaacggaggaaattttctgccacgtgtatataacagagcactcctatgtcagtgtgaaggcaaaagtttccagtatagcccaagagatcctaaaagtcgtggcagaaaagatccagtatgcagaagaggatctggctctggtggccatcacattctctggggaaaagcatgaacttcagccaaatgacttagtcatctccaaatccctcgaggcatctggtcgaatatatgtctaccggaaagacctggcggacactttgaacccatttgcagaaaatgaggaatcacagcaaaggtcgatgaggattttgggaatgaacacttgggatcttgctctggaattaatgaattttgattggagtctattcaattcaattcacgagcaagagctgatctacttcacgttcagcagacagggaagtggggaacacactgcaaatctcagccttctgctccagagatgcaatgaggtccagctttgggtggccacggagattctgctctgcagccagctgggcaagcgagtgcagctggtgaaaaaattcatcaaaattgcggctcactgcaaagcccagagaaacctgaattctttctttgccattgtgatgggtctcaacactgcttctgtcagtcgactgtcgcagacctgggagaaaatccctgggaagtttaagaaacttttctctgaacttgaaagtttaacagatccttccctaaatcacaaagcctacagagatgcattcaaaaagatgaagccaccaaaaatccctttcatgcccttattgcttaaagatgtaacatttattcatgaaggaaataaaacttttttggataatcttgtcaattttgaaaagctgcatatgatcgcagacactgtccgaaccctgagacactgcaggactaaccagtttggtgacctgtctccaaaagagcatcaagagttaaagtcctatgttaatcacctgtatgtcattgacagccagcaggctctgtttgagctctcacacaggatcgagcctcgggtgtgagccccactgcctcacctcccctgtatctgcagcactttgagctacgggaatgtctatgccaagcacgttgctttcctgtgagaaaagaagttgctgagttttatcagtataacccaagacattcacaggaaagccagccaaagcgtgttcaggaagtgatgtcagccaccagagagggggagaggtttctccatgctactctcgggacaagaaggcagaaggagagtcagaagcattcttgagatggagaaggctggtttcttatgatcacattgttgatccagtccagttttcaatatgagatgtgccagcatcaagacaagacaacgtcttgacatgcaatgaccaaatatttcattaagagcgtgcatgaaacaggaaggagtttttactttgcctagttttagattactgtccataagctgtcaaagaagtcattcttttgaacacctgatgacagagacagcatctctagatctccagggaggagaggtttctgttgatacaacctgtgacatcaccaaaagccacttgtgtctagggagttagtgaggactgcagctagcatccatgctctgatgggcagatgaacaatgtcaaggtgtgcatcactttgcaccacaatcaactattgacacatgcttgcaggtgaaattagtttctgtacaactgatttgcagctataggcaaggtagatgaagttgctttgccagtaaggaaaaatagtaatctttaagaaattgactcattgtttaatttctggggattttctttatacttctaagcaggctcttatcttttattggacataatatgattttgaaaaagcacagtgcctgacacattgcaaacactcaccaactgcttgctgaggtgacagagtcacaaaagtctgcattcttgtgcctgatgatgcattttgcgtacctcatacaggctccttgcccacactatggaatgacagcagccagtgcagggaggttaagtgacatttaatgagtgaagcacttagcactctctaggtaataagatagtggtaattactagtgttttggcaaatgaaaaatgccctgaaatagccaaatgtctgattaatgttggcaacttagaagtcctataatccaactaccagccaaagcagggagcctttctataatttgcctttttttttttttttttcaaaatctgagtcttctaaaatcttattattcccatttttaccaattgaggctcctgtagcaaataagacctcttgatattttcaaggactggttagaggatttctttcaaccttcacatgaacaaaacagcctatgggtcaaaataatgaaatccacccctgcctgctagatacttgtcaccttgctaaaatgcaagggcctggtccattcattttccaaatgcaggagtcttggtgcacttctcactcttcctgcctgttcatctctttcatgcccacacagacctgtttcctttttgtctcatcaacgcctcattcatcctcattactgaggcgtgtccaatgctttttgacatctttatagcagtgctgtttcctgggctcaggaaccacactgagcttgagatactgctggaaggaaccatgtggagagaaggtttgggagaactttgagagagacttagtttggcccagcatgtaaaacttcagtcctgaacatttatagggttttatagaagggcatcctccagggctggtccattcagagaaatgctgcatgctgccgtcatggaatgtggcccacaggacaccagagccgtgagaaccggagagcagacttccctcacggctgggctgagcaaaccctccaaagccctcctcacgcagttactaacaatagcatgggcttacagcacaagcacgtgttctcacctttttcctatgccctggactaaggtttggccagtgtaatcatataaggccatcctgacattgtttctgtgtttcaaaatttggatttttatttacattagaactacattgctcctagtagaacattacctttaggggactaattttccatggagaactatttcagcatattgcatgctgctcagaccccaagtcagatatgcccaccaagccagatgaagctacacaaatgtggtatttaaatgcattttgtacagtgacttcagagtatctcacatgacatgggtgtaaactggctggggagaaaatgatgcttgttcacctcttcctccagccgtggttaggtggtcctaggggtagcagagggaagggaggattttgtgcagtcaagatttgcttttccatccttgtcttctgaatgtctaaaatctctgcatctttctgaagtttaacaactgtctccagaggtttgccaggcagcagctctcagaagtttccaaagctttgcagaatcttagatctggaattaaagaattcaagcccgaattgtgagaaccagatattactcaacagaaagctctttctaaggaatctgagctgttcactggtggacagtggtggggcttgagtgctccttgttaataggatgggccatgcaccctctctggatattcaccaaggcctcttcagaatagggtttgttctggctagaagcgtggtctagaagatggctaagctctttgccagctctcatttggagttttattattgcataaaatcttcgctcactctgcaaatcttacgtaatctggcaccttcggcaccaggtggtgcaggggcacttctaagtgggctctttttgttacagcacaactctcagacagtcctgtgggtctttggattcgtcagcattccagcaaactagccctgcttagaagttagcacaagacagcagaatgcaggaccccgtaggcaaaatcacaaccttgctattaaaaaaaatttttttttacatacacatttgcaggtgttccctagagtgtggtgttttgaatttgctctttgtcatctgtataattgccaaatgattatagtgatacacatgacctgcattcacttttttctagtttccttaattatgtttagaataaattcatttccctagaccgagaaccacaaacaggtagtgtggagcatacaccgaatttagaagcatgtggataaggtcagtgctcacactgcctagtccacagggagaggatgctgcatgaatatatacttgcctctgagtggaggagaaatcgtggcatgaaagagagagtaccagtgatgacttcttatccctggagctgggctttcactgctacccatatcccagccctgcgagtctgttctagccagcacagacaccgcagatccggaactgaatgttcctaaatggcgcagccaatccaggcttttcagaaactgggcaaaaacattaaaatggggacgatcgggtcttccgcagtggtccaacacaggatttcttttaaatgtttcaaaaacatgtccttaaaatttcagcctgcttcttagcgagtgggccagttttgcttaaaactggtgggggggcgggggggaagtttttaaaaattgccaaaaagttagatgcaaatgtattactgtataaagcaaagctgtatatactaaacattttttagcagagtaatatttatttgcatagtctatttattgtattcgtatcacactgttattaaatactgggatgaaatcagtgacctgaagcaagaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttgttgagttaccagaattgccattaacagtgttttctttcccatattccatgctttctgcctctgtgtatatatataatatatatgtatatgactgtgctgtgtatttatcgaagctagtaagcaataatttatatgtaaaaatggccaagcaatataaggttaaaacttatataagtaacccttaccttatcttgtattttcaatttttttttaaaactgcttttccaaatatgagactatgttaaagacactattcatgc

SEQ ID NO: 53356 - DNA, 5657 bp, Homo sapiens
tccttttccctgcctgccttcccttcccttgctccatctcactcgctctctgcctcctctaccctccctccctctcttttctctccgcctctccagcgttctagctgactgcagagctcttagcagccagatggactcagttcccagtgaaaggacagggatggcaagatcttttagcatttaggggatgcctttgttagtaaccgttcacaatgggcagctcccggctgagggtctttgaccctcatttggagaggaaagattccgccgcggcgctctcagaccgagagctgcccttgcctaccttcgatgtgccttatttcaaatacatcgacgaggaggatgaggacgatgaatggagcagccgctcgcagtcttccaccgaggatgactcagtggactctctgctctctgacagatatgtggtggtgtccgggaccccggagaagattttggagcaccttttgaatgacttgcacctggaagaagtccaggacaaagaaacagagaccctcctggatgacttccttctcacgtacactgtcttcatgacaactgatgacttgtgccaggctctgttaaggcactattctgctaagaagtatcaaggcaaagaggaaaactcagatgttccgcgtaggaaacgtaaagtcttgcatcttgtttcccagtggattgctctgtacaaagactggttacctgaagatgaacattcaaaaatgtttttaaagaccatatataggaatgtactggatgatgtttatgaatatccaatacttgaaaaagaattgaaagaatttcaaaagatacttggaatgcaccgtcgtcacactgtagatgaatattcaccacaaaaaaagaataaagcccttttccaccaattcagtcttaaggagaactggctccagcatagaggaactgtgactgaaacggaggaaattttctgccacgtgtatataacagagcactcctatgtcagtgtgaaggcaaaagtttccagtatagcccaagagattctgctctgcagccagctgggcaagcgagtgcagctggtgaaaaaattcatcaaaattgcggctcactgcaaagcccagagaaacctgaattctttctttgccattgtgatgggtctcaacactgcttctgtcagtcgactgtcgcagacctgggagaaaatccctgggaagtttaagaaacttttctctgaacttgaaagtttaacagatccttccctaaatcacaaagcctacagagatgcattcaaaaagatgaagccaccaaaaatccctttcatgcccttattgcttaaagatgtaacatttattcatgaaggaaataaaacttttttggataatcttgtcaattttgaaaagctgcatatgatcgcagacactgtccgaaccctgagacactgcaggactaaccagtttggtgacctgtctccaaaagagcatcaagagttaaagtcctatgttaatcacctgtatgtcattgacagccagcaggctctgtttgagctctcacacaggatcgagcctcgggtgtgagccccactgcctcacctcccctgtatctgcagcactttgagctacgggaatgtctatgccaagcacgttgctttcctgtgagaaaagaagttgctgagttttatcagtataacccaagacattcacaggaaagccagccaaagcgtgttcaggaagtgatgtcagccaccagagagggggagaggtttctccatgctactctcgggacaagaaggcagaaggagagtcagaagcattcttgagatggagaaggctggtttcttatgatcacattgttgatccagtccagttttcaatatgagatgtgccagcatcaagacaagacaacgtcttgacatgcaatgaccaaatatttcattaagagcgtgcatgaaacaggaaggagtttttactttgcctagttttagattactgtccataagctgtcaaagaagtcattcttttgaacacctgatgacagagacagcatctctagatctccagggaggagaggtttctgttgatacaacctgtgacatcaccaaaagccacttgtgtctagggagttagtgaggactgcagctagcatccatgctctgatgggcagatgaacaatgtcaaggtgtgcatcactttgcaccacaatcaactattgacacatgcttgcaggtgaaattagtttctgtacaactgatttgcagctataggcaaggtagatgaagttgctttgccagtaaggaaaaatagtaatctttaagaaattgactcattgtttaatttctggggattttctttatacttctaagcaggctcttatcttttattggacataatatgattttgaaaaagcacagtgcctgacacattgcaaacactcaccaactgcttgctgaggtgacagagtcacaaaagtctgcattcttgtgcctgatgatgcattttgcgtacctcatacaggctccttgcccacactatggaatgacagcagccagtgcagggaggttaagtgacatttaatgagtgaagcacttagcactctctaggtaataagatagtggtaattactagtgttttggcaaatgaaaaatgccctgaaatagccaaatgtctgattaatgttggcaacttagaagtcctataatccaactaccagccaaagcagggagcctttctataatttgcctttttttttttttttttcaaaatctgagtcttctaaaatcttattattcccatttttaccaattgaggctcctgtagcaaataagacctcttgatattttcaaggactggttagaggatttctttcaaccttcacatgaacaaaacagcctatgggtcaaaataatgaaatccacccctgcctgctagatacttgtcaccttgctaaaatgcaagggcctggtccattcattttccaaatgcaggagtcttggtgcacttctcactcttcctgcctgttcatctctttcatgcccacacagacctgtttcctttttgtctcatcaacgcctcattcatcctcattactgaggcgtgtccaatgctttttgacatctttatagcagtgctgtttcctgggctcaggaaccacactgagcttgagatactgctggaaggaaccatgtggagagaaggtttgggagaactttgagagagacttagtttggcccagcatgtaaaacttcagtcctgaacatttatagggttttatagaagggcatcctccagggctggtccattcagagaaatgctgcatgctgccgtcatggaatgtggcccacaggacaccagagccgtgagaaccggagagcagacttccctcacggctgggctgagcaaaccctccaaagccctcctcacgcagttactaacaatagcatgggcttacagcacaagcacgtgttctcacctttttcctatgccctggactaaggtttggccagtgtaatcatataaggccatcctgacattgtttctgtgtttcaaaatttggatttttatttacattagaactacattgctcctagtagaacattacctttaggggactaattttccatggagaactatttcagcatattgcatgctgctcagaccccaagtcagatatgcccaccaagccagatgaagctacacaaatgtggtatttaaatgcattttgtacagtgacttcagagtatctcacatgacatgggtgtaaactggctggggagaaaatgatgcttgttcacctcttcctccagccgtggttaggtggtcctaggggtagcagagggaagggaggattttgtgcagtcaagatttgcttttccatccttgtcttctgaatgtctaaaatctctgcatctttctgaagtttaacaactgtctccagaggtttgccaggcagcagctctcagaagtttccaaagctttgcagaatcttagatctggaattaaagaattcaagcccgaattgtgagaaccagatattactcaacagaaagctctttctaaggaatctgagctgttcactggtggacagtggtggggcttgagtgctccttgttaataggatgggccatgcaccctctctggatattcaccaaggcctcttcagaatagggtttgttctggctagaagcgtggtctagaagatggctaagctctttgccagctctcatttggagttttattattgcataaaatcttcgctcactctgcaaatcttacgtaatctggcaccttcggcaccaggtggtgcaggggcacttctaagtgggctctttttgttacagcacaactctcagacagtcctgtgggtctttggattcgtcagcattccagcaaactagccctgcttagaagttagcacaagacagcagaatgcaggaccccgtaggcaaaatcacaaccttgctattaaaaaaaatttttttttacatacacatttgcaggtgttccctagagtgtggtgttttgaatttgctctttgtcatctgtataattgccaaatgattatagtgatacacatgacctgcattcacttttttctagtttccttaattatgtttagaataaattcatttccctagaccgagaaccacaaacaggtagtgtggagcatacaccgaatttagaagcatgtggataaggtcagtgctcacactgcctagtccacagggagaggatgctgcatgaatatatacttgcctctgagtggaggagaaatcgtggcatgaaagagagagtaccagtgatgacttcttatccctggagctgggctttcactgctacccatatcccagccctgcgagtctgttctagccagcacagacaccgcagatccggaactgaatgttcctaaatggcgcagccaatccaggcttttcagaaactgggcaaaaacattaaaatggggacgatcgggtcttccgcagtggtccaacacaggatttcttttaaatgtttcaaaaacatgtccttaaaatttcagcctgcttcttagcgagtgggccagttttgcttaaaactggtgggggggcgggggggaagtttttaaaaattgccaaaaagttagatgcaaatgtattactgtataaagcaaagctgtatatactaaacattttttagcagagtaatatttatttgcatagtctatttattgtattcgtatcacactgttattaaatactgggatgaaatcagtgacctgaagcaagaaatcttgccttttaatgtatcattaattagggctgctgtgatattgtcagcttgcattaacaattagaagatagagaacccgccatcagggtgtctacctaacttctcagggactacacttggtagttttccaccatttaaagaactggtaaatatgaaacatttgttgagttaccagaattgccattaacagtgttttctttcccatattccatgctttctgcctctgtgtatatatataatatatatgtatatgactgtgctgtgtatttatcgaagctagtaagcaataatttatatgtaaaaatggccaagcaatataaggttaaaacttatataagtaacccttaccttatcttgtattttcaatttttttttaaaactgcttttccaaatatgagactatgttaaagacactattcatgc

SEQ ID NO: 53357 - DNA, 6065 bp, Homo sapiens; identical to SEQ ID NO: 53355

SEQ ID NO: 53358 - DNA, 5657 bp, Homo sapiens; identical to SEQ ID NO: 53356

SEQ ID NO: 53359 - DNA, 669 bp, Homo sapiens
atgcagcacccactgtggcctgggagctccgaggggctccagctgcttgtctgcttcctgctgctgaacagctgcccggggggctgcagcgacactagtgcccacgatggtcaggaccaagtaggagtggggcagctttggcccctccaaggatttgccaccccagtcttccagcatttacaggttgtgctccagcagattataccccaaggtctgttctggaaggatgacatcacccaggatgcaatgatccaaaagatggagcatgccagcagactgcatccccaagaaccatgcctgaaggatgggaaggcacttttccccactaaaaccactgagagccccctggccaaggtgaacagggatcagtgctttacctccgaagtggtttctaaggccctgaaacaagaggtggccaaccctgtcaagattacctataggtgttcatatggggggctggacatgatgcaggcgccgggaccctctaaggaagaaattatctataagatcatgcggcttctctgggccacttcctactgtgggccgcaaccctgtggctgattgagacctcatgtgaagcctccctgccccagcacccttcccattgcccttcagaggagcagttcttggatgacccagatttgaatcattaaagtagactctaatgca

SEQ ID NO: 53360 - DNA, 6322 bp, Homo sapiens
atgcaggccttcccacaagggcccggcagcatgacaaggtgaaggcagagtatgtgcatctcaaccacccgctcaccctcgtgaccagagagcgcgatttggccgtgaaggagaaacaccagctccaagccaagctggagaacctagaacaggtcctgaagcatatgcgagaggcggctgaacggcggcagcagctgcagttggagcatgaccaggccctggctgttctcagtgccaagcagcaggaaattgaccttctgcagaagtccaaggttcgagagctggaagagaaatgccggactcaaagtgagcagttcaacctgctgtcccgggacctggagaagttccggcagcacgctggcaagattgacctgctgggtggcagcgcggtggcccccctggacatctccacggcccccagcaagcctttcccacagttcatgaatggcctagccacctccctcggcaaaggtcaggagagcgctattggaggcagctctgcgatcggtgaatatatccggccccttccgcagcctggtgacaggccggagcctctgtccgccaagcccaccttcctgtcgagatccggtagcgcaagatgcagatctgagtcagacatggagaatgaacggaattccaatacctccaagcagagatactcggggaaggtccacctctgtgttgcccgctatagttacaaccccttcgatggaccgaacgagaaccccgaagctgagctgcccctcacggcgggaaaatacctctacgtctatggagacatggatgaggatgggttctatgaaggagagctcctcgatggccagaggggtctggtgccctccaacttcgtggactttgtgcaggacaacgagtcgcggttggcaagcacgctggggaacgagcaggatcagaacttcatcaaccattccggcatcggcctggagggagagcacatcctggacctccactccccaacccacatagatgcgggcatcaccgacaacagtgccgggaccctggacgtgaacatcgacgacatcggagaagacatcgtgccttaccctagaaaaatcaccctcatcaaacaactcgccaaaagtgttattgtgggctgggagcccccggcggtgccaccaggatggggaacggtgagcagctacaacgtcctggtggacaaggagacacgcatgaacctcacgctggggagcagaactaaagccctcatcgagaagctcaacatggcagcctgcacctaccgcatctccgtgcagtgcgtcaccagcaggggcagctcggatgagctgcagtgcacgctgctggtgggcaaggacgtggtggtggccccctcccacctgcgggtggacaacatcacgcagatctccgcccagctctcctggctacccaccaacagcaactacagccacgtcatcttcctcaacgaggaggagttcgacatcgtcaaggccgccaggtacaagtaccagttcttcaatctcaggcccaacatggcctataaggtgaaggttctggccaaaccccaccagatgccgtggcagctcccgctggagcaaagggagaagaaggaggcctttgtggagttctccacgttgcctgcaggacccccagcacccccacaagatgttaccgtccaggctggggtgacccccgccaccatccgggtctcctggagaccacctgtgctgacgcccaccgggctgtccaatggcgcaaacgttaccggctacggcgtgtatgccaaagggcagagggtggctgaagtcatcttccccacggcagacagcacggccgtggagcttgtgcggctgcggagcctggaggccaagggcgtgaccgtgcggaccctctccgcccagggcgagtccgtggactctgcagttgctgccgttccccccgagctcctggtgcctcctaccccccacccgagacctgcaccccaatcaaagccattagcaagttctggagtccccgaaaccaaagacgagcacctgggtccccacgccaggatggatgaggcctgggagcagagccgtgcacctggccctgtgcatgggcacatgctggagccgcccgtgggccccggaaggcggtcgccctcacccagccgcatcctgccgcagccacagggcaccccggtgtccaccaccgtcgccaaggccatggcccgggaggccgcgcagagggtggccgagagcagcaggttagagaaaaggagcgtcttcctagagagaagcagcgcggggcagtacgccgcctcagacgaggaggacgcctatgactctccagacttcaagaggaggggcgcctcggtggacgacttcctgaaaggctctgaacttggcaagcagccgcactgttgccatggagacgagtaccacacagagagcagccgggggtctgacctctcagacatcatggaggaggacgaggaggagctgtattctgaaatgcagctggaagatgggggaaggaggcggcccagcggcacgtcccacaatgccctcaagattttagggaacccagcctctgcaggacgggtggatcacatgggccggaggtttccccgtggcagcgctggtcctcagaggtcccggcccgtgacagtcccatccatcgacgattacgggcgagaccgcctttctccagacttctatgaagagtcagaaactgaccctggtgccgaagagctcccggcccggatctttgtggctctctttgactacgacccgctcaccatgtccccaaacccagatgctgcagaggaggagcttccctttaaagaaggccagatcatcaaggtttatggtgataaagacgctgatggattctaccgtggggaaacctgtgcccggcttggccttattccttgtaacatggtctctgagatacaagcagatgatgaggagatgatggatcagcttcttagacagggctttctccctctgaatacacctgtggagaaaatagagagaagcaggagaagtggcaggcgtcattcggtatcgacgcggagaatggtggccctgtatgactacgaccccagagaaagctcgcccaacgtcgatgtcgaggccgaacttacattttgcacaggagatattattacagtttttggtgaaattgatgaagatggattttattatggggagctgaacgggcagaaaggccttgtgccctcaaacttcttggaagaagtgcctgatgacgtagaagtctatctttctgatgctccatcccactactctcaagatacgccaatgcgctcaaaggcaaaaaggaagaagagtgttcatttcataccttaatcaggcaatgtagccttcacgtaagtgagcaactgaagataccgataaagataccaacttaagctaccttaaccgggccagtgtggtagacttaaggcttcattgtggggttaaaaaaaaaaaaagatacaaagaaatatgtctcaaaaaactattggacctaaataattagaatattacttggtctcagttgtaaagcaactgaatttatagtgaagcaaatcatctttaataatcatttcctactatttgcattaagaatatttgaaaggccaacattgggaacatatttcttaacaagctaactgtgtgtttacatagagagagctgcatattgcattgttagccactcttggaaaaagcacaacctaacaaacatgtttactataggaagctttactttagaaacttaacccaaggtcaagcagatgagtagtgaacacaggtgatcgagtgttggctctgaacactccaaacactggctcgagtggccagaacgtgttttccttaagtaaccctgcctctaccttacgagagagctatgctcctcctcaaagcacaatcatcctgtgacagaagttgctgcaacacgcgtttgttgttggtataccaatgcaatactaagttgatgaagcacgcagctcaaatgatcacattagatggaatagatggtatcttcaggtgtactttgggatgctttactaggtgttttccattagaattagaccttgattttaaatccaagcaagcttgaagccccttggcttacagcatttgcctgctgaatactaaacactcacatggcaagagttgctctggagaggtagggccagaggaatgctgctgcactgccaactcaggcacatgcttagctgtaaagggaagcgaggtgaagtcgtcctgcagcgtattagagtaaaagtctacccctctgaagcactattaagcgcttaacgtatatttaaatactaccatgtgctatctactgaggaagattcatgttcaattatttggaaataatgcaagcatccactaagggcctttaagctttctttgattataattaaggttcattttagttttttttttttctttcaaccagtgtgccatctccaatatttctatagtataccaaccaccccaggaatgcactttaacaatatcaggattttatataaccaaatagtttcaaatacaacaaaattccctttatgaactttcgctttttaagactactgatgggtactcggccaactttactatcaacctaatttcagatcatgtctcccctgcccttagtcttcatttatgaagtgaattattacctgccttagctttgccaaagcaacggccaccccgcactccctcgagacagagaaacggaacccacacatttatgtctggggcctctctctggcgtgctgtgggagaggacctttgcttctcatggcatacttcaacaactgaaagaacaaatgaacccccctgacctttcctggtgggaaacggggacagtacgatgttaccaagtgaattctgttgttggcgctcacacactcaataaactgtaacactgtacctactaggttcctcctgagggttcaggtacagcaaggagagctccatcccccacagtccatctccattcggggtcacctacgtcatctatgggttctggtagtcctgggagaggcagggaaatgtcctcgaaaaagaaaaaggggctgctttccaaaggcaagaaactgctgaaaaagctgggtgcagtgaaatgattcatgtgcttccggacaactgccaaatctatgtaattttctttaattccaaactagggctttcatgactcaagtacttcctaaaaaaacccaatcttctcccctgacaccagtagagaaatgcacttttgcactaccaaccactttaaaccaaccacgagaacaaagaggagcggttgctctctgtcaccgctggcagtctgctctcattgtccaagctctgatttgggaggtgggaggggacgtcttattaacaaacgggggcgcatagctatcacctgtagctccctccctacctgtaattccagtctttgtgcatttgtcatctgcccttaaaggaatgattttcaacctttctcccttctcaaaatgcttgcctcataatgcataactttcactttgactctggtcttgaaattcctagtttaattcgccttgatgttctgccttataaatgcacaatgatttgtactgtctaataaaaacagtgtatactttgtatgtgtcgtgcattcagtggtcttcatcctgacacagtggttcgagatcaagttgtacaggctgtgcattttaagatactagtttcagtctttcaaagccagccaggctacacacagaaaatgtttactcaatcattcaaaaaagagaaaaggagagaaagtaactttgtttggtaaagcaccagtactccaaccttccagaaagccgattatcttcattgcttttaatgttctattctgtggcatatggttttctgttactttcgttgtcaaaatgccatacccaaatacacagcaatgaatggcacacaagtaatccacataatgcataagccacaccaaaaccagactcaatttaaatctgctccaaatgagtccatacccatcttcatcattggcatttgaacaaaagacttacttacaaagttgctggcagatgtatttgatggttactcttttgtaattcttgtccacttgtaaattgtttttactctttatacatacttttcagactgcctttcttttgtaatttatggacggtttataaatgaatgacaaagctttccccattgtgtcttcaaaaacgctattataaattgtaatataatagtatgtggtagatttattattaaaggaaatccatgtgtggttaagctctgtgtgggtgtgtgcatgtgcacagttagtgtaaaatattttctagaaataaaatttgttattttat

SEQ ID NO: 53361 - DNA, 2328 bp, Homo sapiens
aattctctaggttgcaaattgggaggattaggaacaagtaagagagttccatgcaggatggacaagaaaaaaaagttttataccaaaaattgtatttcatggcattagggcagtctactggggtaaggcactatgcagtactaggcaattagaattctattcactagctatgtgcacaagcggctcctgacctggtcattttggctgtaaaactattcatgcctggacagtttttgacggtgcagtcttgctatatggtgtgagaaatggctgtaggaaacaacactcaacgaagttattccatcatcccgtgttttatatttgttgagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgattgctcaggagaaaacaattctgaccggagaatgctgttacctgaaccccttacttcgaaggatcataagattcacaggggtgtttgcatttggactttttgctactgacatttttgtaaacgccggacaagtggtcactgggcacttaacgccatacttcctgactgtgtgcaagccaaactacaccagtgcagactgccaagcgcaccaccagtttataaacaatgggaacatttgtactggggacctggaagtgatagaaaaggctcggagatcctttccctccaaacacgctgctctgagcatttactccgccttatatgccacgatgtatattacaagcacaatcaagacgaagagcagtcgactggccaagccggtgctgtgcctcggaactctctgcacagccttcctgacaggcctcaaccgggtctctgagtatcggaaccactgctcggacgtgattgctggtttcatcctgggcactgcagtggccctgtttctgggaatgtgtgtggttcataactttaaaggaacgcaaggatctccttccaaacccaagcctgaggatccccgtggagtacccctaatggctttcccaaggatagaaagccctctggaaaccttaagtgcacagaatcactctgcgtccatgaccgaagttacctgagacgactgatgtgtcacaagctgttttttaaaatcatcttccaattctatacttcaaaacacacagttgctcaatgtcaaactgtgatgacaaatattacgtttatctagttagaagctaatgttttgtacattttttgtatgaggaagtgatgtagcttgccctgattttttttttttttttttggtcagctttaatatatttatgccagaattttaaaaccaacaaaattttcttgttcaagcgtgcattgaagaaccacatttattcaatggttgacgttgttttgtgatatttgtacacaaattttcttttctcagttttataaacacagaatataacaattcactttaaacttttattaccacagttgctgcctcctccagaatttttgaattttaataaaaggcaaacttttgagctgcaggaaggacaatgttggttaataataaatctcaaagtcaattgtagaaaaaaaattgtcttcaaaaagaatgttgcactctgatctcttaacaaattgttacgttcaaagtttaaagtgatatattaacaaagtcacctagttatacaaacaattgtcagagaattctggatttggagggtattggggttatatgattctttcttagataatggcctctactaaataactcaagatctttctggaatgtcttctggcaggcaggtgccactgtcagcttttctccaaaaagcagccaacatcagcctcccctgtcaactcaacagttttgtatctcatattatatggactttatatgaaaatgaatattttacagtttgcacagtattattttacagaaaaggaatcagagaatctacaacatagggccccagaacaacagtttcactttgtggcttttaattattctagaattttaactgcatctcatttttctagcatggtgagaactaatatgtaactcctttgattgaaggagctcttttgtccgtacctatcagaatgttttcttgacacttccatgttggctcttctcagctttttttgtacatattttttttttctaaagagaagaaaaagttatcacaaaatgtaaaaaaa

SEQ ID NO: 53362 - DNA, 2461 bp, Homo sapiens
ttaaacaaacaggagatcctgaaacctggaccctgtgcaagctgcagcgccaggaggaggcagcggaggaagcagagcgcgggatgggcgcccagcggcatctgtgatcccgcgcacctccgccccacgggcgcgcgcacaaacacggacacacacatacacacactcgcgcacacactcgcacaaacacacactcgtacacgcccgcgccgctcgctcgccggcttgctctcccacgcaagcggaatgcagcagcgcctggagagcgtgtctcggaccgccgcctgaatgtacctcgctcccgggagccggacggcccagtagggcgcactggaggacgctccgctgcgggagcctggacagtttttgacggtgcagtcttgctatatggtgtgagaaatggctgtaggaaacaacactcaacgaagttattccatcatcccgtgttttatatttgttgagcttgtcatcatggctgggacagtgctgcttgcctactacttcgaatgcactgacacttttcaggtgcatatccaaggattcttctgtcaggacggagacttaatgaagccttacccagggacagaggaagaaagcttcatcacccctctggtgctctattgtgtgctggctgccaccccaactgctattatttttattggtgagatatccatgtatttcataaaatcaacaagagaatccctgattgctcaggagaaaacaattctgaccggagaatgctgttacctgaaccccttacttcgaaggatcataagattcacaggggtgtttgcatttggactttttgctactgacatttttgtaaacgccggacaagtggtcactgggcacttaacgccatacttcctgactgtgtgcaagccaaactacaccagtgcagactgccaagcgcaccaccagtttataaacaatgggaacatttgtactggggacctggaagtgatagaaaaggctcggagatcctttccctccaaacacgctgctctgagcatttactccgccttatatgccacgatgtatattacaagcacaatcaagacgaagagcagtcgactggccaagccggtgctgtgcctcggaactctctgcacagccttcctgacaggcctcaaccgggtctctgagtatcggaaccactgctcggacgtgattgctggtttcatcctgggcactgcagtggccctgtttctgggaatgtgtgtggttcataactttaaaggaacgcaaggatctccttccaaacccaagcctgaggatccccgtggagtacccctaatggctttcccaaggatagaaagccctctggaaaccttaagtgcacagaatcactctgcgtccatgaccgaagttacctgagacgactgatgtgtcacaagctgttttttaaaatcatcttccaattctatacttcaaaacacacagttgctcaatgtcaaactgtgatgacaaatattacgtttatctagttagaagctaatgttttgtacattttttgtatgaggaagtgatgtagcttgccctgattttttttttttttttttggtcagctttaatatatttatgccagaattttaaaaccaacaaaattttcttgttcaagcgtgcattgaagaaccacatttattcaatggttgacgttgttttgtgatatttgtacacaaattttcttttctcagttttataaacacagaatataacaattcactttaaacttttattaccacagttgctgcctcctccagaatttttgaattttaataaaaggcaaacttttgagctgcaggaaggacaatgttggttaataataaatctcaaagtcaattgtagaaaaaaaattgtcttcaaaaagaatgttgcactctgatctcttaacaaattgttacgttcaaagtttaaagtgatatattaacaaagtcacctagttatacaaacaattgtcagagaattctggatttggagggtattggggttatatgattctttcttagataatggcctctactaaataactcaagatctttctggaatgtcttctggcaggcaggtgccactgtcagcttttctccaaaaagcagccaacatcagcctcccctgtcaactcaacagttttgtatctcatattatatggactttatatgaaaatgaatattttacagtttgcacagtattattttacagaaaaggaatcagagaatctacaacatagggccccagaacaacagtttcactttgtggcttttaattattctagaattttaactgcatctcatttttctagcatggtgagaactaatatgtaactcctttgattgaaggagctcttttgtccgtacctatcagaatgttttcttgacacttccatgttggctcttctcagctttttttgtacatattttttttttctaaagagaagaaaaagttatcacaaaatgtaaaaaaa

SEQ ID NO: 53363 - DNA, 3532 bp, Homo sapiens
gtgcggccggcgcatcccgatggagcgcggcggcggcggctccgggacgggatcccggcctgaggggactgcgcggggaacctctctcccagggaagatcgcagaaccgggcgcggtgcggacctctcagcccaactaccggcctcaaggcatggagggatttttgaaatcagatgagaggcagagattggccaaagaaagacgagaagaaagagaaaaatgtctggctgctcgggagcaacagatcctggagaaacagaaaagagccaggctgcagtacgaaaagcaaatggaggagcgatggcgaaaactggaagagcagcggcagcgggaggaccaaaagagagctgctgtggaagagaaaaggaaacagaagctccgggaggaggaggaacggctggaggcgatgatgcgccggtccctggagcgcacacagcagctggagctgaaaaagaagtattcgtggggagcaccactggccattggacccggaggacatgatgcatgtgacaaactttcaacatcaactatgagtttgccaaagccaacggagcctcccatgaataaacgcctgtcttcatccaccgtggcaatatcctattccccagaccgagtattccatgtctgtcctcgtttagctcctcttggccctcttaacccttcttacaagtcttcacccactcgaaacattgagaagaagaaagctacatctacgtctacatctggtgcaggagatgttgggaaagaagccctttcaggaggagaggcctctctggtggagaaggtgaagcgggggcaacgaacagcaacttctcttcctgttgtgaacttcgggtcccctctgagaagatgtgagttttctggaggcattcctaagagaccatcttctcctgtgatatccaagacagctactaaagcttatccacagtctccaaagacaacgaaacctccctacccagggtctcctgtgaagtaccgcttacctgccctttctggccaagacatgcccaagaggaaagcggagaaagagaagagcaacaaggaaagggaaggtaccttggctcagcaggctgctggcccgcaaggagaggaagccctagagaagcatgtagtggacaagcatgccagcgagaagcatgctgctgccgcaggagggaaagccgaaaacagcgcagccttggggaagcccacagcaggcaccactgatgcaggagaggctgcgaagatcttggctgaaaagagaagacaggcccggctgcagaaggaacaggaggagcaagaacgagtggagaaggaagaacaagataggctggagagagaggaattgaaaagaaaggcagaggaggaaaggcttcgcctagaagaggaagcccgaaagcaggaagaagaaaggaagcggcaggaagaggaaaagaaaaaacaggaaggggaagagaaaagaaaggcaggcgaggaggccaagcggaaggctgaggaggagctgttgttgaaagaaaagcaagaacaagaaaaacaagagaaagccatgattgaaaagcagaaagaagcagcagaaacaaaggcccgggaggtagctgaacagatgcgtctcgagagagaacagattatgctgcagattgagcaggagagactggagagaaagaagagaatagatgaaatcatgaagagaacaaggaaaagtgatgtgcctccacaagtgaagaaagaagaccccaaagtgggggtccagcctgctgtgtgtgtggaaaagaagacaaaactggttgtccccaacaaaatggaaatcaatggattgaacacctgccaggaagttaatggtgtggatcacgctgccccagaaacttatccccaagacattttctctaatgggcttaagccagctgggggactcattcatctggatgcccttgatgggaaatcaaatagcctggatgattcaactgaagaagttcagtctatggatgtgagtcctgtttcaaaagaagagcttatctctatcccggaattttcaccagtgagtgaaatgattcctggggtgtctctggaccaaaatggaactggtaatgcccgagcacttcaagatctcttagatttcactggtcccccgacattccccaagagatccagtgaaaatctcagcctggacgactgtaacaaaaaccttatcgaaggatttaacagtcctggccaagaaactcctctcaacaccttctgttgacaaatacagcatccctttaataaaaggtgtttggagaacccgtaaagctgctgatagtcaaatccgagctactagctgcttgaagaagcttctgtcacccttaccgctggatcccaaattattagctcggaatgtaactgtattcctaggtagtatgtcaaacactggccactcttggtagaaaccttgaaactttcaccttgctgggctttagcaaagtttccttttacagttctgtttatgagcttcagctactgataaagcacttcctgaacttctctattatcatagtgaccctctgaataacctgagtgactggctcggcaattcgctttataaccattcttattcccaaagttggagcacataaacatttagatgtcttttcctgtaaaatattctagacatttacccaaactctagttcaacatatactcaacttgcactgtatatctccctgtcttttttgagacagagaagaaattcaggaggttccccatctccagagtttctctgttggaaagcagtatcaagaagcctttaaaaaattgttgttaagctttgccacctgcagaaatgcattgccccacattattcttctggggttaaagtagtaagtttggttgaggaaggaagtcaaaacagtcagtaatgatttctgttctcttatgcatattcgtgtatacatgggcaactgaatctagcaaggactctttcgtgtcacaccttaaaatcttcatgctgtagtcactccagaccatggagtggctttccagctgaatgaatcctatgtctcgcgtgcaggtggttggttttcaatgttcttgctaattttttttctattggatcttgggagttttctttgtttgctcctgtgtttgcccagctttaataaaaccaggcgcaaacaaaaaccatagcattctgaaacaatagggggcccacattggacccagtatgtcactttaatggacttcaagaaaaaatctgaatgggaaaaatgacactagaatgtatactccacacattttatgccatataatggtgtgttttcttaattttgtttcttgtggcgaaatgtggctttcaaattaaaatggccttttcttctttgaaactttttgttttgacttgtataattaagggtttggaaagattcataattctgagagaggtttgcaaccaggagatacaaagaagtctcagtagtaatcttgttcatgtgcttttacagccagctacatttaagaatgtattagttacagaaattatatgtctgtgtatgtgtctctactcaataaagtacatgcctcc

SEQ ID NO: 53364 - DNA, 4613 bp, Homo sapiens
atgtccccccctggctcggccgcgggagagagcgccgccggcggcggcggcggcggtggcggccccggggtctcggaggagctcacggcggcggcggcagcggcggcggcggacgagggccccgcccgagaggagcagcgtcccatccagccctctttcaccaagtccctctgccgtgagtcccactggaagtgcctcctgctctcgctgctcatgtacggctgcctgggggcagtggcctggtgccacgtcaccacagtgacgcgcctcaccttcagcagcgcctaccagggcaacagcctcatgtaccatgacagcccctgctccaacggctatgtctacatccccctggccttcctgctcatgttgtacgccgtctacctggtggagtgttggcactgccaagcccgccatgagctgcagcaccgtgttgatgtgagcagtgtgcgggaacgtgtgggccgcatgcagcaagccacgccctgcatctggtggaaggccatcagctaccactatgtccgccgcacccgccaggtcaccagataccgcaatggagacgcctataccaccacccaggtctaccacgaacgcgtcaacacgcacgtggcggaggctgagttcgactacgcgcgctgcggcgttcgcgacgtgtccaagacgctggtggggctggagggcgcgccggccacgcggctgcgcttcaccaagtgcttcagtttcgccagcgtggaggccgagaacgcgtacctgtgccagcgcgcgcgcttcttcgcagagaacgagggcctagacgactacatggaggcacgcgagggcatgcacctcaagaacgtggacttccgtgagttcatggtggccttcccggacccggcccggccgccctggtacgcctgctcgtcggccttctgggccgcggcgctgctcacgctgtcgtggccgctgcgagtgctggccgagtaccgcacggcctacgcgcactaccacgtggagaagctatttggcctggagggcccgggctcggccagcagcgcaggcggtggcctcagccccagcgatgagctgctgcccccgctcacccaccgcctgccgcgggtcaacacagtagacagcacggagctcgagtggcacatccgctccaaccagcagctggtgcccagctactctgaggcggtgctcatggacctggcggggctcgggacgcgctgcggcggggcaggcggcggctacgcgccctcgtgccgctacggtggggtaggcggcccgggcgcggcgggcgtggctccctaccggcgcagctgcgagcactgccagcgcgccgtcagcagctcgtctatcttctcgcgcagcgccctaagcatctgcgccagcccgcgggccggcccggggcccggtgggggcgcgggctgcgggggcagccgcttctcgctgggccgtctctacggctcccggcgcagctgcctgtggcgcagccgcagcgggagcgtcaacgaggccagctgccccacggagcagacgcggctgtccagccaggccagcatgggggacgacgaggacgacgacgaggaggaggccgggccgccgccgccctaccacgacgccctctactttccggtcctcatcgtccaccggcaggaggggtgtctgggccacagccaccggccgctgcaccgccacggctcctgcgtagagacctcactgtgacctccggccccggagtggcccgcgccgtcctcccgcctgcccctcgccggactgtgctccctctgcgacgcagggcgagtcaccacggtgactgaggccgcgcggggggcagggaaagggaggtgagggccgcaagacaggcccggatggggccgagacccccgctgtccctgtacataaagagaccgatgggtgggagggggtcggctgctccccgagatccccctggcagagtcattcttccagccccaaccctgagttcctaaagggacacctccctcctgtccagcccttcaacagatcttctgttagatgacaaccgtgccgtgggccccgcgttgggccttgtctgaagggagaggccctggcatgcggatgggagatttagaggctgtggagaagggaacttggggctttccttccttcgtggcctcactcccctggggcctctctctatggagggggcaatggtttggtgaccagcaggctggattccaactagctaatgcattcagcaggtctgaggctggggccaggtgtcagccctaggcctccatccaacaccgtggaaatgttgctgccctcttcttggcgctgaccccaagattggggtttcctttctgccgctccctccactgttgtttatctaactgggcccccactccaggtccagagggactgtgctcactgcacagacatcactcaccttccgctccccagtcctgcagagctgttgccagggtgcagtggggaggggagtgaaatgtggaggactgtgtacctcagtcctctctctaaactcctcagcctcccaacaggggcctcctcacctgggttctgagtgtataccccttttagagagtgagatgccacccgggcagcactcgttaaagctggccagcacgagtgactaaggggagagagcatgacatagacctgggtggcaacggggacctctggaagcaggtgggagtaagagaggagagggcagtggagggtagaggaaaaggacctccagaggtggggtgtctgtgggggcggcctttgcctccctaaacctgtgcggaggagtggagtgtgcttgtcgctcaaacacatctctgggggactgaggacgttgtcacaagccccaactggagaaataattccaatggcagggtcagaggcaagcattctctaaatcttgcccaacccttccatccttccctatcctatgagctgaagccctgctgtgtgtcgcagggtcttcaaaggggcatcctgccaccaccccagggcgctggccccacgtcctgttcccctaaagctctgacaccgccttctctccgtgtgctccccccaccacctccaccctgatgtgcttcagtgtgcatgtctgtgaacagccctcctgccctgccaactcccctggctaaagtctccccagcagatttagcacccagggattgagctcacatttcaggctagagaggataacccttgggccacccacatctctcacccctgatgcttcttacttcgcctgagccatcagaactcctccttaccctccttcagcccctctcatcttccttcagcccagccaggcctgcaccaccaactgtgtggcctccacctatgcaacatcgcctctggctccccttcccttcttcctagcggggagtgcgaggggcccaaattgtggggataccatggcccatggcttctaaagggtttagctttactttcaggtagagatggctgagtgaggagggagaagaggctagagagagggaggcttgggcaggggaaacagctgcccaccaggttttcctggacagcagtgcccacctgcctactagcactgaacctgcctggaccctgagtctgtgctccttgggggcctggcgtttggagcacccttctttcctctgaatggacatctgtgaggtacaggtggtgagctgcagcctcaggctccatttcttagccagctggcacctggatgtcatgctttgtgtggggacagcctggccacctcagggctccaaggaaggaggaacgtggctcctcctccctcaggcctgttcctgagacagagcctggtctcacaagaggggaagggggacctctattattatttttgcctgtattgaccatttctgcctaggtcgtctcagacagcctcatctcccacacatgcacagacttagagagaaaccaattctttggtctattttcttggtagctttactgattgccagggaaaatgaaaaccagaaaattaattaatctctaaaattaaactttacactgaatgttcttgtttctctaattagaacttctgctagcagctgtggctatacacacacacacacacacacacaccctcacacctacacgtttgcactccggaactgtcagagggtgtcaggcacagacagactctaggttgcctagacaggcacacacatgcagtcactcccaagccccctttggtgctctgctcagcgcctgcttagcggaaggagtccctggagagcaggcactcctggactggggttgtagcccatgacctgccctttggggacacagttctggaggctctgggccaatgaatcagcccaaggaggatgggcaatggcgctcagcctgaatcagtcagctaggtctcttgtggccctgggggctgatgtgattcctgtaggtgtggccccagggtggacagctacagagtgatgggggactcatgtagggcacctggaaggctccatgtgtcctggggacaagggcttgtggggtgggctgggcctggctggggagaagacaggtctctgtcaattgggtgcatcacactgtggcctttttgtcgtggatttaagcgcaaagattgtacaaatcaaactggtggataataaagtcgtggatgactc

SEQ ID NO: 53365 - DNA, 4613 bp, Homo sapiens
atgtccccccctggctcggccgcgggagagagcgccgccggcggcggcggcggcggtggcggccccggggtctcggaggagctcacggcggcggcggcagcggcggcggcggacgagggccccgcccgagaggagcagcgtcccatccagccctctttcaccaagtccctctgccgtgagtcccactggaagtgcctcctgctctcgctgctcatgtacggctgcctgggggcagtggcctggtgccacgtcaccacagtgacgcgcctcaccttcagcagcgcctaccagggcaacagcctcatgtaccatgacagcccctgctccaacggctatgtctacatccccctggccttcctgctcatgttgtacgccgtctacctggtggagtgttggcactgccaagcccgccatgagctgcagcaccgtgttgatgtgagcagtgtgcgggaacgtgtgggccgcatgcagcaagccacgccctgcatctggtggaaggccatcagctaccactatgtccgccgcacccgccaggtcaccagataccgcaatggagacgcctataccaccacccaggtctaccacgaacgcgtcaacacgcacgtggcggaggctgagttcgactacgcgcgctgcggcgttcgcgacgtgtccaagacgctggtggggctggagggcgcgccggccacgcggctgcgcttcaccaagtgcttcagtttcgccagcgtggaggccgagaacgcgtacctgtgccagcgcgcgcgcttcttcgcagagaacgagggcctagacgactacatggaggcacgcgagggcatgcacctcaagaacgtggacttccgtgagttcatggtggccttcccggacccggcccggccgccctggtacgcctgctcgtcggccttctgggccgcggcgctgctcacgctgtcgtggccgctgcgagtgctggccgagtaccgcacggcctacgcgcactaccacgtggagaagctatttggcctggagggcccgggctcggccagcagcgcaggcggtggcctcagccccagcgatgagctgctgcccccgctcacccaccgcctgccgcgggtcaacacagtagacagcacggagctcgagtggcacatccgctccaaccagcagctggtgcccagctactctgaggcggtgctcatggacctggcggggctcgggacgcgctgcggcggggcaggcggcggctacgcgccctcgtgccgctacggtggggtaggcggcccgggcgcggcgggcgtggctccctaccggcgcagctgcgagcactgccagcgcgccgtcagcagctcgtctatcttctcgcgcagcgccctaagcatctgcgccagcccgcgggccggcccggggcccggtgggggcgcgggctgcgggggcagccgcttctcgctgggccgtctctacggctcccggcgcagctgcctgtggcgcagccgcagcgggagcgtcaacgaggccagctgccccacggagcagacgcggctgtccagccaggccagcatgggggacgacgaggacgacgacgaggaggaggccgggccgccgccgccctaccacgacgccctctactttccggtcctcatcgtccaccggcaggaggggtgtctgggccacagccaccggccgctgcaccgccacggctcctgcgtagagacctcactgtgacctccggccccggagtggcccgcgccgtcctcccgcctgcccctcgccggactgtgctccctctgcgacgcagggcgagtcaccacggtgactgaggccgcgcggggggcagggaaagggaggtgagggccgcaagacaggcccggatggggccgagacccccgctgtccctgtacataaagagaccgatgggtgggagggggtcggctgctccccgagatccccctggcagagtcattcttccagccccaaccctgagttcctaaagggacacctccctcctgtccagcccttcaacagatcttctgttagatgacaaccgtgccgtgggccccgccttgggccttgtctgaagggagaggccctggcatgcggatgggagatttagaggctgtggagaagggaacttggggctttccttccttcgtggcctcactcccctggggcctctctctatggagggggcaatggtttggtgaccagcaggctggattccaactagctaatgcattcagcaggtctgaggctggggccaggtgtcagccctaggcctccatccaacaccgtggaaatgttgctgccctcttcttggcgctgaccccaagattggggtttcctttctgccgctccctccactgttgtttatctaactgggcccccactccaggtccagagggactgtgctcactgcacagacatcactcaccttccgctccccagtcctgcagagctgttgccagggtgcagtggggaggggagtgaaatgtggaggactgtgtacctcagtcctctctctaaactcctcagcctcccaacaggggcctcctcacctgggttctgagtgtgtaccccttttagagagtgagatgccacccgggcagcactcgttaaagctggccagcacgagtgactaaggggagagagcatgacatagacctgggtggcaacggggacctctggaagcaggtgggagtaagagaggagagggcagtggagggtagaggaaaaggacctccagaggtggggtgtctgtgggggcggcctttgcctccctaaacctgtgcggaggagtggagtgtgcttgtcgctcaaacacatctctgggggactgaggacgttgtcacaagccccaactggagaaataattccaatggcagggtcagaggcaagcattctctaaatcttgcccaacccttccatccttccctatcctatgagctgaagccctgctgtgtgtcgcagggtcttcaaaggggcatcctgccaccaccccagggcgctggccccacgtcctgttcccctaaagctctgacaccgccttctctccgtgtgctccccccaccacctccaccctgatgtgcttcagtgtgcatgtctgtgaacagccctcctgccctgccaactcccctggctaaagtctccccagcagatttagcacccagggattgagctcacatttcaggctagagaggataacccttgggccacccacatctctcacccctgatgcttcttacttcgcctgagccatcagaactcctccttaccctccttcagcccctctcatcttccttcagcccagccaggcctgcaccaccaactgtgtggcctccacctatgcaacatcgcctctggctccccttcccttcttcctagcggggagtgtgaggggcccaaattgtggggataccatggcccatggcttctaaagggtttagctttactttcaggtagagatggctgagtgaggagggagaagaggctagagagagggaggcttgggcaggggaaacagctgcccaccaggttttcctggacagcagtgcccacctgcctactagcactgaacctgcctggaccctgagtctgtgctccttgggggcctggcgtttggagcacccttctttcctctgaatggacatctgtgaggtacaggtggtgagctgcagcctcaggctccatttcttagccagctggcacctggatgtcatgctttgtgtggggacagcctggccacctcagggctccaaggaaggaggaacgtggctcctcctccctcaggcctgttcctgagacagagcctggtctcacaagaggggaagggggacctctattattatttttgcctgtattgaccatttctgcctaggtcgtctcagacagcctcatctcccacacatgcacagacttagagagaaaccaattctttggtctattttcttggtagctttactgattgccagggaaaatgaaaaccagaaaattaattaatctctaaaattaaactttacactgaatgttcttgtttctctaattagaacttctgctagcagctgtggctatacacacacacacacacacacacaccctcacacctacacgtttgcactccggaactgtcagagggtgtcaggcacagacagactctaggttgcctagacaggcacacacatgcagtcactcccaagccccctttggtgctctgctcagcgcctgcttagtggaaggagtccctggagagcaggcactcctggactggggttgtagcccatgacctgccctttggggacacagttctggaggctctgggccaatgaatcagcccaaggaggatgggcaatggcgctcagcctgaatcagtcagctaggtctcttgtggccctgggggctgatgtgattcctgtaggtgtggccccagggtggacagctacagagtgatgggggactcatgtagggcacctggaaggctccatgtgtcctggggacaagggcttgtggggtgggctgggcctggctggggagaagacaggtctctgtcaattgggtgcatcacactgtggcctttttgtcgtggatttaagcgcaaagattgtacaaatcaaactggtggataataaagtcgtggatgactc

SEQ ID NO: 53366 - DNA, 1842 bp, Homo sapiens
acggggccccggctcagcaccccggagagctccctccccggccttgttttgctctggcatcgccgccgggggagggagcgagggggccgggcaccgggcgcaaaggcagggggatggccatggaagggttgaggggccccgtcggacagagggcccagccgtgatccagcgacgggtttggggctccgggaggggtgggggggcagcgggcggcggcagcagtggccgcacatctggatggaagcgagctttgtccagaccaccatggctctggggctgtcctccaagaaagcgtcctctcgcaacgtggctgtggagcgtaagaacctgatcaccgtgtgcaggttctctgtgaaaacgctgctggagaagtacacagcggagcccatcgatgactcatcggaggagtttgtcaattttgcagccattttagagcagatcctcagccaccgcttcaaagcctgtgccccagcaggtccagtgagctggttcagctcagacgggcagcggggcttttgggactatatccggctggcctgcagcaaagtgcccaacaactgtgtgagcagcatcgagaacatggagaacatcagcacagcccgggccaagggccgggcatggatccgggtggcactgatggagaagcgcatgtcagaatacatcaccacggctctgcgtgacacccggaccaccagacggttctatgactctggagccatcatgctgcgggatgaagccaccatcctcaccggaatgctgatcggactgagcgccatcgacttcagcttctgtctaaagggggaagtcctggacgggaagacccccgtggtcatcgattacacgccctacctaaagttcacgcagagctacgactacctgacggacgaggaggagcggcacagcgccgagagcagcacgagcgaggacaactcgcccgagcacccgtacctcccgctcgtcaccgacgaggacagctggtacagcaagtggcacaagatggagcagaagttccgcatcgtctacgcgcagaagggctacctggaggagctggtgcgtctgcgcgagtcgcagctgaaggacctggaggcggagaaccggcggcttcagctgcagctggaggaggcggcggcgcagaaccagcgcgagaaacgggagctggaaggcgtgatcctggagctgcaggagcagctgacaggtctgatccccagtgaccacgcccctctggcccagggttccaaggagctcactacacccctggtcaatcaatggccctcactgggaacgcttaatggggccgagggcgccagcaactccaagctctaccggagacacagcttcatgagcacggagccgctgtcagctgaagccagtctgagctcggactcccagcgcctgggagagggcacgcgggacgaggagccctggggtcccatcggaagctcagagccaaattagtggctcccttcgagcgaatgcccaggacttcaacgcatgcactttgtgttgacctcatccctggcttcaccttggtttttcccatcctagttctccctatgcctgaatatcctgtcttttcttttttataagcaaccacactgtattggatgaccctagatcttctttgagacaaggcaggctgtggccatgtagccccatcacactgtgtttgtgattgtctgtgtgtctgtctcccccaccagactgtgagctccatgagggcagggaccgtgtcttgtccgttctctgtatccccagtgcttggaacagagcgagtgctcactgtgtatttaataaatggacaaagagagaggatgaccctcaaaaaaaaaaaaaaaaaaaaaa

SEQ ID NO: 53367 - DNA, 1134 bp, Homo sapiens
agcggaggttctccggctccagctcctgcgccgcctgttgctcgctcctccgggcggtcgcttcccgcccggtgcccaggggtaggcggcccgagagcgcgcaggcagccagcctcccgccttcgtcccctccccgtaccgcaggagccggtccgaggggtccggagcgtccctgagagcgcggaccccggcgagcagcccagtgcacccgggactgcgcgccgagacccccggcgccgcgcggcgatgaacgcgaccttcctgaaccacagcggcttggaggaggtggacggcgtgggcggcggcgccggggccgccctgggaaaccgcacccacgggctgggcacgtggctgggctgctgtccagggggcgcaccgctggccgccagcgacggggtccccgcggggctggcgcccgacgagcgcagcctgtgggtgtcgcgggtggcgcagatcgccgtgctctgcgtgctgtcgcttaccgtggtcttcggcgtcttcttcctgggctgcaacctgctcatcaagtccgagagcatgatcaactttctggtgcaggagcgccggccctccaaggacgtgggcgcagccatcctggggctgtactgagcgccatctgggtccgccctcgccagcgctgctgcaagaaggaccccggagacccggaccctcgccccgctctctgcgctctgccgccgcctccgggcgggcagctacgtgcctggggcgcccgggcggggacgcggcgagactgtcggcgggggcgcgggaagggacttggacgcccggctctgtcctgtgtgcgctgcagcgttgcggggtgggagaatgtggggtgagggttcttaccagttttttttttgtttgtttgttttttaagacgttcggggcagggtgggagtgggtatggagatgcaatttgggactgcggtcgctcgcgtgggagttttgtgtgtacgttggtgcgggtgggttcggaacacggtgcgagtgggtgaagatgtgaagcgtcagagtcgctgagcttgttggcctgatcttgcgtttggaaagaaatcttgtaataaaactgcagccgtagggcttcaggcagcttcccaaaaaaaaaaaaaaaaaacaaaaaaaaaaaaaaaa

SEQ ID NO: 53368 - DNA, 3327 bp, Homo sapiens
ggaagaggaggggggagaaggaggagctgaagcgggaagagcggcaggcagcggctcggcggagttgcagcagaggcggcggcgacgctgagacaccgcagcttccctgagcgccgagtccctccggggacagcagcagggagcgcccgcgcagccaccgagcctctgcccagccaagccgccgtcgccgcgccgggggaccgccagccatggccgcgccgggggatccgcaggacgagctgctgccgctggccggccccgggtcccagtggctcaggcaccggggggagggggagaacgaagcggtgacgccgaaaggggccacgccggcgccgcaggctggggagcccagcccggggttgggcgccagggcccgggaagcggcgtcgcgggaagccggctcgggccccgcccggcagtcgcccgttgccatggaaactgcatccacaggtgtggcaggtgtttccagtgccatggaccacaccttctcaacaacatcaaaagatggggaaggatcgtgttacacatctctcatttctgacatctgctatccacctcaggaggattctacatattttactggaattcttcagaaggaaaatggccacgtcaccatttcagagagccctgaggagctgggtacacccggcccctccttaccagatgtgcctgggatagagtctcgtggcttatttagttctgattctggaatagagatgactcctgcagagtccacggaagtgaacaagatcttagcagaccctctggaccagatgaaagcagaggcctataaatacattgacataaccagacccgaggaggtgaagcaccaagaacaacatcaccccgagctggaagataaagacttggactttaagaataaagacactgacatctcaattaaacctgaaggagtccgtgaacctgacaaaccagctcctgtggagggaaaaatcatcaaggaccatttattggaagaatccacatttgctccatacatagatgatctctctgaagaacagcgcagggctcctcagatcaccacccctgtcaaaatcacactgacggaaatagaaccttctgttgaaaccactacccaagagaagacccctgagaagcaagatatatgtctaaagccaagtcctgacacagtccccactgtcactgtctcggagcctgaagacgacagcccaggatctatcacccctccatcttctggaacagaaccatctgctgcagaatcccaggggaaaggcagcatctccgaggatgagctgatcaccgccatcaaagaagcaaagggattatcgtatgaaaccgccgagaacccacggccggtgggccagctggccgacaggcccgaggtcaaggccaggtccggaccgccaaccatccccagccccctggaccacgaggccagcagcgcggagtcgggggactcagagatcgagctggtgtccgaggaccccatggccgcggaggacgcgctgccctcaggctatgtgagctttggccacgtgggcggcccgccgccctcgcccgcctcgccatccatccagtacagcatcctgagggaggagcgcgaggccgagctggacagcgagctcatcatcgagtcgtgcgacgcctcctcggcctcggaggagagccccaagcgggagcaggactcacccccgatgaagcccagcgccctggatgccatccgggaggagactggcgtccgggccgaggagcgtgcgccaagccggcggggcctggccgagccgggttccttcctcgactacccctcaactgagccccagcctggccccgagctgccccctggagacggagccctggagcctgagacgcccatgttgccacggaagcctgaagaagactcgagttccaaccaaagtcctgcggccacaaagggccctgggcctctaggtcctggcgccccgcccccactgctgtttctcaataagcaaaaagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcacgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgtagaatgttaaaaaaaaaaaaaaaaaa

SEQ ID NO: 53369 - DNA, 1710 bp, Homo sapiens
cccgtctccagggtagcacccttgggcagcccagccaacgctgtcgcgtggagcggcgcccgcatccccatgcgcgcaggcggctccggggccgcgccgcgctgattcgctgccggccgcgcagactgcggcgccagcgacgctcccgcccctcaccgcgcgccgcctggtgcagcctcagtctctccgcagccgcgcggccactgcgagcccagccgcagcagccgggcaccaacgcttgagtgcacgctcggcgcccccgaggagagccacggcgagcccccaaagcccgcacgatgcaggccactgccgattccaccaagatggactgtgtgtggagcaactggaaaagtcaggctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcacgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgtagaatgttaaaaaaaaaaaaaaaaaa

SEQ ID NO: 53370 - DNA, 2148 bp, Homo sapiens
cgtgtgtgtgcctccgtggctctccttcgctctgtgggacgacagaaccatctgctgcagaatcccaggggaaaggcagcatctccgaggatgagctgatcaccgccatcaaagaagcaaagggattatcgtatgaaaccgccgagaacccacggccggtgggccagctggccgacaggcccgaggtcaaggccaggtccggaccgccaaccatccccagccccctggaccacgaggccagcagcgcggagtcgggggactcagagatcgagctggtgtccgaggaccccatggccgcggaggacgcgctgccctcaggctatgtgagctttggccacgtgggcggcccgccgccctcgcccgcctcgccatccatccagtacagcatcctgagggaggagcgcgaggccgagctggacagcgagctcatcatcgagtcgtgcgacgcctcctcggcctcggaggagagccccaagcgggagcaggactcacccccgatgaagcccagcgccctggatgccatccgggaggagactggcgtccgggccgaggagcgtgcgccaagccggcggggcctggccgagccgggttccttcctcgactacccctcaactgagccccagcctggccccgagctgccccctggagacggagccctggagcctgagacgcccatgttgccacggaagcctgaagaagactcgagttccaaccaaagtcctgcggccacaaagggccctgggcctctaggtcctggcgccccgcccccactgctgtttctcaataagcaaaaagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcacgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaatgttactaaatgtagaatgttaaaaaaaaaaaaaaaaaa

SEQ ID NO: 53371 - DNA, 3408 bp, Homo sapiens
gctccccgcccccagccccggagcggctcgcggccggctccgcgccgcatcgctcgggtgcagcgcagctcagcgcagcgctgcggcctttcggcagccgaacggccgcggcagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtgggtacaggccagggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtgaaaaaaaaaaaaaaaaaaaaaaaaaa

SEQ ID NO: 53372 - DNA, 4939 bp, Homo sapiens
tctttttagcagcaacatacaagccggccatattagagagatggaaataaagcttccttaatgttgtatatgtctttgaagtacatccgtgcatttttttttagcatccaaccattcctcccttgtagttctcgccccctcaaatcaccctctcccgtagcccacccgactaacatctcagtctctgaaaatgcacagagatgcctggctacctcgccctgccttcagcctcacggggctcagtctctttttctctttggtgccaccaggacggagcatggaggtcacagtacctgccaccctcaacgtcctcaatggctctgacgcccgcctgccctgcaccttcaactcctgctacacagtgaaccacaaacagttctccctgaactggacttaccaggagtgcaacaactgctctgaggagatgttcctccagttccgcatgaagatcattaacctgaagctggagcggtttcaagaccgcgtggagttctcagggaaccccagcaagtacgatgtgtcggtgatgctgagaaacgtgcagccggaggatgaggggatttacaactgctacatcatgaacccccctgaccgccaccgtggccatggcaagatccatctgcaggtcctcatggaagagccccctgagcgggactccacggtggccgtgattgtgggtgcctccgtcgggggcttcctggctgtggtcatcttggtgctgatggtggtcaagtgtgtgaggagaaaaaaagagcagaagctgagcacagatgacctgaagaccgaggaggagggcaagacggacggtgaaggcaacccggatgatggcgccaagtagtgggtggccggccctgcagcctcccgtgtcccgtctcctcccctctccgccctgtacagtgaccctgcctgctcgctcttggtgtgcttcccgtgacctaggaccccagggcccacctggggcctcctgaacccccgacttcgtatctcccaccctgcaccaagagtgacccactctcttccatccgagaaacctgccatgctctgggacgtgtgggccctggggagaggagagaaagggctcccacctgccagtccctggggggaggcaggaggcacatgtgagggtccccagagagaagggagtgggtgggcaggggtagaggagggggccgctgtccacctgcccagtgcttggcctggcagtggcttcagagaggacctggtggggagggagggctttcctgtgctgacagcgctccctcaggagggccttggcctggcacggctgtgctcctcccctgctcccagcccagagcagccatcaggctggaggtgacgatgagttcctgaaacttggaggggcatgttaaagggatgactgtgcattccagggcactgacggaaagccagggctgcaggcaaagctggacatgtgccctggcccaggaggccatgttgggccctcgtttccattgctagtggcctccttggggctcccgttggctcctaatcccttaggactgtggatgaggccagactggaagagcagctccaggtagggggccatgtttcccagcggggacccaccaacagaggccagtttcaaagtcagctgaggggctgaggggtggggctccatggtgaatgcaggttgctgcaggctctgccttctccatggggtaaccaccctcgcctgggcaggggcagccaaggctgggaaatgaggaggccatgcacagggtggggcagctttctttggggcttcagtgagaactctcccagttgcccttggtggggtttccacctggcttttggctacagagagggaagggaaagcctgaggccggcataaggggaggccttggaacctgagctgccaatgccagccctgtcccatctgcagccacactactcgctcctctcccaacaactcccttcgtggggacaaaagtgacaattgtaggccaggcacagtggctcacgcctgtaatcccagcactttgggaggccaaggcgggtggattacctccatctgtttagtagaaatgggcaaaaccccatctctactaaaaatacaagaattagctgggcgtggtggcgtgtgcctgtaatcccagctatttgggaggctgaggcaggagaatcgcttgagcccgggaagcagaggttgcagtgaactgagatagtgatagtgccactgcaattcagcctgggtgacatagagagactccatctcaaaaaaaaaaaaaaaaaaaaaaaaaggcaattgtgcggagccaaccatcactgccattacactcacattcaatggaaattgattaggcctgagagaaggagcaagaggcagaaacactgactctgagaccatgaccttggaagatcctcagagatcaactagccaagtcactcacttaaaatggggaaactgaggttccaactgacagaaactgagggtcctgccctcttctctggctcctcagtctccagtttgaagcaacagagccatcattttcccagtgggaggggcctctgtgtcctggtctatgatggggcgagttggaggggtgggcttctctagccctgccccctcccaggagcccagcccctctggccaggactgaggaggagtggagggaagcagggagggagggagcaagtgtgaagggcacagctgctggcaaatgccccattccctgccccagcacttcccagcctttccaggagctctgccccacccctactcaaggagtcaggtgcccagggtagggaataagtctaggaaagggggtggagacaggaccgtgacagtctcagggaccaatccctgcctctgcccatcagattgccaatttggggagacagcaatatcatctgggagattcagcttaatttgcttcaattcagcaaccatttattgagcatctattatgtgccaggcactgtgccgggcactggggatatacacaaagccataagcactggggactgccaggttggcactgtagggaccaagattaactttttggtgcatctaattccacctctgcaagacactgcttccaaggctacagttggggaagatgaagagattctagaatctgtgccctgggaagggagaaacagcagggaagaggggcaatacaacagggtcaagggtgcagaggccaggcagagtgggtgcagagtgggggatgggcaaccagcctggtaacacctgggtgaggtgagcgagtcaagcccatctggaaatgctaaactcatcagctcagtacctaactgccaatcaacacactgccaatgcgggtgggctaagccgccaggatgcctgcagcagatggacgctgcccatccttgagccagccagctgggggcagagaggtgggtggcgggcacctcatgccagctgagaccaagagtggttgtatacatttctgcagcttgcagatttcatttttttggtcaccctttaagtgtccttctctcccaggatgagtgaggagctgtgctgatgttgggaacttatctttttccaggatccataacatttaggggaattatttgcgggctttcctagtgtattctaagaagttctaactctccatcaagaagcccaagattcctggagtctttttttcctctgccctgatcaactggggcccaggaaaagcaatgtctcttcacgggcctcagggccccagcagatggggctgggtcaggaaccatctctgtcccaggtgctcagccctcatatgcattttcttctggagcctcttagaatctcctccagaggactcatagagctgcctcccccaggatggtgaagttgggagcaaaatggggcttctgtaagtagaggtggaaaaccagagagatgtttccacagcagccatttccctaccctgtttcctaacttatgctgacaagttcttcctcttcctaccgtggggttcgagccccacttctggttgcatgttcccaccaccacgctctgctggttttagtcggctgactttctcaactgccccagcctctcctgctctctcagaacctccctctgcccccaccccccatctgtctcttcctcctaattaagggccactgcaaagagagacgggctggctaacccatgggatttagcttataagaacaaagcacaattattcaggactgaactgctttgaggtgccttggaactggctttggaaatagctatctgccccctagctatggactcttcacagttatttccagtttataaaaaggaaaagctgatcggatccatgtttctctctgcgagtctccttggggaggttgggctggtaaatatttgcaaggtcaggttaagcagacagacaattgaaaatactgggcaggtccaaaaggatagttccaggccataggaatggcttggtgcagttaacgggtgatgaagcaagaaatcttccttcctacttatgtcttaaagatggacagcctgtgtctcttgctgtgcctcttgctggcgtcttcctttattgaagcttgctgatgcactgtacatagtctctctctctaggtatagatatattatatatacaaatatcaaacatctcaccacacccaccccaaaagttacactgtgtgtgtgtggggaggtgtaataacttctcagtgttttgagttgattcaccaaaggcaaattttggaatgttcttgcgctttgtgcacttggaggggaaaacccaactacatatgcactttcttggttgtgtgtgctatagagaggttggaaggggtggttggaaggggagagaaactgagatggccctctgtgactcgactgctgggatgtatctgcttttgggagcagactgagtttcttttgcaatttgtcttattgtttgggtctactggcaacaataaactatctcccctgaaaatcaaaaaaaaaaaaaaaaaa

SEQ ID NO: 53373 - DNA, 4052 bp, Homo sapiens
cagggctgacagcacacacggcctgggggcctagagaaggattgctgatcacctgccacccagggtcggggccccgcaccatccgggggcgagctcccgggaaggggctccccctctacacccaccccccaacctctgacatcgccggccgaacgggagctgccgcttccttcccggccccgctgcacctccccagggagccgagggcgggcgtggacgggaccgacgtggaacgcattctgtagcccagacgggcggccccggcggcttcgggagtggggtcacgcccagctggagaagcagttagggcggacgaagcaggagccgcggggctgggaggattccagtcggaacgcaaccgatcctggggaggcgagaggtgaatcaacctggacccttccacagcctggctgctaggccagcagtgcgactcccttccgagctgagcttaccctgggcgcaaacgagcgaggcaggggcgcgagtggaagctggagttccggggtgggcggggaggcgactgtccgtggtgctgagcgccggcgagagcgggcgcggagcggctgatcagctccctcgaactggggaggtccagtggggtcgcttagggcccaaagcccccgcccggctccaaaagctcccagggcctccccaggcaccggtgctcggcccttccttcggtcagaaagtcgccccctgggggcagttcgtcccaaagggtttcctcgaaagaatctgagagggcgcagtccttgaccgagggaatctctctgtgtagccttggaagccgccagccccagaagatgcctgccttcaatagattgtttcccctggcttctctcgtgcttatctactgggtcagtgtctgcttccctgtgtgtgtggaagtgccctcggagacggaggccgtgcagggcaaccccatgaagctgcgctgcatctcctgcatgaagagagaggaggtggaggccaccacggtggtggaatggttctacaggcccgagggcggtaaagatttccttatttacgagtatcggaatggccaccaggaggtggagagcccctttcaggggcgcctgcagtggaatggcagcaaggacctgcaggacgtgtccatcactgtgctcaacgtcactctgaacgactctggcctctacacctgcaatgtgtcccgggagtttgagtttgaggcgcatcggccctttgtgaagacgacgcggctgatccccctaagagtcaccgaggaggctggagaggacttcacctctgtggtctcagaaatcatgatgtacatccttctggtcttcctcaccttgtggctgctcatcgagatgatatattgctacagaaaggtctcaaaagccgaagaggcagcccaagaaaacgcgtctgactaccttgccatcccatctgagaacaaggagaactctgcggtaccagtggaggaatagaacaggagcagtgtgacatgaggtggcctgaacacctgagggactggacatcccatgttcagcaatgtcaatggcatcaggagggcgccccaagggccccatcgcttcccttcatgcatccattgttctgttcattcattcatccatacatccacctgcctctgagctttcacctctgactccctaactccatcagacctctacgcaccataagactctgccagaactgagaagccaacatttctacatagactcaacctcaccctctcctagttttccaacaagacactccaaagccaactggatttctcccctgtgctccaaatgactttgtacaagtgctggagttagcacctccctctgcccttaactggctggaactggttcattctccattactgcaagagaatggaagtcttaatagaaggaagcaggagtgattagttcgggttaaagcaaaagtgtgtcatgaacttggattccctgaagtcagttttgtcaggttcatggcccactttgctacagcatcagagtgaagcacgcctgtctaggttctccagtgacagaaagatcctgaagcatggactaacatgctctctggagcttagtactccagagctagatcctgatgggtctctaaggttccctccaagaagacaaggacaggagacttgggaaggaccaatggtaatttaagtggctcttaaaaagtcatgcaacatgtttctggacacgttcctgatcctattgcgataatgtatgtgtgccctccctgtgggcacaccacctgggcattaggactgaaattcctgagttcttcctctcaaaatttctgtgcaccagtattattcctcattttacatacaggaggcaactaagactcatacagggctcaactgaataagaggcttaagaggataaactggagcagaaataagccttaggtgctgcccagtttacacttcctgggatggatgtttttgtttgttttgttttttgttttttttgtttgagatggagtctcactctgtcacctaggctagagtgcagtggtgtgatctcggctcactgcaacctctgcctcttgggttcaagcaattctcatgcctcggcctctccagtagctgggattacaggtgtgcaccaccacgcctggctaaattttgtatttttagtacagacagggtttgactatgttggccaggctagtcttgaactcctgacctcaaatgacccacccacctcagcctcccaaagtgctgagattacaggcgtgaggcactgcgcccggtggataactttgtttctgaaaagactgacattgaacttgtctatggcaatgcttctttcacaagcacggactgggctgaggtcaactctgatagattcagatgactagaaattggccaaaaaagcagggagaagaacatgaggtagacttaaagaacttcctttatgtaaagatctgtgactctgaaatatcctccaaaaggagagtgcatctgagactgatatttaaactaagaaaaatgtttagtctgagatggatcataagtaaatgagcagtgtgagaggggagggatgggtaggtgctttccaaatacttcgcctatgaatgcataattttcagatttttttcccctagattttgagggagcagagaaactggaaaaaactttagtcaatatctcgtgtttcattttaattaagtgacaggtccaagtgtgacatccttcagcacccagggacaagagaggggaaagatgctttatggaatgtaagaagatgaaggtgactgggattcagcgagagagaggtccctcagacctgggacctccctttatagggaaagaccatattccataggtttagggctttaccttaaaagctcatttttttcattcttccatccctaggaaagtacttaaaaccagacttttaaatttttatttatttattattatttttttgagacagattctcactctgtctcccaggctagagtgcagtggtgcaatctcagctcactgcagcctcaactgccccaggtttaagcaatcctcccacctcagcccccaggtaactgggactacaggcatgcaccaccatgcctggctaatttttgtattttatgtagagacaggggtcttgccatgtcgcccaggctgatcttgaactcctgggctcaagcaatctgccagcctcagcctctcaaagtgctgggattacaggcctgagcaactgtgcctggcccaaaaccagaccgttaacacattaaagagtctgattttgttgaagaaaatatttgcaataaattcaagactcttcttattggtaattttccacacaatccctctgaaataagggagaggatatagacctttttaactttatagttagaaaaattggcctcagtgtgaaatttttccagtcccatagctcatggatgccaccagcttgcggtagtagcaagatgcttactaccacaccgttttcctcggtggcccaatagctcgtgtatctaagttgaacccggcagtatgcatgattgcctttttctcttctttttaaaaaaacccaactcaaaaaaaaaaaaaaaaa

SEQ ID NO: 53374 - DNA, 4489 bp, Homo sapiens
cgtccgctctgcccgctaactttcccgagccccgaccggcggcgcagagctccggggtagctttgtggccgaacgccgacctcgggcggagagcgcggctgtgcccagtatcccatccccgcgacccccgcgcgctccggagagaacaggactatgcccggggctggggacggaggcaaagccccggcgagatggctgggcactgggcttttgggcctcttcctgctccccgtaaccctgtcgctggaggtgtctgtgggaaaggccaccgacatctacgctgtcaatggcacggagatcctgctgccctgcaccttctccagctgctttggcttcgaggacctccacttccggtggacctacaacagcagtgacgcattcaagattctcatagaggggactgtgaagaatgagaagtctgaccccaaggtgacgttgaaagacgatgaccgcatcactctggtaggctctactaaggagaagatgaacaacatttccattgtgctgagggacctggagttcagcgacacgggcaaatacacctgccatgtgaagaaccccaaggagaataatctccagcaccacgccaccatcttcctccaagtcgttgatagactggaagaagtggacaacacagtgacactcatcatcctggctgtcgtgggcggggtcatcgggctcctcatcctcatcctgctgatcaagaaactcatcatcttcatcctgaagaagactcgggagaagaagaaggagtgtctcgtgagctcctcggggaatgacaacacggagaacggcttgcctggctccaaggcagaggagaaaccaccttcaaaagtgtgagccctgcttcgggctgagcagctgcagggagccccctttctgatgatgaaactgatgcttgagccccgaccgtagaacccacgtgcctgagacatctgctgcttggctcaaactgtagtctttccgggcacaagaaaccagagtcctgcccagcctgcccatccccttcccagtcagggctccccagggacaagggatggccaggggagggggtctgtggaagattcaggagaaagaaaggagaggctagggtggtgtggaggggctggtcccctgacacctgggcagatggggtctccttcagtctccctaccctgcacaagcagggccttgattttcctccaggcttctcttcacaagagactgggaggatccgtaagggatgtcctaagagctgcaccctggagatggggtgtaggaagaagtggcttcctttggaggtgggagtgggctggaggcctctggagaagacctggggtgggggctgatgggggcaggcccacagtgagagactgcctctgcttcataggataccagatcccccacagtcttccaagtaggaaacttcctttcccctgccccgggaccctatctgcctatcccctcccctgctcagagtttttaagccctctcaaccagggctggccaccctggtcttgagggttcctggccacctagcctgctcctctgctctctgggttactgaggggctcaggaaggggcccctcgagccttcctggagtacccgagtgctccctatgcctttccaagcatttctacttggagaattgggccacagaggtagtgagccagtgtcctgggcctctgggatgcccgccccattgctgccaatgctggcagcccctcccctggcatggcaggaccatcgccactctgggcactcctgagcccagctctcccctgcttctccccctcctacctgagaggctgcaccctccaacctcccattggctcgctccccccgcccaccgtgccctccatcacgccctgcccccagggtggttcatttcccagccctgggtcaagggcctgccttcgcctcagggactctcttcctttggatgagggggtccttgggtttcccagctgcttcctgctcagctgggccaccccctcccaccctggggttggggaggagcagggagtgggtgcccacagttttcctttgcttctcccagagctggtttgcacagcccttgtgtgtggggctagaatgtgccttagtcctgaatcctagcccttacccccatcctctctagacggtatgtcctgacataacagcagagtctggtgtggtgctggtgagggttcaccagccctcccctccccagggtcatagagggggccatgaggctggaattggccagtgactgaatcttggagatgtcggccaggtgctcccattggggtttctagcctgccctagggggaggtggtgatgttgggagtgggatctcctgagtccttgttgggcagaattggtgaggccagggatggcagggaaaagtggtaacaagcctctctgcccatctacttccaatccctctctcccttactgattttttgatgccctgtcttctgggcccctaggagggatgagagaggagtagccccctttttcagagagtttggggtctacctcagagctctccctgtcaaaaagcagctgcaagcctcgcaagggtggagtggggggagactgaggaccagtagtacctgcagggtgcccgtggctgtggccagtgtcccttagccaacctgctgggctcaccagttccccgtctgatctgcctgtgcgcctcccattcttctctacccagaacctgtcatgggctggggctcagattttcctggctttgggagcagacagaccagagccaccagccattcagaaaacttcttatagctaccttcatgcaaaactgttttcttcttccttctcaatggtgacatttgaagaggcagagcaccttggggctcctccttctgtcttaagagaaagccaaggcacgtagagtagggagaagaagggcaccatcctctctttcctccccagggtctactgctgatttctagatggatcatgcagcttctctcagctcagctctttccatctaccaaatgggtgtaataatacttacctacctcacaggactgttgtgaggcttggcaagttttgtctaaaaacatctttttggcttggaaagggatctgggaagccaggtattaattgcagggatagttccaagtctgtcctgtcttcatctctgtgtcccatctctacaacccacatacagacacacacactctctctctctttctttccatcccaccccccttggaattatttagtctttgcaatattagaaaccttgactctgatgcttaaagcttcttgtccatggcttttgtttgatggttttcaatagaggtgactgagattgtagggggggcatttttggttgcccccatgcgtgggggcactactaagaatgctaaacttagtccccacaacaaagaatcatcctgtcccatgtcaacattatacccatggagaaacactggcatggatttgcactaggatgtatatgggcaaagctatcttccccaagtggaacctcagtgcatgcaaatctctgatggtggcttccagggcttgtgggctagagagagccacttacaaagtcgatcttgagagacctggccacatgcagctgggctgagtgatgtcagcgagactaaagacaaagttctgagctcctcatcaactacaaaatatgaaatcagcattccaggttctgggcttctccccatgtcgtaattgaacagaaggcagcccgaataaacccctgatgttagagaggcctggggagagcagccgatggggctcagactacatatggcaggccgatcagagctcttgtggagcgagggcttgagagcatgcttgtgagatggcaggaggtggggtgtgcttgtgtggagtgtgcgtgtgcaggcagtgtgggtgcatggcagcgtaactgtggagtggatgggctctgcatgtaaggggtgatgcatgatgggcagatgctggacatttgaggagccgtctttcttggcctgagctatgcctgttgaggcatctggagactgagaaagaatcaaaggcagagaagaccagccgtgctcctgcattccgtcactccatgacttcatctcagtgtcacagacagctgccatcagagggctggcagtagggagttccaggagcggggacttctcgggaaaatcctataacttgctttactttactttgtcccaggttggagtccctaccctcccacctcccacctgatatgcagtgcttttgactatcttatgcatggtttattcctctggcttggatgacaacaatacccatagtcaattttcctatgtaactatagatcaaatgatgcaacaacaggccttgggaggcctcaggtgtgcgagtgcctctgggaggcgcagatgcccacacagccagcactgacttgtgttcgagcacagaacggatataatcagtctggcctctacaacaagttttgcattgtagaattgtatttagctttgccttggatgaaataaaaattatgtttaataa

SEQ ID NO: 53375 - DNA, 5228 bp, Homo sapiens
actgcagctgcagcccccgaggtcgccgcagtaatccggacccggcagcacccgcaccctcggcggccgcagcctcagcaccgcagagcggagagcggagcccggagcccgccgccccaggatggctgcagctcctccaagttactgttttgttgccttccctccacgtgctaaggatggtctggtggtatttgggaaaaattcagcccggcccagagatgaagtgcaagaggttgtgtatttctcggctgctgatcacgaaccggagagcaaggttgagtgcacttacatttcaatcgaccaagttccaaggacctatgccataatgataagcagacccgcctggctctggggagcagaaatgggagccaatgaacatggagtgtgcatagccaatgaagccatcaacaccagagagccagctgccgagatagaagccttgctggggatggatctggtcaggcttggtttagaaagaggggaaacagctaaagaagccttagatgtcattgtctccttgttggaagaacatggacaaggtgggaattactttgaagatgcaaactcctgccacagcttccaaagtgcatatctgattgtggatcgtgatgaagcctgggtgctcgagaccatagggaagtactgggctgccgagaaagtcacagagggagtgaggtgcatttgcagtcagctttcgctcaccactaagatggatgcagagcatccggaactcaggagttacgctcagagccaaggttggtggacgggagagggcgagttcaatttttccgaagtcttttctccagttgaggatcatctagactgcggtgctggcaaagacagcttagaaaaacaagaagaaagcatcacagtgcagactatgatgaacaccttacgggacaaagccagcggagtgtgcatagactctgagtttttcctcaccacagccagtggagtgtctgtcctgccgcagaatagaagctctccgtgcattcactacttcactggaacccatgatccttccaggtccatattcaagcctttcatctttgttgatgacgtaaaacttgtccccaaaacacagtctccctgttttggggatgacgaccctgccaaaaaggagcctcggttccaggagaaaccagaccgccggcatgagctgtacaaagcccacgagtgggcacgtgccatcatcgaaagtgaccaggagcaaggtcgcaagctgaggagcaccatgctggagctggagaagcaaggcctggaagccatggaagaaatcctgaccagctccgagccactggaccctgcggaagtgggggaccttttctatgactgtgttgacacggagattaagttctttaagtgaagtaagcattccctttccccttcttatttaagacttcccaccttactaaattaccagcaaaacaaaccactctcctgtttgagtaaaatgagaaagttaatatgtggcctccttttctgaagccagatcaaactgttaccttgtgttccaccttgaatctcacagcgtccccttctgcaatgtaggtctccttcctgtgcagtgtaacatgtatcccgttgcctgttgttcggttgtgtgactaattgtggattttaagctgctattattgtatttcagtggcaatggacacattagccttttacaagaggactagagttcatcaagccttgaaaggcaggcttcacagtgccgagttggcgggaaaagcaaattcttttgaagtcttagtctttccctcagtagcggtttctttcaggttaacaagaggcatttgtgcacacacacagggctcttgggtgtgttgtcaaggggaccctccgtggcctcctgtgagtgcatgcctgtagtgcacagtgtctctacaggtgtcttctggggggcagaaccaattggaaggaagaaagggacccctctccagtcctggctccttcctacatcctgggctcctgaagaagctgtcttcccattttccatgcactgtgcttatgtgtggtggactgcagagctgcttccacttacaggagagctgataatttgttagctggaacctattcacttccgagattcagacatagccatgctggtggccttctgaatcactgcatggatgtcccaggaggcagctctccccacacagcagcacagccatcacaggattccttgtgtagaaatgattcccagtctagttaccaacagctagtctaggagtaattgaatggccctatggcacagttccacccacagagtggtgaatctctcagccaaggagggaaagaaaaggaagaactcttgactatttagattctagttaaatatctggaatcttagcagtcactacattatctcagcagagagactttaattaaactgatttgtttccaatgtcgggttcacttaaaggatttgacttaccaccagagcatagaaaagcatgcaaggaagaccagatgggcttagcattgggaagacagagggcaaggaggcgatagatggatatagaagcatttctctgcaggataccagttcaggccccaccattcctgccaaggccattacatcccacaaacccaaatacaaagcagctgacttccctggatcttccccccactcctcacacctcacatgtccgaggagctgccttcattcaggcgggtagctgcactgggcatggggtggtggtgggagcttaccgccacctattcaagctctcagctactcctgaaacgggcagagatgatgaacagaagtgtatgtaaatacagcagctagtgggagagcaccagttgggcctaatcctgcctcatcattcttggcaggaatctgcaaatggaaacattgtgagtatcagcaatctgggaagtgacagggttaataactccttcccagaagctgtatcatgagattttgaggggaccgagccctgttacatggatgtgaacagtgaggatcagaggttttatcagaacacattatttttttctaccaactctccagagcgtgagtataggagtgccatgagctttttactcagcagttttgtaaactctgtatataaaatcattaaccacacattgtgggtgatgggaagacgatttcagctgacagagttaatggcaaccaataatggtggcctgtagctgctaagagcttcacgcaggtttggcctgggctttcactgttggtgaatttagagtgtccttttaggtggggcggctattctaaaagtgtctttctatcactgttaaggggggcggaaagtgaggttcgaggatgacgtaggtaactctcccctcccaagtccatgttccaagtggctatgtaaagcaagatgatacagaaagctgctctaaaatctcactgagtgatttcaccttcgcctactatgaaatgtctcatcagacctgacatgtctgagataaccaaggtgattcaggatttgatcaaaagaagtctagtaagaattaattacacagaagcctcctttcatttctatgggccaaacaaaggccatggataaccctacccgctttatgtcattacccattgggaaacacaatggctacttctgttagggtacattgaccttggtcaagcatcttaaagaaggcaaccctaattgagagctgtcttggctaatactctgcaccacaattgtgatgtcctagtcctaccactagagggcatggtacagcctggcaaaagttaaaaggggtgtggcagctcccatcaggtctggaggtggtctataagcacagttgacagttgtgcattgggatgggtggagaaagacgacaagagagcagagaatctgctgatgtggctgcgcttacttttagtgactttatgtacttatattaacagctggaaataggttgttgggttttgagcaggctgttatagtgaggaatgttcatttttaaatgttcctaacagattttgcttttgaaaaatgcttgttacatgaataatttgtggaccagggattgcttttctgaaggcagtatagggaacatgaatattcaagatgaaatacaaaaattatgtttaagggtcatagtgtataagtagcttcctaggaaaccatttgtgtatcttttctgactgggatgggggctgagcatgcttgtgcagaaagaagccatagcaagaaaggacagaatctctcccccactcccttgccccataaccaaacataagctagctagtcttgtctaatagatgggatttactataggtgaagatagccatcatattcaaggacagaagctctggcaggagtaaattagcaaagcagaaatagtaccctttcattcttagaggtgctttgaaattttaggtagaatataatcgaaattatggaggttccttagtgctcaataatataagacctgttgttattagaacgagtctttcttataaactaacagagcaggtatatgcctgttagatcttagctgtggggttcctttactattgggtgaatcattaggtataaaaaataatcatcaaccaggcaaattactttgcttcctagctgatgtcatcccacattggtacaggtgttattcagtactgggtggttcagcagggaagccaggtgggaccagtgtgtctgtcatgaaaccactaactgcattcctgactgaagagccatctgtcatttattggggaaggtcttcagttgagctctcagccttagtaaggaagcacgtggaggagggacggaggaggttcccttgctgggcatgcttcgtagagggccaggagcagcaggtcatgtgcacatgccgttgcagcacaagcttatgcttcccgtagccgtggcttttcattctgcacagtcccaggtcccagctcccctcttatggtttctgtcataatgtgctttatctgattgactccaaacatcccgaaatgtcacctgcagatttctcgtgggaaccaatatgtacatgtttgcaattatgctgtgagaatttaaatgtgttagatggaaaatgctattggcagggaataataataaaaaaaaaagaaaatcattctgtttcctgcagtgggaactggccatgtagtcttaacagtcttttgtacaaatatctacaaagcagataatatccctatccagtgcttgcccttggaattgtctctaaatgcatcaagcatacaataaaaaaaactgaaatcaaaaaaaaaaaaaaaa

SEQ ID NO: 53376 - DNA, 3552 bp, Homo sapiens
gtggggtcccgcgctgcctccgccgctcctcggatggtgacggggccctgccgccgcagcccccccaagccccggctccgcaggcccacagcgccggagccccgcaggaatcatgcccaggtccttcctggtcaagaaggtcaaacttgacgcgttctcttcggccgacctggagagcgcctacggacgcgcccgcagcgacctcggcgcgccactgcacgataaagggtacctcagcgactacgtggggccctcgtccgtctacgatggcgacgccgaggctgcgctgctcaaagggccgtcgccggagcccatgtacgcagcagctgtgcgtggagagctgggtccggcggctgcagggtctgcgccgccgcccaccccgcgcccggagctggccaccgctgcgggcggctacatcaacggcgacgcggccgtcagcgagggctacgcggcggacgccttcttcatcaccgacgggcgctcgcggcgtaaggcttccaatgccggctctgccgccgctccctccacagcctcggcggcggcccccgacggcgacgccggaggcgggggcggggcgggcgggcgcagcttgggatccgggccggggggccggggcggcacgcgcgcgggggcaggcaccgaggcgcgcgcggggccaggggccgcaggtgctggcggccggcacgcgtgcggcgagtgcggcaaaacatacgccacgtcgtcgaacctgagccgccacaagcagacgcaccgcagcctggacagccagctggcgcggcgctgcccgacgtgcggcaaggtgtacgtgtccatgccggccatggccatgcacctgctcacgcacgacctgcgccacaagtgcggcgtgtgcggcaaagccttctcgcggccctggctgctgcagggccacatgcgctcgcacaccggcgagaaacccttcggctgcgcgcactgcggcaaggccttcgccgaccgctccaacctgcgcgcgcacatgcagacgcattcggccttcaagcacttccagtgcaagcgctgcaagaagagcttcgcgctcaagtcctatctcaacaagcactacgagtcggcctgcttcaagggcggcgccggaggccccgcggctcctgcgccgccacagctcagccctgtgcaggcctagggcggcggggcctcccccagccaggtcggctctcagcaatacggccccccagggaagtcttcgctggcgtccgggtggaggggccggagggcgggcccctcctcacagcaatagggggaggggggcccggtcccaccccgccccgcccgccaggggccttgccggccccttcaagcaatagggtcccgaggggagacccaccccgagccccctcccctcccctccagggtgcccccggctttctcccagcaatagggtcgacgagacctagaaccgaacctcatctccgagttgggtctctgaagacgggggtgaggtgaggtagggagcgccctccttctcccgcctctgcgcccctggatcgcgtcgcagggactcaggtcttccccaccccttcccaagccttctagcgcagggcctgcggcccagacgtccagggagccggcccctccccggcagcaggccggggcggagcaggagcgggcgggcctgcagggacgcccctgcctagcagccttcgcggaactcccggcagtgttagacgcgttgtgggtcggggagaggggcggacggcggcaccccctccctcgggttgcttctggggcctcagtcggagccgccctcctaccctcgcctcgcatcctctgccaaatccgaattcttccagcccagcttcccgggctctgtcctccatatcgaataataatgacacatatcgaatcgcatggacttatccgacctcctcagaccccgcttccgccctgccccgggcccccacccccccccccgtaccccaggcattcgtgttggaggacggattcccggggccggcaggcaggcctgggcgctgccctctacacacctctgtcttcgctttgcgggtaaagccccctgggggggttgcggacgcgtcgggtttctttttctgtatttgtacgttttatttatgaacggattgcactcgggtcagggagggggcgctgaacccccatcttgcccgccgacgccgggggcctgggatgtccgggattactttccacgccccgaggcccgcccctagctgggagcctctagggagcctcaggccccgcctctccgaggcaggcccctcccctgagacccaggccccgcccctgagacccaggccccgcccccactcggttgccaactttcgcccgtctatgccaaagcctcggcggcgaccccgccccaagggcccgccccattggccgccgcctttgtgacgtcactgcatgcagccccacccctcctcccgatcctacccggggctgcccgctccccctccctcttaggtagtccgaagccgactatagagcaataatgcgcactgcatgcgaagctgccgccgcctctagagttactgagaatcaggtatcccctcgccctacccaccccataggcccctagatcagggacgctgcgcggggccggccgcgcagactttctccccacccctccccgacccccacggcagagcccggcggctgtaatggttccatgggcgggggtggggtggttgcccccaagacccctccttcaggcattaatcattcactgaccgttcattgagcacctactatgtgccaggccaattgctgagtccgccaggagcgcagccacctgctgggaggtgtgtttgcaggacaggggtccaaccggcttgggtgggccagggaagaacggcagatgcagagagaccaggtccctaggttcacatgccccctacactcctccccacctcaaccagtccctgctgggcacaactgggctctacctttgagttaggccttttgactccagctgagggggacagatccagggctcctgggcccccacacaggtggccacttctctgatcctctggccaacacacatctgccatgtccagccaggggcagagccatggctggagaagaaggtgccagctgtagcctatggtgtggccagcctcacccccagcagcaagcgtggctgcccccacaaggatgacccaccgctctgcacagcagtgcccacatccaaacaccctacacaaccaggtgtggtgcctgcacagctcccaagctggggcctgcccacctgtgccgcatgcacacgcacacacaggcgcccccacctcaccccaccccatactcctgtctacctacctaaggagaaagctggagggctgtgggcccgtcagggtctcctgcttccccctacaccccgccgccgtggaaagccatgggccccctcccgcccccataactaagcagcacaataaccgacttagcgaattcaggtagaaggaacgtttaggtagcacctattttgtactgattctacaagtagggcccgaggtgcgggggccctcgggtgggggctgcggccgc

SEQ ID NO: 53377 - DNA, 6513 bp, Homo sapiens
atgcgcttcagcatggttgaccgtgagcacattaggctcagccaggatctccgctgtcccgggtcctggagctctctcggcccggcaggtttcgctcccgcccctccggccttccacagctgtcctggccgcagggtgttcaaggcgggacacaccaggctagagatccgcgatcgggccccgcctcaggctctgtgcacacccctgcctggtgacctccattggtgctccagcgtgaacatggtgcaaagataccagtctcctgtccgagtctacaagtacccgtttgagctggtcatggcggcctacgagaagcgtttccccacgtgcccacagatcccagtcttcctgggcagcgaggtcttgcgcgagtcccgcagcccggacggggctgtgcacgtggtggagcggagctgccggctgcgcgtggacgccccgcggctgctgcggaagatcgcaggtgttgagcacgtggtcttcgtgcagacaaacatcttgaactggaaggagaggacgctcctcatcgaagcgcacaatgagaccttcgccaaccgcgtggtggtgaacgagcactgcagctacacggtccaccctgagaatgaagactggacttgcttcgagcagtctgcctcactggacattcggtctttctttggctttgaaaatgccttggagaagatcgccatgaagcagtacaccgccaacgtcaagagggggaaggaggtgattgagcattacctgaatgagctcatctcccagggtacctcgcacattccgcgctggacgcctgccccagtccgtgaggaggatgcccgcaaccaggctggaccgagggaccccagctccctggaggcccacgggccccgtagcaccctggggcccgctctggaggcggtcagtatggacggggacaagctggatgcggactacattgagaggtgcctgggccacctcacgcccatgcaggagagctgcctgatccagcttcggcactggttacaggagacccacaaaggcaagattcccaaagatgagcacatccttcggttcctgcgggctcatgacttccacctggacaaggcccgggaaatgctgcgccagtccttgagctggcgcaagcagcaccaggtggatctcctccttcagacctggcaaccccctgccctgctggaggagttctatgcagggggctggcattaccaggacatagatggccgccccctctacatcctccgcctgggccagatggacaccaaaggcttgatgaaggccgtgggggaggaggcgctgctgcggcatgttctctccgtcaacgaggaaggacagaagcggtgtgaggggagcacaaggcagctgggccgtcccatcagctcctggacctgcctgctagacctggagggactcaacatgcggcacctgtggcggccgggggtgaaggccctgctgcggatgattgaggtggttgaggacaattacccagagaccctgggtcggctgctcatcgtgcgagccccccgagtcttccccgtgctctggacactgatcagccccttcatcaatgagaacaccaggcggaagttcctcatctacagtggcagcaactaccagggacccggaggccttgtggactatctggatagagaagtgatccctgacttccttgggggagagagtgtgtgtaatgtccccgaaggagggctggtccccaagtccctctacatgacagaagaggagcaggagcacacggaccagctgtggcagtggagtgagacctaccattcagccagcgtgctccgcggagccccccacgaggtggccgtggagatcctggaaggagagtcggtcatcacctgggactttgacatcctgcgaggggacgtggtgttcagcctgtaccacaccaagcaggcgcccaggctgggcgcccgggaaccggggaccagggccagcgggcagctgatcgacaaaggctgggtcctgggcagggattacagccgtgtggaggctccccttgtctgccgggagggggagagcatccagggctcccatgtgacccggtggcccggcgtctacctgctccagtggcaaatgcacagcccccccagcagcgtggcctgcagcctcccgggtgtggacgatgtcctgacggctctgcacagccccgggcccaagtgcaaacttctctactactgtgaggtgctcgcctctgaggacttcaggggctccatgtccagcctggaatcctgcaccagcggcttctcccagctcagcgccgccacctcgtcctcctcctccggccagtctcatagcagctccctggtctccagatagccgggcccagtgtttcagggccgcccgctcgcctccagtgtccagaaatgtccagaatgagaagccagctaactgcagggcctgggaccatgtgggctggagccccaggcctagatgctgcccaagttggggtgtctggagcggatggcaaggatccagaactggcctgtgggtggtgtcagggctcttgaaattgcaaggacagaaccatctccttccggcttcgtgtaaggaagaccaagccaaggccaaggtgtctaccataccacacctttgggacatccgggcttagcgacgtcagccaggcccatctcctctctgtccacctcttgctctgctttcgccatgcaggggaccatcactatcaggtgcccttctcctccctgcagcttgcctgcataagagagcctcttcctcccaaaggctccagcccacttcccagagctgagtcttagcctggaagggggagcgattgccaggtcaattcctgaaccaatcacagttgccaggcacactggagaatgctgattggccagcagggtcatgcccaatctggaccaatcaccgtgatccagggttgcagtgaggtgcagtgattggccagcctggatcacatgcacatctctggaaccaaccacctgctctcaaaagcactagtgggtgcctcgaggagtactggggtcccccctaagaagaaggaggaaggatgctggggaggcagaaatgaagggtgtttaccttggcatctgattgcataacgttctgttatgcagtatcaagatgtgcttggtgagcagttaagtgagttacaggcgctgctctttgtggggaacagcacatcctgaagtgaaaatccatgttccctgcacttggccagcatggcctaagcctgaccatccctgattggagagggtgggagagccctgggtttctgctaagttccaggcagtgatggggtgactgaggctgtctgtataccccactggagatgcctttctctcctagggaactgtttaattatgactgtttttggttgtaagccacagagacccatgcccaggtgcttcaacacaaaagcatgatcattcatgggtgcatagaactggccagtccaggagggcttgcttcaggtaaggctagatccagggtctcaacatggagtctcgattccccccgcgagtggaggctgctgtgtttgccctggggcagatatgactctggaactaggttcaatattgacatgagttcccctagttactacacaggagcgtcttgggtctccttggggcctgaggacatttctcctttcctttcctggactccccaaaaggcagccagtcaggggtcaccaacttgaagcctgatctggcctgcttttagtgttgcttttttgcctttagaatggtttaaaaattgaggcatttcgcatcgaaatcaggatttctggcttcccttaggcatttgggagcaccagcagaatggggtcactattgttgcatgaagacaacacctctgcacccctggatgtggccacgccagtccctaccccattgacttgcgcccagcccacattacacatcctcatgacctgcgtggcaggagtctcactgacatggctctgtcagcagtggctggtacccttgtctcctggccttgcttagagttggggctcatctctgctgcagtaactgagccaaggggtggttttgtggccacaagaatcatctttatgcaggctcagcaatgcagggccaggaaacttatatctacgccagcctcaaccccaaacccaaggaagagagaaagtgtcatcttttcagatacatccttcttcctgctgggagagagccttgcccaccttcctgttggctctctgtccgcttctcaggtatctgaacaaaatagattgctttgcactctgcgtcaaggtgtgtgtgcacatgtgtgcataagagaccgactgattggaaggagacgttctcaaaactaattgctcccatatcaccaggcatttattgctgagagcaacttgcaatattttcaactatctttaagtgaatttctagcttttctcttaaaaactaggtgttatcctacaagtatgctgggataagctgccctggcagtctttatacatttattgtctagccccagagaaggacacagaagccttttacggaaggaagctggaactgcctgttccagaggcgggtggggggaggggagtctgctatcagctgtccacccttaacagtgggggtgaggaacctcaggccctttcagttctgctcttgagagtgctctctccctagggaaaaccagcccaaactggcttaagcaacaaagcaaattccctgggtcctgtactagggatggctgaaggtgggtgctgcttcagatatggctggatccaggagcttaatgtcctcaggcctctcaactgcacccaggcctcttgactctgcatctctttgcatgctgacctcattctttcttccacctggcgggaaagatggctgccagcagccccaagcctataatttcaggattcacactctaagagatgcttttccatctcaaatctcatggaaggctctgattggcccagctcgagtcacatgcttattcctgtgggccacactggcaaggaactagggtcccgtgattgacattccctgcagaagccgcagcaggattggggagggccattcccccaatggacaagagaagctggaccacagaaccagcaggtatccatggtggcatctgctacggccggctctcctcccatgtggaggtctcggggacccacgtggaagcattatcaaggtcattcttcttgccttcgggaggactggaattaaaaataatccaaggaagggattgccaagcttttggcttttgaatttcccctgagccacaaaggctggaagtgccttggcttgggcttcttgcatcattagttcattaatccattgtgaccaggacagaagcaacccacaagcagcattactgttggtgtttgggcacctgggccttgaatttaggccaggactcaaaccccagccttcctttcactagctgtgtaaccttgaccaggtgacttaacctctctgtgcctcagtttcctcatctgtaaagtgaggatagcagtgcctacctcaataggttgtagtgggacgaaatgagggagtagctgtaaagctttcagcacagctcccagaacacagaaagcgctccattaatgtcagtggtcattctgattacttaatgcttcgcatccaaagactcgttttcttcctgaggtcgcctatccctgtttttcgttattgcacccagagaaaagtaggtgtcaagaattattgccctctgagttgggtgtgcagtctttctcttttagaaactgcttgtgtgggcggggcgtggtggctcatgcctataatcccaacactttgggaggctgaggccggctgatcgcttgagtgcaggagttcaagaccagcctgggcaacatagtgagaccctgtctctacaaaaaattaaaaaatgagccaggcgtggtggtgcgtgcctatagtctcagctgctcgggaggctgaggcagaaggattgcttggaggtcaaggctggagtgagccatgatctcacccctgtacttcatcctgggtgacaaagcaagaccctgtctcaaaaaaagaagaaagaagctgcttgtgttttctgggtaagtccacccatctgagggagtgtattctgagtggtatttcccttggcagttagaaaatgttttttcccagaggttgaagtatggagagtttgagactctttttttctaccctgcactctctggaattccccctccctgctgtaaaatttattgtccaatgagaatagtataattgttttcaacaaagtctctttgagccagtgaaacacgatgggtttttttgtttgcctgatcacttgctccaaccagcagcattaaatgttttccatttggataaacttgcatcgtcagcttcctaaaaccctggaggtttcccgtgggctcgttcaagaactttccagctgttgtttaaaagactttagagctagcttgttcagcctgtggcctgcaggctgcacgcggccccggactgctttgaatgtgctccaacacgagttcgtaaactttcttaaaat

SEQ ID NO: 53378 - DNA, 6675 bp, Homo sapiens
atggagtgtcaacaagtgggattcgtgcgtgtggctcaccggcggctctccagcgcctggacagggctgacccccagtaggcgctctgtgaaggtgtgcagagtgggcgaaggtgcatgcgcgggccgtggggcggggacaggtggaggagccagtcagacccaagtgcagcgggacgagggcgaggttaatctgagcaagaaaagcgatcttcgctgtcccgggtcctggagctctctcggcccggcaggtttcgctcccgcccctccggccttccacagctgtcctggccgcagggtgttcaaggcgggacacaccaggctagagatccgcgatcgggccccgcctcaggctctgtgcacacccctgcctggtgacctccattggtgctccagcgtgaacatggtgcaaagataccagtctcctgtccgagtctacaagtacccgtttgagctggtcatggcggcctacgagaagcgtttccccacgtgcccacagatcccagtcttcctgggcagcgaggtcttgcgcgagtcccgcagcccggacggggctgtgcacgtggtggagcggagctgccggctgcgcgtggacgccccgcggctgctgcggaagatcgcaggtgttgagcacgtggtcttcgtgcagacaaacatcttgaactggaaggagaggacgctcctcatcgaagcgcacaatgagaccttcgccaaccgcgtggtggtgaacgagcactgcagctacacggtccaccctgagaatgaagactggacttgcttcgagcagtctgcctcactggacattcggtctttctttggctttgaaaatgccttggagaagatcgccatgaagcagtacaccgccaacgtcaagagggggaaggaggtgattgagcattacctgaatgagctcatctcccagggtacctcgcacattccgcgctggacgcctgccccagtccgtgaggaggatgcccgcaaccaggctggaccgagggaccccagctccctggaggcccacgggccccgtagcaccctggggcccgctctggaggcggtcagtatggacggggacaagctggatgcggactacattgagaggtgcctgggccacctcacgcccatgcaggagagctgcctgatccagcttcggcactggttacaggagacccacaaaggcaagattcccaaagatgagcacatccttcggttcctgcgggctcatgacttccacctggacaaggcccgggaaatgctgcgccagtccttgagctggcgcaagcagcaccaggtggatctcctccttcagacctggcaaccccctgccctgctggaggagttctatgcagggggctggcattaccaggacatagatggccgccccctctacatcctccgcctgggccagatggacaccaaaggcttgatgaaggccgtgggggaggaggcgctgctgcggcatgttctctccgtcaacgaggaaggacagaagcggtgtgaggggagcacaaggcagctgggccgtcccatcagctcctggacctgcctgctagacctggagggactcaacatgcggcacctgtggcggccgggggtgaaggccctgctgcggatgattgaggtggttgaggacaattacccagagaccctgggtcggctgctcatcgtgcgagccccccgagtcttccccgtgctctggacactgatcagccccttcatcaatgagaacaccaggcggaagttcctcatctacagtggcagcaactaccagggacccggaggccttgtggactatctggatagagaagtgatccctgacttccttgggggagagagtgtgtgtaatgtccccgaaggagggctggtccccaagtccctctacatgacagaagaggagcaggagcacacggaccagctgtggcagtggagtgagacctaccattcagccagcgtgctccgcggagccccccacgaggtggccgtggagatcctggaaggagagtcggtcatcacctgggactttgacatcctgcgaggggacgtggtgttcagcctgtaccacaccaagcaggcgcccaggctgggcgcccgggaaccggggaccagggccagcgggcagctgatcgacaaaggctgggtcctgggcagggattacagccgtgtggaggctccccttgtctgccgggagggggagagcatccagggctcccatgtgacccggtggcccggcgtctacctgctccagtggcaaatgcacagcccccccagcagcgtggcctgcagcctcccgggtgtggacgatgtcctgacggctctgcacagccccgggcccaagtgcaaacttctctactactgtgaggtgctcgcctctgaggacttcaggggctccatgtccagcctggaatcctgcaccagcggcttctcccagctcagcgccgccacctcgtcctcctcctccggccagtctcatagcagctccctggtctccagatagccgggcccagtgtttcagggccgcccgctcgcctccagtgtccagaaatgtccagaatgagaagccagctaactgcagggcctgggaccatgtgggctggagccccaggcctagatgctgcccaagttggggtgtctggagcggatggcaaggatccagaactggcctgtgggtggtgtcagggctcttgaaattgcaaggacagaaccatctccttccggcttcgtgtaaggaagaccaagccaaggccaaggtgtctaccataccacacctttgggacatccgggcttagcgacgtcagccaggcccatctcctctctgtccacctcttgctctgctttcgccatgcaggggaccatcactatcaggtgcccttctcctccccgcagcttgcctgcataagagagcctcttcctcccaaaggctccagcccacttcccagagctgagtcttagcctggaagggggagcgattgccaggtcaattcctgaaccaatcacagttgccaggcacactggagaatgctgattggccagcagggtcatgcccaatctggaccaatcaccgtgatccagggttgcagtgaggtgcagtgattggccagcctggatcacatgcacatctctggaaccaaccacctgctctcaaaagcactagtgggtgcctcgaggagtactggggtcccccctaagaagaaggaggaaggatgctggggaggcagaaatgaagggtgtttaccttggcatctgattgcataacgttctgttatgcagtatcaagatgtgcttggtgagcagttaagtgagttacaggcgctgctctttgtggggaacagcacatcctgaagtgaaaatccatgttccctgcacttggccagcatggcctaagcctgaccatccctgattggagagggtgggagagccctgggtttctgctaagttccaggcagtgatggggtgactgaggctgtctgtataccccactggagatgcctttctctcctagggaactgtttaattatgactgtttttggttgtaagccacagagacccatgcccaggtgcttcaacacaaaagcatgatcattcatgggtgcatagaactggccagtccaggagggcttgcttcaggtaaggctagatccagggtctcaacatggagtctcgattccccccgcgagtggaggctgctgtgtctgccctggggcagatatgactctggaactaggttcaatattgacatgagttcccctagttactacacaggagcgtcttgggtctccttggggcctgaggacatttctcctttcctttcctggactccccaaaaggcagccagtcaggggtcaccaacttgaagcctgatctggcctgcttttagtgttgcttttttgcctttagaatggtttaaaaattgaggcatttcgcatcgaaatcaggatttctggcttcccttaggcatttgggagcaccagcagaatggggtcactattgttgcatgaagacaacacctctgcacccctggatgtggccacgccagtccctaccccattgacttgcgcccagcccacattacacatcctcatgacctgcgtggcaggagtctcactgacatggctctgtcagcagtggctggtacccttgtctcctggccttgcttagagttggggctcatctctgctgcagtaactgagccaaggggtggttttgtggccacaagaatcatctttatgcaggctcagcaatgcagggccaggaaacttatatctacgccagcctcaaccccaaacccaaggaagagagaaagtgtcatcttttcagatacatccttcttcctgctgggagagagccttgcccaccttcctgttggctctctgtccgcttctcaggtatctgaacaaaatagattgctttgcactctgcgtcaaggtgtgtgtgcacatgtgtgcataagagaccgactgattggaaggagacgttctcaaaactaattgctcccatatcaccaggcatttattgctgagagcaacttgcaatattttcaactatctttaagtgaatttctagcttttctcttaaaaactaggtgttatcctacaagtatgctgggataagctgccctggcagtctttatacatttattgtctagccccagagaaggacacagaagccttttacggaaggaagctggaactgcctgttccagaggcgggtggggggaggggagtctgctatcagctgtccacccttaacagtgggggtgaggaacctcaggccctttcagttctgctcttgagagtgctctctccctagggaaaaccagcccaaactggcttaagcaacaaagcaaattccctgggtcctgtactagggatggctgaaggtgggtgctgcttcagatatggctggatccaggagcttaatgtcctcaggcctctcaactgcacccaggcctcttgactctgcatctctttgcatgctgacctcattctttcttccacctggcgggaaagatggctgccagcagccccaagcctataatttcaggattcacactctaagagatgcttttccatctcaaatctcatggaaggctctgattggcccagctcgagtcacatgcttattcctgtgggccacactggcaaggaactagggtcccgtgattgacattccctgcagaagccgcagcaggattggggagggccattcccccaatggacaagagaagctggaccacagaaccagcaggtatccatggtggcatctgctacggccggctctcctcccatgtggaggtctcggggacccacgtggaagcattatcaaggtcattcttcttgccttcgggaggactggaattaaaaataatccaaggaagggattgccaagcttttggcttttgaatttcccctgagccacaaaggctggaagtgccttggcttgggcttcttgcatcattagttcattaatccattgtgaccaggacagaagcaacccacaagcagcattactgttggtgtttgggcacctgggccttgaatttaggccaggactcaaaccccagccttcctttcactagctgtgtaaccttgaccaggtgacttaacctctctgtgcctcagtttcctcatctgtaaagtgaggatagcagtgcctacctcaataggttgtagtgggacgaaatgagggagtagctgtaaagctttcagcacagctcccagaacacagaaagcgctccattaatgtcagtggtcattctgattacttaatgcttcgcatccaaagactcgttttcttcctgaggtcgcctatccctgtttttcgttattgcacccagagaaaagtaggtgtcaagaattattgccctctgagttgggtgtgcagtctttctcttttagaaactgcttgtgtgggcggggcgtggtggctcatgcctataatcccaacactttgggaggctgaggccggctgatcgcttgagtgcaggagttcaagaccagcctgggcaacatagtgagaccctgtctctacaaaaaattaaaaaatgagccaggcgtggtggtgcgtgcctatagtctcagctgctcgggaggctgaggcagaaggattgcttggaggtcaaggctggagtgagccatgatctcacccctgtacttcatcctgggtgacaaagcaagaccctgtctcaaaaaaagaagaaagaagctgcttgtgttttctgggtaagtccacccatctgagggagtgtattctgagtggtatttcccttggcagttagaaaatgttttttcccagaggttgaagtatggagagtttgagactctttttttctaccctgcactctctggaattccccctccctgctgtaaaatttattgtccaatgagaatagtataattgttttcaacaaagtctctttgagccagtgaaacacgatgggtttttttgtttgcctgatcacttgctccaaccagcagcattaaatgttttccatttggataaacttgcatcgtcagcttcctaaaaccctggaggtttcccgtgggctcgttcaagaactttccagctgttgtttaaaagactttagagctagcttgttcagcctgtggcctgcaggctgcacgcggccccggactgctttgaatgtgctccaacacgagttcgtaaactttcttaaaat

SEQ ID NO: 53379 - DNA, 4607 bp, Homo sapiens
cccgcgccccgctcagccttgcagccccgcgcccggagcatctccctggaggaacggagacaaaggaggattcatgtccaaagggctcccagagaccaggacggacgcagccatgtcagagctggtgcctgagcccaggcctaagccagcggtgcccatgaagcccatgagcatcaactccaacctgctgggctacatcggcatcgacaccatcatcgagcagatgcgcaagaagaccatgaagaccggtttcgacttcaacatcatggtcgttggccagagtggactgggcaaatcaacgctggtcaacacgctcttcaaatcccaagtgagccgcaaggcctccagctggaaccgggaggagaagatccccaagacagtggagatcaaagctatcgggcatgtgatagaggaaggcggtgtcaaaatgaagctgaccgtcatcgacaccccaggctttggagaccaaatcaacaatgaaaactgctgggagcccattgagaagtacatcaatgagcagtacgagaagttcctgaaggaggaggtcaacatcgccaggaagaaacgcatccctgacactcgtgtccactgctgcctttacttcatctctcccacaggacactccttgcgacctctggatcttgagttcatgaaacacctcagcaaggttgtgaacatcatccctgtcattgctaaggctgacaccatgaccctggaggagaagtctgaattcaagcaaagggttcgcaaggagcttgaagtaaatggcattgaattctacccccagaaggaatttgatgaggatttggaggataagacggagaatgacaaaatcaggcaggagagcatgccttttgctgtggtgggaagtgacaaggagtaccaagtgaatggcaagagggtcctcggccgaaaaactccatgggggatcatcgaagtggaaaacctcaaccactgtgagtttgccctgcttcgagactttgtcatcaggacccacctccaggacctcaaggaagtgacacacaacatccactatgagacttacagggccaagcggctcaatgacaatggaggcctccctccggtgagcgtggacacagaggaaagccacgacagtaacccatgacgaccacttctctgtgtcatcacacatacccacttcacacacacacatcccaaataccaccaccaaccaccttcttcctctcaactctgtcccacaggcctgtctggtatttgtggagcatcttgtctgtgtgtgtgtgtgtgtgtgtgtgtgtgtgtgtgtgtgtgacagagagagagcgagagagcctgtgtgtgtgcatgcaggggtgaggtattttcactgccctccctggagagtcccttgtaagtttggctcctccatgcctgtccattatctgtctcctttccttgtgtcccaaaacaaagctgtttgcctcactcaggagatctgggggaggtttcatttaaaagtgctgggagcaggtgagccacaggcaactcttctctcggaacctgcacacaaactggggctatagagattctccaaggacagatggcagtggagctagacctgagtagggggcagggagttcaggacaaccctcctgtaagttgggggtggtctgggggtaaggctggggcttcctgggaaaaggaaggccatgagaaggcagagaagtaggccagagctgggttcttgcagaaagcatcagtgcctacaaatggagctccacccttcagtctgtgtcgtgttcagtgtcacaaagctaccacctgtcaccagagcctactgctgctctccactcaactggcctctgctgccaggccactgcctgtctctgcttccgactttgtcttctttctccctttccctccttccctcatacattgctttctctccctctcctgcgtgtctctgacatctctcacttccttttagatgaatctactttaggttcattcctatatttagcatttatgcccagtctacttccagaaatgactttagactgcctttcacataaaatcacaaaactacaggacagtacaaacagattgccagagaaatctgggtcaaagaaaggaataggaaagaaagtttctgtagtcaagcacctgaacaggccctgagctcacaggcagccaatgtaaagagggaaacacagtgagttatgcagttcccagtgtccagttaaaggaagcacacatgctagtcatgtgagacaaccttttattgggacatcaggttctagaactaattctaaagaagtatcagaaacaatatacataatttgtctttcttagtaatttggcttcaaagacaaatttttgaccacacctccgttttctccgtcagacttctctcccttctaagcaggcttctctgttgctccatttgcttcatacatacttgacctctcttttctattccccatcacttttgtgctgaagctaatcatatttatgtctgtctttctctacttttccctaattccctctcctcctgactcctgtagacattcccaatgatacccaccgtcatacatttaggcttttcttgcctttccctgaagccctgtatttattaatgcatatatttcccctgcttgttgtacaagtaagttactcttttcctttaatctgtaagattcatgaaattcggggccagggaaacagtttagccttagggaagggaaaacactaagtgaaactgtttacaataacctcatacaaccttctgtcccatctcctggttcagcctaggtgtttcactggtcctctatgaatcccagcacttataatcccagtcttttatcactcaggtgctaggaaaaaaaacatagactcaagacccaagattcaatggaccaggagaaaggggggcggtgatcaggtcaccagtgaccccaacctatgctctcggtctttcctggaggctgccaacccagccctcatcctcccttgctcacaaagttacagggtaggcacctgtcaggacagaacagcagcagcgctacagcccagaggttatacatttcaacagaacagggatccttggctactgtagaagcagtcctgtatggagaccttggaccagcaggggaagatctatgggcatgggaggtgggcgttggaaaggctgagtaggaatggtgcctggcacccctgaaccatgatctgagcctccctggagaaggtattttatatgtctgctgccagctgctggtctccacaccctcaaccgttctcaacccccctgcagggagaaggcctcctgggcactgtccttccacctgtgccagccaccccctgccccactgctgaatgaaggccatttcaagcgctgcttctcactccattcctctcagctgttattgctgcagggccaagccctttttagtgctgtgctcgtccagctcaccaccacagcccctctcagccctcagtaggtgggaggggccagctgcctctttaggccagttgcatcctccatttatccaaaccactcctctcctcccagtggagtggggttctgccagtacagccctactgcatcatctgcgtcagccggtcctagcccatctgcagggtgaaagaactcatcaagagctccttctgcccttgtaagcccatcccagctacttgtaaccatctctaagggcaatggcattgctccctacccattcatctgcatgagctactcttggcttccttaaagggtcaagaaagcaatttttctgcttactagattcattgagatcagctgtgtgagccccaaagtgggacaagggtgtctccttcattacttaaagatattcatgagggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctgtccaaacaaacaaacaaaaactaaacacacacacaaacccccagaaacccacaatatgtacacgctaaggaaaaactagcacccttctgtccactcagcaataagagggatctcttcccacctaccctacctactcctacccccaacccccttccccattaatgtgagtaatgaattagcctgaccacaggtggtcactgtaggctaatggaaaatacccaagggagggcaaagccccccatcagatgcatgaatgtttgcgaatgttgactgccactgccccacacactgtgtctttatagaattcccctttgcccaccctcttcctgtctccacctggacacaacttgctcaaaggctggtgacttgtgggccattcatctacaaccaagtcctgatggagcaagaggcccacgcctaggggatgcaagaacaacccgtttcttaaatgttaccagtcccagccaatcttacggtgacattacagttaaatttcccaattgaaaacaagcaaacagacactcaaactggtcctgtaattgttgctagactttatgtgttgtacaactaaacattgctgtttgaacagtaaaaaaaaaaaaaaaaaa

SEQ ID NO: 53380 - DNA, 2249 bp, Homo sapiens
cccgcgccccgctcagccttgcagccccgcgcccggagcatctccctggaggaacggagacaaaggaggattcatgtccaaagggctcccagagaccaggacggacgcagccatgtcagagctggtgcctgagcccaggcctaagccagcggtgcccatgaagcccatgagcatcaactccaacctgctgggctacatcggcatcgacaccatcatcgagcagatgcgcaagaagaccatgaagaccggtttcgacttcaacatcatggtcgttggccagagtggactgggcaaatcaacgctggtcaacacgctcttcaaatcccaagtgagccgcaaggcctccagctggaaccgggaggagaagatccccaagacagtggagatcaaagctatcgggcatgtgatagaggaaggcggtgtcaaaatgaagctgaccgtcatcgacaccccaggctttggagaccaaatcaacaatgaaaactgctgggagcccattgagaagtacatcaatgagcagtacgagaagttcctgaaggaggaggtcaacatcgccaggaagaaacgcatccctgacactcgtgtccactgctgcctttacttcatctctcccacaggacactccttgcgacctctggatcttgagttcatgaaacacctcagcaaggttgtgaacatcatccctgtcattgctaaggctgacaccatgaccctggaggagaagtctgaattcaagcaaagggttcgcaaggagcttgaagtaaatggcattgaattctacccccagaaggaatttgatgaggatttggaggataagacggagaatgacaaaatcaggcaggagagcatgccttttgctgtggtgggaagtgacaaggagtaccaagtgaatggcaagagggtcctcggccgaaaaactccatgggggatcatcgaagtggaaaacctcaaccactgtgagtttgccctgcttcgagactttgtcatcaggacccacctccaggacctcaaggaagtgacacacaacatccactatgagacttacagggccaagcggctcaatgacaatggaggcctccctccgggagaaggcctcctgggcactgtccttccacctgtgccagccaccccctgccccactgctgaatgaaggccatttcaagcgctgcttctcactccattcctctcagctgttattgctgcagggccaagccctttttagtgctgtgctcgtccagctcaccaccacagcccctctcagccctcagtaggtgggaggggccagctgcctctttaggccagttgcatcctccatttatccaaaccactcctctcctcccagtggagtggggttctgccagtacagccctactgcatcatctgcgtcagccggtcctagcccatctgcagggtgaaagaactcatcaagagctccttctgcccttgtaagcccatcccagctacttgtaaccatctctaagggcaatggcattgctccctacccattcatctgcatgagctactcttggcttccttaaagggtcaagaaagcaatttttctgcttactagattcattgagatcagctgtgtgagccccaaagtgggacaagggtgtctccttcattacttaaagatattcatgagggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctgtccaaacaaacaaacaaaaactaaacacacacacaaacccccagaaacccacaatatgtacacgctaaggaaaaactagcacccttctgtccactcagcaataagagggatctcttcccacctaccctacctactcctacccccaacccccttccccattaatgtgagtaatgaattagcctgaccacaggtggtcactgtaggctaatggaaaatacccaagggagggcaaagccccccatcagatgcatgaatgtttgcgaatgttgactgccactgccccacacactgtgtctttatagaattcccctttgcccaccctcttcctgtctccacctggacacaacttgctcaaaggctggtgacttgtgggccattcatctacaaccaagtcctgatggagcaagaggcccacgcctaggggatgcaagaacaac

SEQ ID NO: 53381 - DNA, 1767 bp, Homo sapiens
gaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggctaaaaaaaaaaaaaaaaaaaaaaaaaaaaaaa

SEQ ID NO: 53382 - DNA, 1911 bp, Homo sapiens
cggcggtgctgcgaggtcggcgcgcagctccgccgcgggtcgctcgggcgctgtccaggcggagccggccccgcccgggctgcagccatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggtatggtccaagcctgaggctcctggcaccaccgggtgctgtcaagggaacaggccaagagcaccaggggcagggctgccactagcaggtggtcacaggttcctgttccccaggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaagtatgaccagaagccaggacaaagctggcagggggagatcccaagcctagccttgggtgagaccaagccctacttttgttcttctataggccctgggctcaatctaagcgggtgctggggtcctcctcgccttatcaacccttttctccctttagcaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggctaaaaa

SEQ ID NO: 53383 - DNA, 1669 bp, Homo sapiens
cggcggtgctgcgaggtcggcgcgcagctccgccgcgggtcgctcgggcgctgtccaggcggagccggccccgcccgggctgcagccatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacgcgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggctaaaaaaaaaaaaaaaaaaaaaaaaaaaaaaa

SEQ ID NO: 53384 - DNA, 2290 bp, Homo sapiens
gaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggtagagcctccagccctgcctttgcctttcagtgggctgctgcaggaagaccgggggcagggagcagagtgtgtgtgtgtgtgtgtgtgtgtgtgtgtgtgtgtgtgtttgtgtgtgtgtgtatctgggacctatttcagtcctgtgtcagccctagctccaagatatctgcccccaagggcactggaaatttgcagtttcagcaagggcaggaggcccagctggtggcctcagatgggaactcacagaagtctggcactgcttttttaaggctggggcaaaggcctgaaagggagagaagattggcgctgggtgccggggcccctttggctcctcaccgtgatgcattctgccttcctgtctactaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaagtatgaccagaagccaggacaaagctggcagggggagatcccaagcctagccttgggtgagaccaagccctacttttgttcttctataggccctgggctcaatctaagcgggtgctggggtcctcctcgccttatcaacccttttctccctttagcaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggctaaaaaaaaaaaaaaaaaaaaaaaaaaaaaaa

SEQ ID NO: 53385 - DNA, 1910 bp, Homo sapiens
ggagacgaaagcaggaacgagagcggagcggagcacagtccgccgagcacaagctccagcatcccgtcaggggttgcaggtgtgtgggaggtaagcgtgggtccttcttcggggcgtctgcactgccctggagaaaacgtcttccaataggaattacatcaagacacagctaaaagagtccgcgttgggttaggaaaccggtgcaaaacctctcgggtgaaagatttacatttttcgactttaagggcaaaaaagcaaaaggaagcttgactctgggtataaagggcgtggttagtgtttttggtttgagttgcaccagtaaaactgttctgggagatctgaagattgagaaaaatcctgctaattgaggacgaggtggatgttatctggtggatgttataggcttgaaactgttacaatatggctttccttggactcttctctttgctggttctgcaaagtatggctacaggggccactttccctgaggaagccattgctgacttgtcagtgaatatgtacaatcgtcttagagccactggtgaagatgaaaatattctcttctctccattgagtattgctcttgcaatgggaatgatggaacttggggcccaaggatctacccagaaagaaatccgccactcaatgggatatgacagcctaaaaaatggtgaagaattttctttcttgaaggagttttcaaacatggtaactgctaaagagagccaatatgtgatgaaaattgccaattccttgtttgtgcaaaatggatttcatgtcaatgaggagtttttgcaaatgatgaaaaaatattttaatgcagcagtaaatcatgtggacttcagtcaaaatgtagccgtggccaactacatcaataagtgggtggagaataacacaaacaatctggtgaaagatttggtatccccaagggattttgatgctgccacttatctggccctcattaatgctgtctatttcaaggggaactggaagtcgcagtttaggcctgaaaatactagaaccttttctttcactaaagatgatgaaagtgaagtccaaattccaatgatgtatcagcaaggagaattttattatggggaatttagtgatggctccaatgaagctggtggtatctaccaagtcctagaaataccatatgaaggagatgaaataagcatgatgctggtgctgtccagacaggaagttcctcttgctactctggagccattagtcaaagcacagctggttgaagaatgggcaaactctgtgaagaagcaaaaagtagaagtatacctgcccaggttcacagtggaacaggaaattgatttaaaagatgttttgaaggctcttggaataactgaaattttcatcaaagatgcaaatttgacaggcctctctgataataaggagatttttctttccaaagcaattcacaagtccttcctagaggttaatgaagaaggctcagaagctgctgctgtctcaggaatgattgcaattagtaggatggctgtgctgtatcctcaagttattgtcgaccatccatttttctttcttatcagaaacaggagaactggtacaattctattcatgggacgagtcatgcatcctgaaacaatgaacacaagtggacatgatttcgaagaactttaagttactttatttgaataacaaggaaaacagtaactaagcacattatgtttgcaactggtatatatttaggatttgtgttttacagtatatcttaagataatatttaaaatagttccagataaaaacaatatatgtaaattataagtaacttgtcaaggaatgttatcagtattaagctaatggtcctgttatgtcattgtgtttgtgtgctgttgtttaaaataaaagtacctattgaacatgaaaaaaaaaaaaaa

SEQ ID NO: 53386 - DNA, 4332 bp, Homo sapiens
ctgcccctgggtctctgcgcctttgcatgagactttacggtaagccgctcctcccgcgcccccgcccccagccccgctcggcgatccccggcgccgtcgccaggcgctggccgtggtgctgattctgtcaggcgctggcggcggcagcggcggtgacggctgcggccccgctccctctacccggccggacccggctctgcccccgcgcccaagccccaccaagccccccgccctcccgccgcggtcccagcccagggcgcggccgcaaccagcaccatgcgcccggtagccctgctgctcctgccctcgctgctggcgctcctggctcacggactctctttagaggccccaaccgtggggaaaggacaagccccaggcatcgaggagacagatggcgagctgacagcagcccccacacctgagcagccagaacgaggcgtccactttgtcacaacagcccccaccttgaagctgctcaaccaccacccgctgcttgaggaattcctacaagaggggctggaaaagggagatgaggagctgaggccagcactgcccttccagcctgacccacctgcacccttcaccccaagtccccttccccgcctggccaaccaggacagccgccctgtctttaccagccccactccagccatggctgcggtacccactcagccccagtccaaggagggaccctggagtccggagtcagagtcccctatgcttcgaatcacagctcccctacctccagggcccagcatggcagtgcccaccctaggcccaggggagatagccagcactacaccccccagcagagcctggacaccaacccaagagggtcctggagacatgggaaggccgtgggttgcagaggttgtgtcccagggcgcagggatcgggatccaggggaccatcacctcctccacagcttcaggagatgatgaggagaccaccactaccaccaccatcatcaccaccaccatcaccacagtccagacaccaggcccttgtagctggaatttctcaggcccagagggctctctggactcccctacagacctcagctcccccactgatgttggcctggactgcttcttctacatctctgtctaccctggctatggcgtggaaatcaaggtccagaatatcagcctccgggaaggggagacagtgactgtggaaggcctgggggggcctgacccactgcccctggccaaccagtctttcctgctgcggggccaagtcatccgcagccccacccaccaagcggccctgaggttccagagcctcccgccaccggctggccctggcaccttccatttccattaccaagcctatctcctgagctgccactttccccgtcgtccagcttatggagatgtgactgtcaccagcctccacccagggggtagtgcccgcttccattgtgccactggctaccagctgaagggcgccaggcatctcacctgtctcaatgccacccagcccttctgggattcaaaggagcccgtctgcatcggtgagtgcccaggggtgatccgcaatgccaccaccggccgcatcgtctctccaggcttcccgggcaactacagcaacaacctcacctgtcactggctgcttgaggctcctgagggccagcggctacacctgcactttgagaaggtttccctggcagaggatgatgacaggctcatcattcgcaatggggacaacgtggaggccccaccagtgtatgattcctatgaggtggaatacctgcccattgagggcctgctcagctctggcaaacacttctttgttgagctcagtactgacagcagcggggcagctgcaggcatggccctgcgctatgaggccttccagcagggccattgctatgagccctttgtcaaatacggtaacttcagcagcagcacacccacctaccctgtgggtaccactgtggagttcagctgcgaccctggctacaccctggagcagggctccatcatcatcgagtgtgttgacccccacgacccccagtggaatgagacagagccagcctgccgagccgtgtgcagcggggagatcacagactcggctggcgtggtactctctcccaactggccagagccctacggtcgtgggcaggattgtatctggggtgtgcatgtggaagaggacaagcgcatcatgctggacatccgagtgctgcgcataggccctggtgatgtgcttaccttctatgatggggatgacctgacggcccgggttctgggccagtactcagggccccgtagccacttcaagctctttacctccatggctgatgtcaccattcagttccagtcggaccccgggacctcagtgctgggctaccagcagggcttcgtcatccacttctttgaggtgccccgcaatgacacatgtccggagctgcctgagatccccaatggctggaagagcccatcgcagcctgagctagtgcacggcaccgtggtcacttaccagtgctaccctggctaccaggtagtgggatccagtgtcctcatgtgccagtgggacctaacttggagtgaggacctgccctcatgccagagggtgacttcctgccacgatcctggagatgtggagcacagccgacgcctcatatccagccccaagtttcccgtgggggccaccgtgcaatatatctgtgaccagggttttgtgctgatgggcagctccatcctcacctgccatgatcgccaggctggcagccccaagtggagtgaccgggcccctaaatgtctcctggaacagctcaagccatgccatggtctcagtgcccctgagaatggtgcccgaagtcctgagaagcagctacacccagcaggggccaccatccacttctcgtgtgcccctggctatgtgctgaagggccaggccagcatcaagtgtgtgcctgggcacccctcgcattggagtgaccccccacccatctgtagggctgcctctctggatgggttctacaacagtcgcagcctggatgttgccaaggcacctgctgcctccagcaccctggatgctgcccacattgcagctgccatcttcttgccactggtggcgatggtgttgttggtaggaggtgtatacttctacttctccaggctccagggaaaaagctccctgcagctgccccgcccccgcccccgcccctacaaccgcattaccatagagtcagcgtttgacaatccaacttacgagactggatctctttcctttgcaggagacgagagaatatgaagtctccatctaggtgggggcagtctagggaagtcaactcagacttgcaccacagtccagcagcaaggctccttgcttcctgctgtccctccacctcctgtatataccacctaggaggagatgccaccaagccctcaagaagttgtgcccttccccgcctgcgatgcccaccatggcctattttcttggtgtcattgcccacttggggcccttcattgggcccatgtcagggggcatctacctgtgggaagaacatagctggagcacaagcatcaacagccagcatcctgagcctcctcatgccctggaccagcctggaacacactagcagagcaggagtacctttctccacatgaccaccatcccgccctggcatggcaacctgcagcaggattaacttgaccatggtgggaactgcaccagggtactcctcacagcgccatcaccaatggccaaaactcctctcaacggtgacctctgggtagtcctggcatgccaacatcagcctcttgggaggtctctagttctctaaagttctggacagttctgcctcctgccctgtcccagtggaggcagtaattctaggagatcctaaggggttcagggggaccctacccccacctcaggttgggcttccctgggcactcatgctccacaccaaagcaggacacgccattttccactgaccaccctataccctgaggaaagggagactttcctccgatgtttatttagctgttgcaaacatcttcaccctaatagtccctcctccaattccagccacttgtcaggctctcctcttgaccactgtgttatgggataaggggagggggtgggcatattctggagaggagcagaggtccaaggacccaggaatttggcatggaacaggtggtaggagagccccagggagacgcccaggagctggctgaaagccactttgtacatgtaatgtattatatggggtctgggctccagccagagaacaatcttttatttctgttgtttccttattaaaatggtgtttttggaaaaaaaaaaaaaaaaaaaaaaaaaaaaaaaaaaaaaaaa

SEQ ID NO: 53387 - DNA, 2540 bp, Homo sapiens
cgccgcctccctcccgcacagcagccgccagcgcggcctcctgcaccatgtcggtggccggcctcaagaagcagttccataaagccactcagaaagtgagtgagaaggttggaggagctgaaggaaccaagctagatgatgacttcaaagagatggaaaggaaagtggatgtcaccagcagggctgtgatggaaataatgactaaaacaattgaataccttcaacccaatccagcttccagagctaagctcagcatgatcaacaccatgtcaaaaatccgtggccaggagaaggggccaggctatcctcaggcagaggcgctgctggcagaggccatgctcaaatttggaagagagcttggagatgattgcaactttggcccagcacttggtgaggtcggggaggccatgcgggaactgtcggaggtcaaagactctttggacatagaagtgaagcagaacttcattgaccctcttcagaatcttcatgacaaagatcttagggaaattcaacatcatctaaagaagttggagggtcgacgcctggattttgattataagaagaaacgacaaggcaagattccggatgaagagcttcgtcaagctctagagaaatttgatgagtctaaggaaattgctgagtcaagcatgttcaatctcttggagatggatattgaacaagtgagccagctctctgcacttgtgcaagctcagctggagtaccacaagcaggcagtccagatcctgcagcaagtcacggtcagactggaagaaagaataagacaggcttcatctcagcctagaagggaatatcaacctaaaccacgaatgagcctggagtttccaactggagacagtactcagcccaatgggggtctctcccacacaggcactcccaaaccttcaggtgtccaaatggatcagccctgctgccgagctctgtacgactttgaacctgaaaatgaaggggagttgggatttaaagagggcgatatcatcacactcactaaccaaattgatgagaactggtatgaggggatgctgcatggccattcaggcttcttccccatcaattatgtggaaattctggttgccctgccccattaggatgttatgctggctggctcgcctcctcttgacccagatagttacggttaaccactgctttggcaatgctgcttataacacatcccaagtgcaggccgcagtggtccacgtcatccagccccaccaagtgactttggttgacttgtgggctcccacaggagtcatggtgatggatgatatcctcttagcctggtgggcgtggcatgtgctttttaaaacatcatctgagaccagccagtagtcacagaactgctgtttacacagttctcaggaggctgtggtttattagaatatgaccatgagccatttcacagaaaaaccatcccaccgaagatattgtctatcaccccaggggccatctgaaggtctctttgcatttctccatgcaaagaggagaaagcttttgctttcacactgtcccttcccaaatatgtgagtcatggaattgtcaaagtaagccttccctcaccagcaaattgtctcctgatctgaatgaatttgtctcttaatgcatccatagaaaagtgttaattgtgggttcaaagcattctctgcaaataggcatctcagctcctcacacttatggctatttctgacgtatagccagttttcttccctccttgctattaaagccagagtcgtaattccaaattatttttcagtaagacagttaatcagcattattgtgagagggactgaaaagaaattctccattatgaggaattgggaagaaatctggtatccaagcttaaatttcttgctatacagaactatgtatgtatttaggctattctgaagggcacagggaaggggaacaaatatcttcacttcagttttatttgtgaattacatgtttcatgaatccatttggcacagagacacaaggaagaaaacactagtaaccaactttccactagttcatatactgagaaacagtaaatacctttcctttccacttttaccctgtgttctttgaacatcatttgtgcagattctgccctcaatgaggaccaaataaagatgatttttgtgcttagcagtttaaggtatatggctggcatatgcaaaactctttcccaattcagtcgctacttttacttctgccctttctatccatcgtcttcattttgtgtgtacagtgctgtgtgtaagcttatcagtgtgtttttttatttgtatcagtcatgaaagtcctgttaggtatccagagttctatttatctagctgtacagactctttcagaggtttaacgtgctgcttccgatgtgccacctgcagtagtggatcatgtggagtgaaaggcaaatcttactgcttaatgtataaactctcaccacaggaagcatcgctgtttccaataaatattgctgaagacagaaaaaaaaaaaaaaaaaaaaaaaaaaaaaaaaaaaaaaaaaaaaaaaaaaaaaaaaa

SEQ ID NO: 53388 - DNA, 6643 bp, Homo sapiens
gtcgccccgtggccccacaatgacccacagccccgcgacaagcgaggacgaggaacgccacagtgccagcgagtgtcccgaggggggctcagagtccgacagctccccagacgggccaggtcgaggcccccgggggacccggggccagggcagtggggcacctggtagcctggcctctgttagaggcctccagggccgctcaatgtccgtcccagacgacgcccacttcagcatgatggtcttcaggattggcatcccggacctgcaccagacaaaatgccttcgcttcaaccccgatgccaccatctggacggccaagcagcaggtgctctgtgccctgagcgagagcctgcaggatgtgctcaactatggcctgttccaaccggccacctccggccgcgatgccaacttcctggaggaggagaggctgctgcgggagtacccccagtcctttgagaagggggtcccctacctggagttccgatacaagacccgagtttacaaacagaccaacctggatgagaagcagctggccaagttgcacacgaagacggggttgaagaagttcctggagtatgtgcagctcgggacatctgacaaggtggcgcggctgctggacaaggggctggaccccaattaccatgactcggattcgggagagacccccttgacactggcggcccagaccgaaggctctgtagaggtgattcgaaccctgtgcctgggcggggcccacattgacttccgggcccgggatggcatgaccgcactgcataaggccgcatgcgcccgacactgcctggcactcacggcgctcctggaccttgggggttcccccaactacaaggaccgtcgggggctgacccctctgttccacacggccatggtgggtggtgacccccgatgctgcgagctgctcctgttcaacagggcccagctgggcatagctgatgagaacggctggcaggaaatccaccaggcctgccagcggggtcactctcagcacctggagcatctgcttttctacggggctgagcctggagcccagaacgcctcggggaacacggctctgcacatctgcgccctctacaacaaggagacctgtgccaggatcctcctgtatcgaggtgccgacaaggatgtgaagaacaacaacggacagacccccttccaggtggcagtgattgctgggaattttgagctgggggagctgatccgaaaccaccgagaacaggatgtggtgcccttccaggagtcccccaagtacgcggcccggcgacgggggcccccaggcacagggctgacggtgcccccggcgctgctgcgggccaacagtgacaccagcatggcgctgcccgactggatggtgttctccgccccgggggccgcgtcctctggggcccctggccctacctcagggtcccagggccagtcgcagccctcggcccccaccaccaagctcagcagcgggaccctccgaagtgccagcagcccccggggtgccagggcccgctctccatcccgagggaggcaccctgaggacgccaagaggcagccccgaggccggcccagctccagcgggacaccccgggaagggccagccgggggcacggggggctcagggggccccgggggctccctgggcagccgcgggaggcggaggaagctctactcagcggtacccggacgctccttcatggctgtgaagtcctaccaggcccaagccgagggggagatctccctgagcaagggcgagaagatcaaagtacttagcatcggggaaggaggcttctgggaaggccaggtcaaaggtcgtgttggctggttcccctctgactgcctggaagaagtggcgaatcgctctcaggagagcaagcaagaaagccgcagtgacaaggcaaagagactcttccggcattataccgtgggctcctacgacagctttgatgccccaagcttaatggatgggattggcccagggagcgattacatcattaaggagaagacagtcttgctgcagaagaaggacagtgaggggtttgggttcgtgctccggggggccaaggcgcagacccccatcgaggagttcacccccaccccggccttcccggcgctgcagtacctggagtcggtggacgagggtggcgtggcatggcgagctggactgcgaatgggagacttcctcatcgaggtgaacgggcagaatgtggtgaaggtcggccaccgacaggtggtgaacatgatccgccaagggggcaacacgctgatggtgaaggtggtgatggtcaccaggcacccggacatggatgaggcagtgcacaagaaagcaccccagcaggccaagcggctgccgcccccaaccatctccctgcgttccaaatctatgacctcagagctggaggagatggagtacgagcagcagccggcgccggtgcccagcatggagaaaaagcggaccgtgtatcagatggctctcaacaaactggacgaaatcctggccgcagctcaacagaccatcagtgcaagcgaaagccctggtcccggtggcctcgcgtccctgggcaaacaccgacccaaaggtttctttgccactgagtcgagcttcgatccccaccaccgtgcccagccaagttacgagcgtccttctttcctgcctccaggacctgggttgatgctccggcaaaaatctatcggtgcggcagaagatgacagaccttacctagcacccccagccatgaaattcagccgcagcctgtctgtgcctggttcggaggacattcccccgccacccaccacgtacccaccggagcctccctacagcacacctacagtcccctcctcctcagggcgcctcaccccctcccctcggggagggcccttcaaccctggctctggtggccccctccccgcctcctcccctgcaacctttgacgggccctcccctcccgacactcgcgtggggagccgcgagaagagcctgtaccacagtgggcccctgcccccggcccaccaccacccgccccaccaccaccaccaccacgccccgccccctcagccccaccaccaccacgcccacccccctcatcctcccgagatggagacaggcggctctcccgacgaccctccaccccgcctggctctggggccccagcccagcctgcgaggctggaggggcggcgggcccagcccgaccccgggggccccgtccccatcgcaccacggcagcgcgggcgggggcggcggctcctcccagggcccggctctacgctatatccagctgcccccgcgggcggccagcgcagccatgtacgtgcccgcccgctcgggccgcggccgcaagggcccgctggtcaagcagaccaaggtggaaggcgagccccagaagggcggcggcctcccgcccgcgccgtcgccctcgtccccggcctccccgcagccgccgcccgccgtggccgcgccctcggagaagaactccatccccatccccaccatcatcatcaaggccccgtccaccagtagcagcggccgcagcagccagggcagcagcaccgaggcggagccccccacccagccggagcccacgggaggcggcggcggcggcggctcctcgcccagccccgccccggccatgtcacccgtgcccccgtccccctcgcccgtgcccacccccgcctcgcccagcggcccggccacgctggacttcacgagccagttcggggccgccctggtgggggcggcccggagggaggggggctggcagaatgaggcgcgccggcgctccacgctgttcctgtccaccgacgcgggggacgaggacggcggggacggcgggctgggcacaggggcggccccgggcccgcggctgcgccactccaaatccatcgacgagggcatgttctccgccgagccctacctccgactggagtctgcgggcagcggcgcgggctacggcggctacggggccggtagccgagcctacgggggtggcgggggcagcagcgccttcaccagcttcctgcccccgcgacccctggtgcacccgctgaccggcaaggccctggatcccgcctccccgctggggctggccctggccgcccgcgagcgagcgctgaaggagtcctcggagggcggcggggccccccagccgcctcccaggcccccatcgccccgctacgaggccccgccgcccaccccgcaccaccactcgccccacgcccaccacgagccagtgctgcgtctctggggggcctccccgccggaccctgcgcgccgggagctggggtacagggccgggctgggcagccaggagaagtcccttcccgccagcccgcccgccgcccggcgttccctgctacaccgcctgccgcccaccgctcccggggtggggcccctcctgctgcagctggggacggagcccccggccccgcaccccggagtaagcaagccctggaggtccgcagcccccgaagaacccgagcggctgccgctgcacgtgcggttccttgaaaactgccagccccgggcccctgtgacgagcggaaggggtcccccctcggaggacgggccgggggtcccgccgcccagcccacgccggtccgtgcccccctccccgacctccccgagggccagcgaagagaacgggctgcccctgctggtcctgccgcctcccgccccctcggtggatgtggaagatggcgaattccttttcgtggaaccgctgcctccgcctctggaattctccaacagcttcgaaaagccagagtcgcccctcacgcctgggcctccccacccgctgcccgacacacctgcccctgccaccccgttaccccctgtgccacccccggctgtggccgcagcccctcccaccctggactccaccgcatccagcctgacatcctatgacagcgaggtggccaccctgacccagggggcctccgccgctcctggggacccccatccaccaggcccgcctgccccagcagcaccggctcccgctgccccacagcctggcccggaccctccgcctggcacggattctggcatcgaggaggtggacagtcggagcagcagtgaccacccactggagaccatcagcagcgcctccacgctgagcagcctatctgccgaaggtggtggcagcgcagggggtgggggcggggctggggccggtgtggccagtgggccggagcttctggacacctatgtggcctacctggacggccaggcctttgggggcagcagtactcccggcccgccataccctcctcagctcatgactccctctaagctccggggccgggcgctaggagccagcggaggcctgcggcctggccccagcgggggactccgagaccctgttacccccaccagccccaccgtctcggtgacaggggctggaaccgatgggctgctggccctgcgtgcttgttcaggaccccccacggcaggcgtggcggggggtccggtggctgtagagccagaagtcccaccggtgcccttgccgacggcctcctgtctgccccggaagctgctgccctgggaggagggcccgggcccaccgccaccacctctgcccgggcccttggcccagcctcaggcctcagccttggccacagtaaaagccagcatcatcagtgaactcagctccaagcttcagcagtttgggggctcctcggcagctggcggcgctctgccctgggcccgaggaggcagtgggggaggcggagacagccaccacgggggagccagctatgtccccgagaggacctcctccctgcagcggcagagactctccgacgactcccagtcctcactcctctccaagcctgtcagcagcctgtttcagaactggcccaaaccacctctgccgccactccccaccggaacaggggtctcccctacagccgctgcggccccaggggccacctcaccctcagcctcctcctcctccacgtccacccgccacctccagggcgtggagttcgagatgcggccccctctgctccgccgggcccccagcccctcgctgctgcccgcctcggagcacaaggtcagccctgcgcccaggccctcgtccctgcccatcctgccttccggacccctctacccaggcctctttgacatccgtggctccccaactggaggggcaggaggctcggctgaccccttcgccccagtctttgtgccgccacacccggggatatccggggggctcgggggagccttgtcaggggcctcgcgctccctctcaccgacccgcctgctctcgctgcccccggacaagccgtttggcgctaaacctctggggttctggaccaagttcgacgtggctgattggctggagtggctgggtttggcggagcaccgagcccagttcctggaccacgagatcgatggctcccacctgcccgccttgaccaaggaggactacgtcgatctaggtgtgaccagggtgggccaccgcatgaacatcgaccgggctctcaaattcttcctggagaggtgatggctggcctggacggaccagccccgtccacagaactcttgagcctgctggcctcttgacctctgacccctgactgtcattctctccccgggccagggactctgttcaaactgcgccctgccctcatcttccaaggcc

SEQ ID NO: 53389 - DNA, 1926 bp, Homo sapiens
ggagatattatgaggctgttgtcattagggcgattgcggtggaatcgctgaatcttgactcggcggtggttggctctccctctcctctctccctctccctctccctctctgtctcgggttctctctctgcgcgcgcgcaccgggccgctctcctacctccctctctatgtggctgcgcgggtgtgtgtgtgtgtggatgtgtgtggggtgtgggtgtcccttacgcccttcctcctctccctcctcctcctgctcccccctcctttccttctcctcctcccccctctcctctccctcctcctggtcctcatcgcccctctctcctcttcctcccctctctcttcctctccctgaattttctcctctcctctcaggtcagtccatggtattccgctcccccctagacctctattcctcccacttcttgttgccaaacttcgccgattctcaccaccgctccatacttctggcgagtagcggcggcgggaacggtgcgggaggcggcggcggcgcgggaggcggcagcggcggcgggaacggtgcgggaggcggcggtgctggcggagcaggcggcggcggcggcggcggctccagggcccccccggaagagttgtccatgttccagctgcccaccctcaacttctcgccggagcaggtggccagcgtctgtgagacgctggaggagacgggcgacatcgagcggctgggccgcttcctctggtcgctgcccgtggcccccggggcgtgcgaggccatcaacaaacacgagtcgatcctgcgcgcgcgcgccgtggtcgccttccacacgggcaacttccgcgacctctaccacatccttgagaaccacaagttcaccaaggagtctcacggcaagctgcaggccatgtggctcgaggcgcactaccaggaggccgagaagctgcgcggccgcccactcggcccggtggacaagtaccgcgtgcgcaagaagttcccgctgccacgcaccatctgggacggcgagcagaagacgcattgcttcaaggagcggactcggagcctgttgcgggagtggtacctacaggacccctaccccaaccccagcaagaaacgcgaactggcgcaggccaccggcctcactcccacacaagtaggcaactggtttaagaaccggcggcagcgcgaccgcgccgcggcggccaagaacaggctccagcaccaggccattggaccgagcggcatgcgctcgctggccgagcccggctgccccacgcacggctcggcagagtcgccgtccacggcggccagcccgaccaccagcgtgtccagcctgacggagcgcgcggacaccggcacctccatcctctcggtaacctccagcgactcggaatgtgatgtatgatagccaaggccgccctcctccctctccttcccctcctcccccactccttcccctccgcctcctagccctcctcctcttcctcctcttccttctcctcctccatccccagaacaaaccgaaatcaggatacccaaccatacacacatacaagtccacacacactcccaccccagccaaaaatatataaaaaacaagaaaataacaaattaaccgcaaactatcaacaacccccaaccaccatctaccactacggccaccccaaaggaccccgacgccaacagacagtcaaacgctgatgttgcgggcagaaaacataaaagaggtgacaattgtatactttctaggacaagcacggcttctcctttcggttcccatggacccggcaccccacctgcatgacgatttatttgtatctgggaaaatattctctctagttaaaaatgatttaaagagtcgactatacaaagatcaatcaccaccacgaggacaagagggcaatgagcatgaacagacagagtaagaaacaagtcgccgtctccgttccg

SEQ ID NO: 53390 - DNA, 2959 bp, Homo sapiens
acttgcagcctccttccccccgagcggagctgcggggccggccgggccggggcggaccccgggaacccggacgcggccgcccgggcccgcgggcggggggatcggcgggggggacccgcggggtgaccggcggcaggagccgccaccatggagttccgccaggaggagtttcggaagctagcgggtcgtgctctcgggaagctgcaccgccttctggagaagcggcaggaaggcgcggagacgctggagctgagtgcggatgggcgcccggtgaccacgcagacccgggacccgccggtggtggactgcacctgcttcggcctccctcgccgctacattatcgccatcatgagtggtctgggcttctgcatcagctttggcatccgctgcaacctgggcgtggccatcgtctccatggtcaataacagcacgacccaccgcgggggccacgtggtggtgcagaaagcccagttcagctgggatccagagactgtcggcctcatacacggctcctttttctggggctacattgtcactcagattccaggaggatttatctgtcaaaaatttgcagccaacagagttttcggctttgctattgtggcaacatccactctaaacatgctgatcccctcagctgcccgcgtccactatggctgtgtcatcttcgtgaggatcctgcaggggttggtagagggggtcacataccccgcctgccatgggatctggagcaaatgggccccacccttagaacggagtcgcctggcgacgacagccttttgtggttcctatgctggggcggtggtcgcgatgcccctcgccggggtccttgtgcagtactcaggatggagctctgttttctacgtctacggcagcttcgggatcttctggtacctgttctggctgctcgtctcctacgagtcccccgcgctgcaccccagcatctcggaggaggagcgcaagtacatcgaggacgccatcggagagagcgcgaaactcatgaaccccctcacgaagtttagcactccctggcggcgcttcttcacgtctatgccagtctatgccatcatcgtggccaacttctgccgcagctggacgttctacctgctgctcatctcccagcccgcctacttcgaagaagtgttcggcttcgagatcagcaaggtaggcctggtgtccgcgctgccccacctggtcatgaccatcatcgtgcccatcggcggccagatcgcggacttcctgcggagccgccgcatcatgtccaccaccaacgtgcgcaagttgatgaactgcggaggcttcggcatggaagccacgctgctgttggtggtcggctactcgcactccaagggcgtggccatctccttcctggtcctagccgtgggcttcagcggcttcgccatctctgggttcaacgtgaaccacctggacatagccccgcgctacgccagcatcctcatgggcatctccaacggcgtgggcacactgtcgggcatggtgtgccccatcatcgtgggggccatgactaagcacaagactcgggaggagtggcagtacgtgttcctaattgcctccctggtgcactatggaggtgtcatcttctacggggtctttgcttctggagagaagcagccgtgggcagagcctgaggagatgagcgaggagaagtgtggcttcgttggccatgaccagctggctggcagtgacgacagcgaaatggaggatgaggctgagcccccgggggcaccccctgcacccccgccctcctatggggccacacacagcacatttcagccccccaggcccccaccccctgtccgggactactgaccatgtgcctcccactgaatggcagtttccaggacctccattccactcatctctggcctgagtgacagtgtcaaggaaccctgctcctctctgtcctgcctcaggcctaagaagcactctcccttgttcccagtgctgtcaaatcctctttccttcccaattgcctctcaggggtagtgaagctgcagactgacagtttcaaggatacccaaattcccctaaaggttccctctccacccgttctgcctcagtggtttcaaatctctcctttcagggctttatttgaatggacagttcgacctcttactctctcttgtggttttgaggcacccacaccccccgctttcctttatctccagggactctcaggctaacctttgagatcactcagctcccatctcctttcagaaaaattcaaggtcctcctctagaagtttcaaatctctcccaactctgttctgcatcttccagattggtttaaccaattactcgtccccgccattccagggattgattctcaccagcgtttctgatggaaaatggcggtttcaagtccccgattccgtgcccacttcacatctcccctaccagcagattctgcgaaagcaccaaatttctcaagaccctcttctccctagcttagcataatgtctggggaaacaaccaaaatcgcaattttaacaatatgcctctctacccccgtgcactttttctgacatggttttcaggtctaaatagtggctgctccagtccatgaactcaaaggtttgaagctaccaccattgaactcccccatggtggtttcatgatgccccctccccaattcctcgcactttattctcctgggtggtttcgaactaccctgtttctcagtggccatttgttgtgtccctcaggggcttaatgactcaaaatctgggatccttcccctctcagacacccctctttcagcttagaatttggggaacctatagagaagtcacagaatcccatgaaagggaatggggcaggagacaggggtgttttttcccagtgcagggttgtgtctttgtgtctctgtctctgtgactgtaaatcctgccctgccccactcccaataaaagctttggtgtataggcaaaaaaaaaaa

SEQ ID NO: 53391 - DNA, 3983 bp, Homo sapiens
ggtagtaacttgcagtttcagagcacatgcacactgtcagggctagcctgcctgcttacgcgcgctgcggattgttgctccgttgtacctgctggggaattcacctcgttactgctcgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtcagtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggaacatgttccctccaaatctggtagaagcctgctttaaacagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagcatcacagccacagctgccagtattggggcagctggaattcctcaggcgggcctggtcactatggtcattgtgctgacatctgtcggcctgcccactgacgacatcacgctcatcatcgcggtggactggttcctggatcgcctccggaccaccacaaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatatacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtagtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaatcatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgtttttttaatatactaaccatttcttatggaaaggtcctgtggggagcccatcatctcgccaagccatcacaggctctgcatacacatgcactcagtgtggactgggaagcattactttgtagatgtattttcaataaagaaaaaaatagttttacattaaaaaaaaaaaaaaaaaaaaaaaaaaaaaaagaaaaaaaaaaaaaaaa

SEQ ID NO: 53392 - DNA, 2581 bp, Homo sapiens
gctcgcgccccgcggcagctccgcagtgcactagccaccaccgccgccgccgccgctccgccagacctgctgccagcttgcccggtccagccctgagagagcctcgaacgccagctgcgagggtcatgagccagagagccccggggcgccgcgcggagagcaagcggagatagcgactttgcgccccccagccctcgccttcttgcatcgcgttccccgcatcctcgggtccttctgtcctttccgctgtccccaccgccgccatggccaccttgctccgcagcaagctgtccaacgtggccacgtccgtgtccaacaagtcccaggccaagatgagcggcatgttcgccaggatgggttttcaggcggccacggatgaggaggcggtgggcttcgcgcattgcgacgacctcgactttgagcaccgccagggcctgcagatggacatcctgaaagccgagggagagccctgcggggacgagggcgctgaagcgcccgtcgagggagacatccattatcagcgaggcagcggagctcctctgccgccctccggctccaaggaccaggtgggaggtggtggcgaattcgggggccacgacaagcccaaaatcacggcgtgggaggcaggctggaacgtgaccaacgccatccagggcatgttcgtgctgggcctaccctacgccatcctgcacggcggctacctggggttgtttctcatcatcttcgccgccgttgtgtgctgctacaccggcaagatcctcatcgcgtgcctgtacgaggagaatgaagacggcgaggtggtgcgcgtgcgggactcgtacgtggccatagccaacgcctgctgcgccccgcgcttcccaacgctgggcggccgagtggtgaacgtagcgcagatcatcgagctggtgatgacgtgcatcctgtacgtggtggtgagtggcaacctcatgtacaacagcttcccggggctgcccgtgtcgcagaagtcctggtccattatcgccacggccgtgctgctgccttgcgccttccttaagaacctcaaggccgtgtccaagttcagtctgctgtgcactctggcccacttcgtcatcaatatcctggtcatagcctactgtctatcgcgggcgcgcgactgggcctgggagaaggtcaagttctacatcgacgtcaagaagttccccatctccattggcatcatcgtgttcagctacacgtctcagatcttcctgccttcgctggagggcaatatgcagcagcccagcgagttccactgcatgatgaactggacgcacatcgcagcctgcgtgctcaagggcctcttcgcgctcgtcgcctacctcacctgggccgacgagaccaaggaggtcatcacggataacctgcccggctccatccgcgccgtggtcaacatctttctggtggccaaggcgctgttgtcctatcctctgccattctttgccgctgtcgaggtgctggagaagtcgctcttccaggaaggcagccgcgcctttttcccggcctgctacagcggcgacgggcgcctgaagtcctgggggctgacgctgcgctgcgcgctcgtcgtcttcacgctgctcatggccatttatgtgccgcacttcgcgctgctcatgggcctcaccggcagcctcacgggcgccggcctctgtttcttgctgcccagcctctttcacctgcgcctgctctggcgcaagctgctgtggcaccaagtcttcttcgacgtcgccatcttcgtcatcggcggcatctgcagcgtgtccggcttcgtgcactccctcgagggcctcatcgaagcctaccgaaccaacgcggaggactagggcgcaagggcgagcccccgccgcgcttctgcgctctctcccttctcccctcaccccgcccccaccagcccagtgcgccctgccgccgcgcttgggaggccaagctttaaacatctctggttcctagtttctgattattcggggatgggggggatgggaggggacagggattcacgatccatcgcgtctgcgtttctgttgtcctttcttttccacaacaccctggttttggggggaggcggggtgcatttgcgggcagggttctctgtccttccaagtggggccccgacactttggttccagtcatcgagggggttgggaagggagggagagggggcgcagctcgcaggcgtggcaacttgaccttgggggaatatttcacatccatccagagctcggaatctacagcgtccagccatttccagcaagagcgcttcccattccggagacgtttcaaccctgcagcgggaaaggctgactgggaaatccattttgggtgggcaatttccttcaacgaagccggaaggcgagaagccgcggcggggccagcttgcctgccggttttcaggaatctaaactctcatcttgtgcaatttatcaggtgtggaactgttctactgtgcgtgtggtgtgctcgtggtgaataagatgaaatgtatatcagaaaaaaatctatctctaatttagagtgcggtacataattatatccgcaaataaagaagagacaaaggctaaaaaaa

SEQ ID NO: 53393 - DNA, 4860 bp, Homo sapiens
agcgggactggagaggagtgagtggcgggctgggcggcggcggccgtagccgcgggtgcctccccgcctcaccgcttcgcaggcagcaccgcctcccgggccgcggccgcccggccgggtcctctgcgcgttcccgggcccggaaccggcacacgatgcacccggctgcgttctgatcgccgccgcgcctcagcctctgccgcgatgatcccccctgagcagccgcagcagcagctgcagccgccgtcgccagccccgccgaaccatgtggtgaccaccatcgagaacctgccggccgagggcagcggcggcggcgggagcctgtccgcctcctcccgggctggcgtgcgccagaggatccgcaaagtgctgaacagggagatgttaatctctgtggccctaggccaggtgttatccctccttatttgtggaattggcttgactagcaagtatctgtcagaagatttccacgccaacacaccagtcttccagagtttcctcaattacattcttctcttcttggtctataccaccacactagccgtcagacaaggagaagaaaacctcctggcaattttacgacgaagatggtggaagtacatgattttgggactcatagacctggaagcaaattatctggtggtcaaggcttaccaatacacaaatctgaccagtatccagctcctggactgttttgtgatcccagtcgtgattttgctctcctggttcttcctgctgatccggtacaaggctgtgcatttcatcggcatcgttgtctgcatcctgggaatgggctgcatggtgggagcagatgtgcttgtgggaagacatcagggagcaggggaaaataagctggtaggggaccttctggtcttaggaggagccacactctatggtatttctaacgtctgggaagaatacatcatccgaactctgagccgagtggaattcctgggaatgattggtctctttggagcatttttcagtggaattcaattagctataatggagcataaggaactgttgaaggtgccctgggactggcaaataggactgctctacgttggctttagtgcctgcatgtttggtctctacagctttatgcaagtcgtcataaagaaaaccagtgccacttcagtcaacctctccttgctcacagcagacttgtacagcctgttctgtggattgtttctcttccactacaagttttcaggactttatctcctgtctttcttcaccatcctcattgggctggtgctctactcctccacctccacctacatagcccaggacccccgagtgtataagcagttccgcaatccttcaggacctgttgtggacttaccgaccacagctcaggtggaaccctcagtcacctacaccagcctgggccaggagaccgaagaggagcctcatgttcgtgtggcctagggtgaggcccgccctgccaactgaggccaactcattggccatgtttttgcccatcatctctgtattgtacatagagaaaggtatttactaggtgcagtttacacaggtggactgcaaggtagcaaatcctccaaaagcttgtgaaaggaacaagctcaacatcactggagacacaggctctaatccacctgacttggaaggatgcctagctaacgtgtatcctgatcacaactcccctgcattcattactgtgaaaatttttgaatcaaaagcaagtattattgttattatgatttgtattattattattgctgttactgttattacaccaactttcaggaggatgttttgtactcctgatggaaactattgccagacccacatgtagtcaacataaaccccacttttctatggcaattcactttttaagagtcatactttatttttttgcacagactatatgagtgatgcatgccacaggagctccacccctgagaagtttccttttcctagggacctggtggttaatggtttcctctgttacctgttggattgcctgctcaataagtattttgtgctgtgacctttgtggggaggggcaactgaccatatacttctctattctaggaatagatataaaagaaacattttagcctttttatatttcgatctctgattactccaggccattgcctttctgttgtgccacgtgattctgctaatcaagtccctgtaataacaggataaggactgttccattactgtggcttttgggagcccccagaaataatatcatttgtgtttaggacaatatataattataaaatctttctgctcctccctgtagcctctcttcaaaaactatcttttatttttttttccagatttccttagtgataatatggaaattaatcaaggcactggaaaaagccatggtactctgcccttttaattctgtgacacctttttaaaaatacaccagcatggaaattacctttattgtggaaaatcattggttgtgccacctcctaacaaagtcaaggtgctgatgtggagcagtctttgaaaatggcttaattgatttggccactttgcagtggtaacaatgtcatcattgaaaaagtctggcattttggtcatatttggcatccattcaataacagatatattgacacgacattctttttttttttttttttttttttgagacggagtctcactctgtcgcccaggctggagtgcggtggcacgatctcagctcactgcaacctccgcctccgggattcacaccattctcctgcctcagcctcccgagtagctgggactacaggcacctgccacgacgcccagctaattttttgtatttttagtagagacagggtttcaccgtgttagccaggatggtctcgatctcctgacctcgtgatccgcccaccttggcctcccgaagtgctgggattacaggcgtgagccactgcgcccggccaacacgacattcttatggacccagagaatactgcaggatcctgataagaccttgagtgatatgtcactagtctaatctgttgcccttaaaatagcccttttttcaaacacaggaaattaagaaacaccacagacctctattatttagaatagattctatgtgtcagtatgtgatgtactcttttagtttgactgacttcaataccattcaaaaagatcctcaatggagttacagggtttataggggaaaaatacatgtttatgagacattgggcaattcaaatcaacatgtgttacataagcaagcaaagcaaaacaccagtggggtctctggaaagtaaaaggacagactacagtagaaggactgatcccagagtgcctgtacaaggcctaaatctggcaggcaaaagcatcccacactgtctgtcagcacccacatggcctttttgcctgccttctataacgggtaagtggacctacccttggagatagagaagaaaaattatcttctctgatattcggatgtaatggtcatctcagttcagccccctaggaaacatgttttattttccatggggaaaatatcagcgttaaagctctatcaaatcaaaacaactttgccaacatcttctctctgctaccttttaaaccaattaaatacctttctctgaatattttgtccattcagatccgaagacctttaaagactgtggttttatttttgtgtttacattcctttggtttgaataatttgcttgatttattgcatttttagtatttattttaagccagatgttttcatctttgattcatttttatgacattaatttgtagacacttagtaaagtcttatgagaagcaagtggatgaaattatctccaagtccactcagtagactggagttttttaaaaatataaatttccaaaaagtttgcaatcaacagatggctaaaggttgccatctgaattattttataggatattttaattgactccattgtatggaaaccaagtgtgaatgttaagatgaatttgccgtataccctttatcattcggtgtccttgtactcagactttcatgtccctgggtgacctcaatgtgttggtttgtctccatttagaaaggttgataatatattgaattgttcaagatcaggagttccagactgaccctccaggaaaaaaaaaatcgcaaagaacaaattctttttctgtgtaaaaaacactgatcctttgggaatggggcgggaaatgggagtaggacaacattaactttagctgttttagtttctgagatttcataacctcagtagacaccagcaaaattttcagtttctaactccaccaccaatctctcctcaatgaataagactttagcaatttatatagaatttgatcaggtaagagcgaaccacaattctcctgaaccctgctagagattaagtggtggttctcacttcatcaatgaaaacttgcactggggacagcgcttgccttggtcagaccttcccacatctacatactctcaaatacatgaccaggtgatcaagcaatggaaaaatttgcaccaccgtgtcccatgaaattgtttcaatgtttagtttagatattgctaacttgtgctattaaccttttgacaagcgtgtagtattgtttgttttgggtttctttttgatttataactatttagtagtccccagctagctaccagtacagattttaccccatgggtaggattctattgttaagccacataacaaagcacactaattctgacaacactgcaaatggaaaatacgaaccaaaaaaaagttacaccgataagttcaacaaactgtccatttttgatatttgcatgctcccctatggactggctgtggcaatgtaatgcctgtataatgttttcaaataaaaataaatgctttatgaaaaaaaaaaaaaaaa

SEQ ID NO: 53394 - DNA, 3756 bp, Homo sapiens
agaaagccgagggtttccgtcgcgaacccccctccccactcgctcagggctctccaatccgcagctctgcgtgcgggggcgcgcgcatccccccgccgtccgtccgtcagctgtctgtctgggtgtctatgcgggcgcagcagtgcacccttccccagcctcgggcgctgcgcagggacagacaaggcattcgcagcgccctgcccgcgctccacgcccgcagccgccagacggcagcgcctgcgtccgtgcccgccccagccggtgcgcgggagccgcgggggcaaaggcgcagtggccagcggaccatctctcgtgccctcgctctctgcgctccggggcagctgagccccggccacccgctctccaagatgaagaagctccagggagctcacctccgcaagcctgtcaccccagacctgctgatgacccccagtgaccagggcgatgtcgacctggatgtggactttgctgcacaccgggggaactggacaggcaagctggacttcctgctgtcctgcattggctactgtgtaggcctggggaatgtctggcgcttcccctatcgagcgtacaccaatggaggaggcgccttcctcgtgccctacttcctcatgctggccatctgtggcatccccctcttcttcctggagctctccctgggccagttctccagcctagggcccctggctgtctggaaaatcagccctctcttcaaaggcgccggcgcagccatgctgctcatcgtgggcttggtggccatctactacaacatgatcatcgcctacgtgctcttctacctcttcgcctccctcaccagcgacctaccctgggagcactgtggcaactggtggaacacagaactctgcctggagcacagagtctccaaggacggcaacggggccctgcccctcaacctcacctgcaccgtcagccccagcgaggagtactggagccgctacgtcctccacatccaaggcagccagggcatcggcagccctggggagatccgctggaacctctgcctctgcctgctgctggcctgggtcatcgtgttcctctgtatcctcaagggtgtgaagtcttcgggcaaggtggtgtatttcacggccacgttcccctacctcatcctgctcatgctgctggtccgcggagtcaccctcccaggggcctggaagggcatccagttctatctcaccccccagttccaccacttgttgtcttccaaggtgtggattgaagctgctcttcagatcttctattccctgggtgtgggcttcggggggctcctcacctttgcctcctacaacacgtttcaccagaacatctatagagacactttcatcgtcactctgggcaacgccatcaccagcatcctggctggctttgccatcttctccgtgctgggctacatgtctcaggagctgggcgtgcctgtggaccaagtagccaaagcaggccctggcctggcctttgtcgtctacccacaggccatgaccatgctgcctctgtcacccttctggtcctttctcttcttcttcatgcttctgactctcggcctagatagccagtttgcttttctggagaccattgtgacagctgtgacagatgagttcccatactacctgcggcccaagaaggcggtgttctcagggctcatctgcgtggccatgtacctgatggggctgatcctcaccactgatgggggcatgtactggctggtccttctggatgactacagcgccagcttcgggctgatggtggtggttatcaccacgtgccttgccgtgacacgggtgtatggcattcagaggttctgccgagacatccacatgatgctgggcttcaagccgggcctctacttcagggcctgctggctgttcctgtccccagccacgctcttggccctcctggtgtatagcatcgtcaagtaccagccctcggagtatggcagttaccgcttcccgccctgggctgagctgctgggcatcctgatgggcctgctgtcctgcctcatgatcccagctggcatgctggtggctgtgcttcgagaagagggctcactctgggagcggctccaacaggccagccggccggccatggactggggaccatcgctggaggagaaccggacgggcatgtatgtggccacgctggctgggagccagtcaccaaagccactgatggtgcacatgcgcaagtacgggggcatcaccagcttcgagaacacggccatcgaggtggaccgtgagattgcagaggaggaggagtcgatgatgtgaggcaggaggcaggcgggcagaaggccctgcccgggacctcacagtcccttcttagaagcctgcaaaggtcagctgtgccctctgggattctgagaggctatgggggggcctgccatagggatgccagtcccccagtgggggtcccttctgcagcctctgcctctcctgaaacctctgacaaccccctacacacacacacaggcatactcagacccactcaaagctgagaatgatccaactcagccctactttgcggatggacatattaaggccaggaggggagggacttgccccaggtcgcatggcagaggggacttgaacccacgcctcctgaccagccagctccctttcccatggggcagccggcaccaccttctcatctctattcagggcctacacccctccctttttggggggagcctgtccccacacaccttagcacaaccagaatcttgagttgggcagggaaggtcagggctacagaggctcttgaggctccgaggccctggggatcaaaggtcaatgagttaggtggggagaaagatccctgggggctcctgtatgcaggactcctgaaggaggtgggagctgagggccctggaggatggggaaggtttgcagagagaggaagaagagggcagggtggggaggagctctgggccagaggatgctgagctgcctgggcagagaccaagagggttggagacactagttttaccaggttacaggagggttcaagacagaaggaaaactaacagagggggagccagggatgatggggtgggcaggggatttgcatgatgaggagtatcattccagatctgtgcagagcggatcggacgggacagggtggagcggggaggcctgtgcaaagtgggaaagagctgccggtggcctgagccagggtgctggggctgcgggtggggaaaggaggccccagcacttcagacaaagaccaccccttcacccactggaccccaagccgcaaaagctggggaggtaggaagggtcactgtgagggcccagggcccctctcttcccatctcccttgtcctggtggccttcagtgtctcttccagttccaggagctgctgggaagctggccttcattgttggtgacagggcaaccatgggactaggaggtggcccatacacatggctggctggtcctgaggccacccaccttgttccaggacatgggcccgggcccggtgtgggggtagacgcagagggcagagggtagcccttggtactgtgggtccctcaaagaggagagtggggtgcagaaatgcctcagcatggctcatgcacacagcattctcccgtggggcagggttccctcatgcaacaggcctccctgtggccagcctctctgcctgtctctcgctgtgtccccccaaccccttgtgttctattggttcattgttaataaatatcaaatgaggtcacgctccttaaaaaaaaaaaaaaaaaa

SEQ ID NO: 53395 - DNA, 4282 bp, Homo sapiens
ctctctctctttcgggcggagtcgcccaccactgccagcccagcgctggggggacctgctccaggctgtagccgcaggaccccaccaccccccatggctcccctggccttggtgggggtcacactcctcctggcggctcccccatgctccggggcagccaccccaaccccctccctgccgcctcccccggccaatgacagcgacaccagcacagggggctgccaggggtcctaccgctgccagccgggggtgctgctgcccgtgtgggagcccgacgacccgtcgctgggtgacaaggcggcacgggcagtggtgtactttgtggccatggtctacatgtttctgggagtgtccatcatcgccgaccgtttcatggcggccatcgaggtcatcacgtcaaaagagaaggagatcaccatcaccaaggccaacggtgagaccagcgtgggcaccgttcgcatctggaatgagacggtgtccaacctcacgctcatggccctgggctcctccgcacctgagatcctgctgtcagtcatcgaagtctgcggccacaacttccaggcgggtgagctgggcccaggcaccatcgtgggcagcgctgccttcaacatgtttgtggtcatcgccgtgtgcatctacgtcatcccagccggcgagagccgcaagatcaagcacctgagagtcttctttgtcactgcctcttggagcatcttcgcctatgtctggctttatctcatccttgctgttttttcccccggtgtggtccaggtgtgggaggcgctgctgaccctggtcttcttcccggtgtgcgtggtattcgcctggatggccgacaagcggctgctcttctacaagtacgtgtacaagcgctaccgcaccgacccacgcagcggcatcatcataggcgccgagggcgaccccccgaagagcatcgagctggacggcacgttcgtgggcgccgaggccccaggtgagctgggcggcctgggcccgggccccgccgaggcgcgcgagctggacgccagccgccgcgaggtcatccagatcctcaaggacctcaagcagaagcacccggacaaggatctggagcagctggtgggcatcgccaactactacgcgctgctgcaccagcagaagagccgcgccttctaccgcatccaggccacgcggctgatgaccggcgccgggaacgtgctgcgcagacacgcggcggacgcctcgcgcagggcggcgccggccgagggcgcgggcgaggacgaagacgacggcgccagccgcatcttcttcgagcctagcctctaccactgcctggagaactgcggctccgtgctgctgtccgtcacgtgccagggcggcgagggcaacagcaccttctacgtggactaccgcactgaggacggctctgccaaggcgggctccgactacgagtacagcgagggcacgctggtgttcaaaccaggcgagacgcagaaggagctgcgcatcggcatcatcgacgacgacatcttcgaggaggacgagcatttcttcgtgcggctgctgaacctgcgcgtgggcgacgcgcagggcatgttcgagccggacggcggcgggcggcccaaggggcggctggtggcgccgctgctggccaccgtcaccatcctggacgacgaccacgcaggcatcttctccttccaggaccgcctgctgcacgtgagcgagtgcatgggcaccgtggacgtgcgcgtcgtgcgcagctcgggcgcgcgcggcaccgtgcgccttccctaccgcacggtggacggcacggcgcgcggcggcggcgtgcactacgaggacgcgtgcggagagctggagtttggcgacgacgagaccatgaaaactcttcaggtgaagatagttgatgacgaggaatatgagaaaaaggataatttcttcattgagctgggccagccccagtggcttaagcgagggatttcagctctgctactcaatcaaggggatggggacaggaagctaacagccgaggaggaggaggctcggaggatagcagagatgggcaagccagttcttggggagaactgccggctggaggtcatcatcgaggagtcatatgattttaagaacacggtggataaactcatcaagaaaacgaacttggccttggtaattgggacccattcatggagggagcagtttttagaggcaattacggtgagcgcaggggacgaggaggaggaggaggacgggtcccgggaggagcggctgccgtcgtgctttgactacgtgatgcacttcctgacggtgttctggaaggtgctcttcgcctgtgtgccccccaccgagtactgccacggctgggcctgctttggtgtctccatcctggtcatcggcctgctcaccgccctcattggggacctcgcctcccacttcggctgcaccgttggcctcaaggactctgtcaatgctgttgtcttcgttgccctgggcacctccatccctgacacgttcgccagcaaggtggcggcgctgcaggaccagtgcgccgacgcgtccatcggcaacgtgaccggctccaacgcggtgaacgtgttccttggcctgggcgtcgcctggtctgtggccgccgtgtactgggcggtgcagggccgccccttcgaggtgcgcactggcacgctggccttctccgtcacgctcttcaccgtcttcgccttcgtgggcattgccgtgctgctgtaccggcgccggccgcacatcggcggcgagctgggcggcccgcgcggacccaagctcgccaccaccgcgctcttcctgggcctctggctcctgtacatcctcttcgccagcctggaggcgtactgccacatccggggcttctagggcctcgcgcagagactcgtccccaccgcccgcccggggctagggactcggctgcacctgctcttggaccctggtctccttttccccccagactcggcctcctctcctgggactcggcctcccttctccgccccctcccctggctttgattgcccctgttctgtgtccccagtagctcagccttccctcttcctctcgggagcctccccggttcctcccctgcggtgaccccaactccagcccatcctgttggtgaccgtctatatccctggggaaatttccaccccagtcccctccccagggaaccacccccagtaaccatcctggggagtttaaggtctctctccttggtcacccagcctggctttgcccccaaagtctcccttcccctagtgacccccccccacttcaccccatgtcccagagcctcagaacccaccctccctgggggaccctcgaaggaggctgtcagaggccgtctcagctcccagcccttccccccagccctcagggagctccgctcagccccggcggggaggagcgggtgggtgtgcgcgcaaggaggccgcacacctttccttccaatccctccactcgggttcttgggaggacactcattctccaggctcggagacgaggggagaagtttggggtttcagtcccagggcttagccggaggaagcacattttgaacctgcaacttcagacattccagctcccccactcgccctccactacctctgagagcccagccacgccttggagggaggggcttgtgtgtgtatatagtgtgtttgggggaggggggacgcgggagggtgcatgtcttgggaaaagggggtgacagacaacttttgagagggcagcagactccctcagccatgagaaccagctttggggaggaggccgggaatcaaagcgagtccagttgatctcccctgacaatctggaaggttcattttgccctcagtgccagccaatccgggcaggaccctcgaagaggagaccgagggtcccagaggaccaatgctacaagccagcaaatgctgccacatctctgcctgatggggggtggggatgggtggggggatgggactgggccaagggatctgggtgggcatttttaactttggaggccttccatctgtcggtaggccatctgcattttcttactgttgatgtttcctgcccaaaggacacatttgggcagtgccacccactccttgggcccctaggatgacccaactacccccataactttctgcttcccacaggttttcagcattctatcgtcctgttgtgctcagccccaacatcccagacccgttacccgctacccttctctcccccagctcatcatcagtcgctgtctcttttctgtgatttctgtaaaagttgccataaaactttgaaattctgcctg

SEQ ID NO: 53396 - DNA, 3381 bp, Homo sapiens
cgcaaagaaatggctcaaaagcttcagctctttctgtgccctgggagctgagatgcacgtcagtggccttgccagcgtggccaattctctgctgactgccagaaaaaagaggccaggaagaaagaggaaagagaagagatcgctcaggggtgagaccatgcccttcatcttttcttttccctaatctcctctgcttgtgtccacccacactctccccacctggcaaaattgttcaaaattgctgtggagtttacctcagtttcctctttcagtctgtggtgtgtggtccatcctcttgctgagcacattgaaaggaactggctatctttgatctcttcctccagatcagagtcaaggaatgtgtttataatggacacttcatccaaagaaaatatccagttgttctgcaaaacttcagtgcaacctgttggaaggccttcttttaaaacagaatatccctcctcagaagaaaagcaaccatgctgtggtgaactaaaggtgttcttgtgtgccttgtcttttgtttactttgccaaagcattggcagaaggctatctgaagagcaccatcactcagatagagagaaggtttgatatcccttcttcactggtgggagttattgatggtagttttgaaattgggaatctcttagttataacatttgttagctactttggagccaaacttcacaggccaaaaataattggagcagggtgtgtaatcatgggagttggaacactgctcattgcaatgcctcagttcttcatggagcagtacaaatatgagagatattctccttcctccaattccactctcagcatctctccgtgtctcctagagtcaagcagtcaattaccagtttcagttatggaaaaatcaaaatccaaaataagtaacgaatgtgaagtggacactagctcttccatgtggatttatgttttcctgggcaatcttcttcgtggaataggagaaactcccattcagcctttgggcattgcctacctggatgattttgccagtgaagacaatgcagctttctatattgggtgtgtgcagacggttgcaattataggaccaatctttggtttcctgttaggctcattatgtgccaaactatatgttgacattggctttgtaaacctagatcacataaccattaccccaaaagatccccagtgggtaggagcctggtggcttggctatctaatagcaggaatcataagtcttcttgcagctgtgcctttctggtatttaccaaagagtttaccaagatcccaaagtagagaggattctaattcttcctctgagaaatccaagtttattatagatgatcacacagactaccaaacaccccagggagaaaatgcaaaaataatggaaatggcaagagattttcttccatcactgaagaatctttttggaaacccagtatacttcctatatttatgtacaagcactgttcagttcaattctctgttcggcatggtgacgtacaaaccaaagtacattgagcagcagtatggacagtcatcctccagggccaactttgtgatcgggctcatcaacattccagcagtggcccttggaatattctctggggggatagttatgaaaaaattcagaatcagtgtgtgtggagctgcaaaactctacttgggatcatctgtctttggttacctcctatttctttccctgtttgcactgggctgtgaaaattctgatgtggcaggactaactgtctcctaccaaggaaccaaacctgtctcttatcatgaacgagctctcttttcagattgcaactcaagatgcaaatgttcagagacaaaatgggaacccatgtgcggtgaaaatggaatcacatatgtatcagcttgtcttgctggttgtcaaacctccaacaggagtggaaaaaatattatattttacaactgcacttgtgtgggaattgcagcttctaaatccggaaattcctcaggcatagtgggaagatgtcagaaagacaatggatgtccccaaatgtttctgtatttccttgtaatttcagtcatcacatcctatactttatccctaggtggcatacctggatacatattacttctgaggtgcattaagccacagcttaagtcttttgccttgggtatctacacattagcaataagagttcttgcaggaatcccagctccagtgtattttggagttttgattgatacttcatgcctcaaatggggatttaaaagatgtggaagtagaggatcatgcagattatatgattcaaatgtcttcagacatatatatttgggactaactgtgatactgggcacagtgtcaattctcctaagcattgcagtacttttcattttaaagaaaaattatgtttcaaaacacagaagttttataaccaagagagaaagaacaatggtgtctacaagattccaaaaggaaaattacactacaagtgatcatctgctacaacccaactactggccaggcaaggaaactcaactttagaaacatgatgactggaagtcatgtcttctaattggttgacattttgcaaacaaataaattgtaatcaaaagagctctaaatttgtaatttctttctcctttcaaaaaatgtctactttgttttggtcctaggcattaggtaatataactgataatatactgaaatatataatggaagatgcagatgataaaactaattttgaactttttaatttatataaattattttatatcatttacttatttcactttattttgctttgtgctcattgatatatattagctgtactcctagaagaacaattgtctctattgtcacacatggttatatttaaagtaatttctgaactgtgtaatgtgtctagagtaagcaaatactgctaacaattaactcataccttgggttccttcaagtattactcctatagtattttctcccatagctgtcttcatctgtgtattttaataatgatcttaggatggagcagaacatggagaggaagatttcattttaagctcctccttttccttgaaatacaataatttatatagaaatgtgtagcagcaaattatattggggattagaattttgaattaatagctctcctactattaatttacatgtgctttttgtgtggcgctataagtgactatggttgtaaagtaataaaattgatgttaacatgcccaattattgttcttttatgaattcaatgaatttaaaactattgttaaatataatactgccccactttaatatatgtaagcaacttcctacttatacacgacgtgttcctaaaacatgtttgaaaggtgaatttctgaaagtctcccataaatgtaggtgttacaacaggaaaaaaaaaaaaaaaaa

SEQ ID NO: 53397 - DNA, 5201 bp, Homo sapiens
cgcgctctcttcctccctcagacaactcgccccccgccctccgcccccctccacgtaattccgaaagagcagaagaaagagaaggagaacaggaaaagaagagctagtaagcgagagcgagagcacagaaaagaaaaaaaaaagccttaagaggaccgaaggggaggaaaggaaaaggatggacaaccacaaaacgcagcgattgcggaaattttccagcgccattggctgggcagcgtgagtccttcggtcgggcgtgatttcagcaccgggggaactggacagcacctcggggggacttctgggcaacccgcaaccacagcaagaactccaccagcagcctcaacaacagaagccgcggaaaaccctgctttgtatcagagaggcaaggtcagtccgacgcacagccatgcacaggcagtgcgcctgtactacgctgcaaaccctctgcttgtttctctaacatgcacttgcttctaattactagcattgtttcatttctgatcagtgaagatcagtagatgagattctgtaagggtgtacttttaatttatatgtatatatttaacttctttttctgttatttttaaagtgttgtgggggagtggggtttttttcctacttttttttttttttttttttctttgcttgccttgcactacgtgcctggatagtttgtggatataattattgactggcgtctgggctattgcagtgcgggggggttagggaggaaggaatccacccccacccccccaaacccttttcttctcctttcctggcttcggacattggagcactaaatgaacttgaattgtgtctgtggcgagcaggatggtcgctgttactttgtgatgagatcggggatgaattgctcgctttaaaaatgctgctttggattctgttgctggagacgtctctttgttttgccgctggaaacgttacaggggacgtttgcaaagagaagatctgttcctgcaatgagatagaaggggacctacacgtagactgtgaaaaaaagggcttcacaagtctgcagcgtttcactgccccgacttcccagttttaccatttatttctgcatggcaattccctcactcgacttttccctaatgagttcgctaacttttataatgcggttagtttgcacatggaaaacaatggcttgcatgaaatcgttccgggggcttttctggggctgcagctggtgaaaaggctgcacatcaacaacaacaagatcaagtcttttcgaaagcagacttttctggggctggacgatctggaatatctccaggctgattttaatttattacgagatatagacccgggggccttccaggacttgaacaagctggaggtgctcattttaaatgacaatctcatcagcaccctacctgccaacgtgttccagtatgtgcccatcacccacctcgacctccggggtaacaggctgaaaacgctgccctatgaggaggtcttggagcaaatccctggtattgcggagatcctgctagaggataacccttgggactgcacctgtgatctgctctccctgaaagaatggctggaaaacattcccaagaatgccctgatcggccgagtggtctgcgaagcccccaccagactgcagggtaaagacctcaatgaaaccaccgaacaggacttgtgtcctttgaaaaaccgagtggattctagtctcccggcgccccctgcccaagaagagacctttgctcctggacccctgccaactcctttcaagacaaatgggcaagaggatcatgccacaccagggtctgctccaaacggaggtacaaagatcccaggcaactggcagatcaaaatcagacccacagcagcgatagcgacgggtagctccaggaacaaacccttagctaacagtttaccctgccctgggggctgcagctgcgaccacatcccagggtcgggtttaaagatgaactgcaacaacaggaacgtgagcagcttggctgatttgaagcccaagctctctaacgtgcaggagcttttcctacgagataacaagatccacagcatccgaaaatcgcactttgtggattacaagaacctcattctgttggatctgggcaacaataacatcgctactgtagagaacaacactttcaagaaccttttggacctcaggtggctatacatggatagcaattacctggacacgctgtcccgggagaaattcgcggggctgcaaaacctagagtacctgaacgtggagtacaacgctatccagctcatcctcccgggcactttcaatgccatgcccaaactgaggatcctcattctcaacaacaacctgctgaggtccctgcctgtggacgtgttcgctggggtctcgctctctaaactcagcctgcacaacaattacttcatgtacctcccggtggcaggggtgctggaccagttaacctccatcatccagatagacctccacggaaacccctgggagtgctcctgcacaattgtgcctttcaagcagtgggcagaacgcttgggttccgaagtgctgatgagcgacctcaagtgtgagacgccggtgaacttctttagaaaggatttcatgctcctctccaatgacgagatctgccctcagctgtacgctaggatctcgcccacgttaacttcgcacagtaaaaacagcactgggttggcggagaccgggacgcactccaactcctacctagacaccagcagggtgtccatctcggtgttggtcccgggactgctgctggtgtttgtcacctccgccttcaccgtggtgggcatgctcgtgtttatcctgaggaaccgaaagcggtccaagagacgagatgccaactcctccgcgtccgagattaattccctacagacagtctgtgactcttcctactggcacaatgggccttacaacgcagatggggcccacagagtgtatgactgtggctctcactcgctctcagactaagaccccaaccccaataggggagggcagagggaaggcgatacatccttccccaccgcaggcaccccgggggctggaggggcgtgtacccaaatccccgcgccatcagcctggatgggcataagtagataaataactgtgagctcgcacaaccgaaagggcctgaccccttacttagctccctccttgaaacaaagagcagactgtggagagctgggagagcgcagccagctcgctctttgctgagagccccttttgacagaaagcccagcacgaccctgctggaagaactgacagtgccctcgccctcggccccggggcctgtggggttggatgccgcggttctatacatatatacatatatccacatctatatagagagatagatatctatttttcccctgtggattagccccgtgatggctccctgttggctacgcagggatgggcagttgcacgaaggcatgaatgtattgtaaataagtaactttgacttctgacaaaaaacaaaaagtgctgcatggctcgcatggaatccacgcgctccagggactctgcccgcccccgcgactggagacggcatctcgttcacagcacccaccctcttacctgataagttccatcgtatcaaactttctataaacaaaatacagtataatcagaaagtgccatttcgccattatttgtgatcggtaggcagttcagagcataagttaactgtgaaaaaaatgtaaaggttttatttaggacatttgcatggctagtcatcagtccattttatgagttaacaatgtattttgttgagggaagtttttaggggttgttttgggttcttttattttgatggtgatgttttattttattttatttttttcagggggtcttttttttaatacatatccaataatgccttccatctgaatgtaaaataagtacccatgatttctattatagtatcagtgtaattatttaaaaaatgattttgaggcagttaagcatgaccaattaatgtcactctagtgcttaggctgcgatcctatggtagcaattctgtgctggtataaatcttacttataaagtaggaaaagagaaccgaggaagcacgtgaaacttactaattctattcgaggattttataatggcatattttttcagtattaaagcgaaaatgttttcaactctgggtccttacctttttccagcttcatatttgcaagtggtaaattggatttgcggtggaagagacaggggagggaaacggttggggttagatcccttcctgagctacattaaggctctttctctaatcgccttacttagctttttaccctttaagtagctcctcttccctcgcccccaccctctaccccacccccaccttcgctcagactttaccggctttccccagtccataaaggtcttgccccaacactcaccccttctttttttcccctctccaaatgcagcagtgaatccctttattaatactggaaatccctctctgctgcttttgttggtgctgcccacactgcagatatattaaggatgttaggagagatttgatttaattgactctgcctagataggtctcattaaacagagtggagatttcattggtcagcactcctcaatgaaagacagacctaatgactggcatttgagatgctgctggcattttgaattcaacatctgctgaaaacggtaaaactaattagtgcccacccaccctccccgccccagcaactgcatattgaaatttgttaaagcactcatctttatggaaattaatcattatcctaaagaagtgtttctctcccatcatccggatttctggttgtggcccagcaattaacaaaaacagcttcaactgttcgaattttatgaaccaatgtaactctggcctcaatcatattcctctgggatttctaaacagcagttaagctacaaaaagcaaacaaaaccacacatattgatggagtctgcattccaccacatatccacccttgagaagtatgtcaaaagactgcagactatagatttttttttaatataggattataaatcagctagtgaaagacctcagagcagttgtaagtagatctgccatctagaactcatattctaaagggaagtgatttctcagaacagtgatgttctggaatatgtattatttattttaacacttttttaataaaatctttattataaaccaaaaaaaaaaaaaaaa

SEQ ID NO: 53398 - DNA, 5022 bp, Homo sapiens
cttcctgcaagaagcgttgcccgttggctagctgctcggtggggatctgcctgccctgggggcgccgcccgcgctccccgcggtgctctcgctcctgggctgcgccagtccgaggcggtgccggctcctttgcctccccgagtcgcagatgctgcgggcgcctccgggaaaagatctgggcggcgcgctcgctcgatggacacaggaagatccagaagctagtggcacatctagcaacagagccagatcagaacccaggcaagaagtgcacgtttaaacctcattatctggctaagtataaacctcagggagaaaaggggtttgtttttgtttttctcagtctataagctaacattgagctgactttcagagtccaggcaaatatgtttggtgggtcaccacccagaaaggaattctcttagcactgaatcagggctctgtatgtaaagtataaatcccctaagagaactcctcaccctcctacacagacacattggtgcatgcacacacaccccactctctgcacagagagcatctgagctaggagctggcaagtggggcaccagtcctgtagcaaagaggcacaccacacacacacacacacacacacacacacactctctctctctctctctctcactcacacacacacacacacacacacacacacgcttctcccttgcttgggaatctgggagaagaaccccccacccccacccctgccctccataggcattgtgtaggtgagagaaagagggaggagtgagagagaacacacagaggggcccaaggaggtgccaggccattagcagggcccctccttgagaaacccctctgcaggagcttctcctgccgccagccaggttggaggtggagtagttcagaatcaactgacgcagccgggaattgagctttgcaaagccacttgcaaggaagggaagcatctgcccaaccctcccccaccgcgcgccctggatcctctgcctgccccctcccccgtgacgtcaccctagtcctgtcccggggagcctgcaaagcctctcagattcaaactgctagacgcactgctgccaccgccaccgaattggaaacgcgcgcccaggctccgtcgtcgccttcgcccgccgaccgggccagccggctctccgacctccctacagaatcgcaccccagtccctccctggcagctcggcttccctcagctccaactcttctcttccgctcctgcctcctgtcggatttttaatttctgcgcacccccagtcaaattaaatcaaccaacaaaaagcagggcatcccccctggaagcagcgtcttattttaccttgttctcccacttcctgaagatgctaaactcctggtggactgcagaggagagggattcagtcttctcctgatgtcgattgcgatttctgctgggagctcaagacgggcgagctgcccgagatctcttcgagataccccaggggaggaggagatgggcaggatttagtaggacaactcggttactaatgacttggcggctggctgcgaccccccgggaaatcaggtttgcctgtaggtacctgagttgacaccgaaggtgcctaaagatgctgagcggcgtttggttcctcagtgtgttaaccgtggccgggatcttacagacagagagtcgcaaaactgccaaagacatttgcaagatccgctgtctgtgcgaagaaaaggaaaacgtactgaatatcaactgtgagaacaaaggatttacaacagttagcctgctccagcccccccagtatcgaatctatcagctttttctcaatggaaacctcttgacaagactgtatccaaacgaatttgtcaattactccaacgcggtgactcttcacctaggtaacaacgggttacaggagatccgaacgggggcattcagtggcctgaaaactctcaaaagactgcatctcaacaacaacaagcttgagatattgagggaggacaccttcctaggcctggagagcctggagtatctccaggccgactacaattacatcagtgccatcgaggctggggcattcagcaaacttaacaagctcaaagtgctcatcctgaatgacaaccttctgctttcactgcccagcaatgtgttccgctttgtcctgctgacccacttagacctcagggggaataggctaaaagtaatgccttttgctggcgtccttgaacatattggagggatcatggagattcagctggaggaaaatccatggaattgcacttgtgacttacttcctctcaaggcctggctagacaccataactgtttttgtgggagagattgtctgtgagactccctttaggttgcatgggaaagacgtgacccagctgaccaggcaagacctctgtcccagaaaaagtgccagtgattccagtcagaggggcagccatgctgacacccacgtccaaaggctgtcacctacaatgaatcctgctctcaacccaaccagggctccgaaagccagccggccgcccaaaatgagaaatcgtccaactcctcgagtgactgtgtcaaaggacaggcaaagttttggacccatcatggtgtaccagaccaagtctcctgtgcctctcacctgtcccagcagctgtgtctgcacctctcagagctcagacaatggtctgaatgtaaactgccaagaaaggaagttcactaatatctctgacctgcagcccaaaccgaccagtccaaagaaactctacctaacagggaactatcttcaaactgtctataagaatgacctcttagaatacagttctttggacttactgcacttaggaaacaacaggattgcagtcattcaggaaggtgcctttacaaacctgaccagtttacgcagactttatctgaatggcaattaccttgaagtgctgtacccttctatgtttgatggactgcagagcttgcaatatctctatttagagtataatgtcattaaggaaattaagcctctgacctttgatgctttgattaacctacagctactgtttctgaacaacaaccttcttcggtccttacctgataatatatttggggggacggccctaaccaggctgaatctgagaaacaaccatttttctcacctgcccgtgaaaggggttctggatcagctcccggctttcatccagatagatctgcaggagaacccctgggactgtacctgtgacatcatggggctgaaagactggacagaacatgccaattcccctgtcatcattaatgaggtgacttgcgaatctcctgctaagcatgcaggggagatactaaaatttctggggagggaggctatctgtccagacagcccaaacttgtcagatggaaccgtcttgtcaatgaatcacaatacagacacacctcggtcgcttagtgtgtctcctagttcctatcctgaactacacactgaagttccactgtctgtcttaattctgggattgcttgttgttttcatcttatctgtctgttttggggctggtttattcgtctttgtcttgaaacgccgaaagggagtgccgagcgttcccaggaataccaacaacttagacgtaagctcctttcaattacagtatgggtcttacaacactgagactcacgataaaacagacggccatgtctacaactatatccccccacctgtgggtcagatgtgccaaaaccccatctacatgcagaaggaaggagacccagtagcctattaccgaaacctgcaagagttcagctatagcaacctggaggagaaaaaagaagagccagccacacctgcttacacaataagtgccactgagctgctagaaaagcaggccacaccaagagagcctgagctgctgtatcaaaatattgctgagcgagtcaaggaacttcccagcgcaggcctagtccactataacttttgtaccttacctaaaaggcagtttgccccttcctatgaatctcgacgccaaaaccaagacagaatcaataaaaccgttttatatggaactcccaggaaatgctttgtggggcagtcaaaacccaaccaccctttactgcaagctaagccgcaatcagaaccggactacctcgaagttctggaaaaacaaactgcaatcagtcagctgtgaagggaaatcatttacaaccctaaggcatcagaggatgctgctccgaactgttggaaacaaggacattagcttttgtgtttgtttttgttctccctttcccagtgttaatgggggactttgaaaatgtttgggagataggatgaagtcatgattttgcttttgcaagttttcctttaaattatttctctctcgctctcctcccctcctttttttttttttttttttctttttcccttctcttcttaggaaccatcagtggacatgaatgtttctacaatgcatttcttcatagattttgtttatggttttgtttcttttttcttctttgtttttcagtgtgggagtgggaagaggagattatagtgactgaagaaagaataggcaaacttttcaaatgaaaatggatatttagtgtattttgtagaagatctccaaagatcttttgtgactacaacttcttttgtaaataatgatatatggtatttccatcgtcagttaccgagtatagccactgggtatcactactttgtgttaaagtgccttcgcactttaagtacattacttaaatgttgcttttagctttgataaattgaaaatattttaatgtgttgtatttttgaaattgaaaacactgtaaaatagattgatgtgtcagctatattaagtcaacgtacagtttgcttgagttatagaaaccagcctgtcatcaaatgattctagttctaggactttgtaggcttaactataaaatatttcctttcctctgggtttaagtgattttatttaagtcaactaaggggatttaacagtggactagaggtaataagccacctcagtcaggattaataattcattaataaaatatatttaacccaaaaaaaaaaaaaaaaaa

SEQ ID NO: 53399 - DNA, 1467 bp, Homo sapiens
cgccagcgggggcgctgagctcagagctgccgcagcgccggagccggagccggagccggagcgcgcgagctcgcagggcgcgaggaacgagcggtggctggctacgcacccgagacccgggcactgctgcgctcctgctcaggacccgcgacccgagcgcctgatcccggccctatcccccctccggcccctggtccaccccggcctggcctagcggagcccccgcgtccgcccgccgcagccgccgctccatccccagccccggccccgcatccaggcgggtcctggatattcgcgccgaacccagcactccggttcgacggggctgcagtttgcagggcccggataaccgaggcagtggcccctcccgcgtccccaggtttcaaggacgctaggactctccgcggccctgaggcttcgcactggggagtggggccgccaggatggacgtgttcatgaagggcctgtccatggccaaggagggcgttgtggcagccgcggagaaaaccaagcagggggtcaccgaggcggcggagaagaccaaggagggcgtcctctacgtcggaagcaagacccgagaaggtgtggtacaaggtgtggcttcagtggctgaaaaaaccaaggaacaggcctcacatctgggaggagctgtgttctctggggcagggaacatcgcagcagccacaggactggtgaagagggaggaattccctactgatctgaagccagaggaagtggcccaggaagctgctgaagaaccactgattgagcccctgatggagccagaaggggagagttatgaggacccaccccaggaggaatatcaggagtatgagccagaggcgtaggggcccaggagagcccccaccagcagcacaattctgtccctgtccctgccccgccccccagagccagggctgtccttagactccttctccccaatcacgagatcttccttccgctctgaggcaaccccctcggagcctgtgttagtgtctgtccatctgtctgtcctacccgcccgcgtccaaccccggggcatggacagggccagggttgcggtcgcggctgggagcctcgcccctccagtgttgcctcctcccatccagcgtctgcgcggatgtagcatgttctatgtgtttttaaacgaagatccgagcgacggctcctccccgatccccgacagtggctctccaagcggcccccgggcagccccagagcaccccgcccgactcccattaacctcgagaacctttttttttttaaccaaaaccaggagccaggctgtgccatgtcccccgccccccatcccagccggcccggtccgaacgcgggcgtcgtgtgttgtgattgtggcatggagagtccccatcccccccatgtgagcgtgtcccgggcgggtgggcccggccgcccccgagagtccatgaataaagctaatctgtctgtaaaaaaaaaaaaaaaaaa

SEQ ID NO: 53400 - DNA, 1310 bp, Homo sapiens
cgccagcgggggcgctgagctcagagctgccgcagcgccggagccggagccggagccggagcgcgcgagctcgcagggcgcgaggaacgagcggtggctggctacgcacccgagacccgggcactgctgcgctcctgctcaggacccgcgacccgagcgcctgatcccggccctatcccccctccggcccctggtccaccccggcctggcctagcggagcccccgcgtccgcccgccgcagccgccgctccatccccagccccggccccgcatccaggccgccaggatggacgtgttcatgaagggcctgtccatggccaaggagggcgttgtggcagccgcggagaaaaccaagcagggggtcaccgaggcggcggagaagaccaaggagggcgtcctctacgtcggaagcaagacccgagaaggtgtggtacaaggtgtggcttcagtggctgaaaaaaccaaggaacaggcctcacatctgggaggagctgtgttctctggggcagggaacatcgcagcagccacaggactggtgaagagggaggaattccctactgatctgaagccagaggaagtggcccaggaagctgctgaagaaccactgattgagcccctgatggagccagaaggggagagttatgaggacccaccccaggaggaatatcaggagtatgagccagaggcgtaggggcccaggagagcccccaccagcagcacaattctgtccctgtccctgccccgccccccagagccagggctgtccttagactccttctccccaatcacgagatcttccttccgctctgaggcaaccccctcggagcctgtgttagtgtctgtccatctgtctgtcctacccgcccgcgtccaaccccggggcatggacagggccagggttgcggtcgcggctgggagcctcgcccctccagtgttgcctcctcccatccagcgtctgcgcggatgtagcatgttctatgtgtttttaaacgaagatccgagcgacggctcctccccgatccccgacagtggctctccaagcggcccccgggcagccccagagcaccccgcccgactcccattaacctcgagaacctttttttttttaaccaaaaccaggagccaggctgtgccatgtcccccgccccccatcccagccggcccggtccgaacgcgggcgtcgtgtgttgtgattgtggcatggagagtccccatcccccccatgtgagcgtgtcccgggcgggtgggcccggccgcccccgagagtccatgaataaagctaatctgtctgtaaaaaaaaaaaaaaaaaa

SEQ ID NO: 53401 - DNA, 4127 bp, Homo sapiens
acactcgctctcgcacactcggtgacacgcccgcgcgcgcgctcacccacacgcccggccgccggcgccctcccagctggtccaccccggcggggcccgcgcccccggcccgcccgcctggcaccgcgccccggggctggggccgagcgaggagcccgcgaggcggcgagagggcgagcgccaggcaggccggcccggggcccccgccccccgcgcccccgcccgatggggaacgctccgtcccaagatccggagcggagcagcccccccatgctgtctgcggacgatgcggagtacccgcgggagtaccggaccctggggggcgggggcggcgggggcagcgggggccggcgcttctccaacgtggggctggtgcacacgtccgagcggcggcacacggtgatcgcggcccagagtctggaggcgctcagcgggctccagaaggcggacgccgaccgcaagcgtgatgccttcatggaccacctgaagagcaagtacccacagcacgccctggccctgcgaggccagcaggacaggatgcgagagcagccaaactactggagtttcaagacccgcagctcacgccacactcagggagcccagcccgggctggcagaccaggcggcaaagctgtcctacgcctccgccgagtcgctggagaccatgtcggaggccgagctgcccctgggcttcagcaggatgaaccgcttccgacagagcctgcctctctcccgctcggccagccagaccaagccgcgctccccaggggtgctgttcctgcagttcggggaggagactcggcgcgtgcacatcacgcacgaggtcagcagcctggacacgctgcacgcactcatcgcgcacatgttcccgcagaagctcaccatgggcatgcttaagtcgcccaataccgccatcctcatcaaagacgaggctcgcaacgtcttctacgagctggaggacgtccgggacatccaggaccgcagtattatcaagatctacagaaaggagcccctctacgctgccttccctggctcacatctcaccaacggggacctccggagagagatggtgtacgcatcgcgggagtcctcgcccacgcggcgcctcaacaacctgtcaccagcgccgcacctggcatccggctcgccgccgcccgggctgccgtcggggctgccgtccgggctgcagtccggttcgccgtcgcgttcgcgcctatcgtacgccggggggcgcccgccttcgtacgccggcagcccggtgcaccacgcggccgagaggctgggaggcgccccggccgcccagggcgtcagccccagccccagcgccatcctggagcggcgcgacgtgaagccggacgaggacctggcgagcaaggcgggcggcatggtgctggtgaaaggcgagggcctctatgctgacccctacgggctgctgcacgagggccgtctgagcctggccgcggccgccggcgacccgttcgcctacccgggcgccggcggcctctacaagcgcggctcggtgcgctcgctcagcacctactcggccgccgcgctgcagtccgatctggaggactccctgtacaaggcggcgggcggcggcggcccgctgtacggcgacggctacggcttccgcctgccgccttcgtcaccgcagaagctggccgacgtggcagcaccccccggaggtcccccgccaccgcacagcccctactcggggccgcccagccgcggctcgccagtgcgccagtccttccgcaaggactcgggctcctcgtccgtctttgccgagagtcctggagggaagacccgcagcgcggggagcgcctcgacggccggagctcccccttcggagctcttccctgggcctggggaacgctcgctggttgggttcgggccgccagtgccagccaaggacacggagaccagggagcgcatggaggccatggagaagcagattgccagcctcacaggcctggtgcagagcgccttactgcgaggctctgagcctgagacccccagcgagaagattgaaggctccaatggagcagccaccccctcagcaccctgtgggtcaggcggccggagcagcggggccaccccggtgtccggcccgcccccgccctcggccagcagcacccccgcaggtcagcctaccgccgttagccggctgcagatgcagcttcacctgcgaggcctgcagaacagcgccagtgacttgcgcggccagctccagcagttgcgcaagctccagctacagaaccaggagtcggtgcgcgcgctgctgaagcgcacggaggcagagctgagcatgcgcgtgtcggaggcggcgcggcggcaggaggacccgctgcagcggcagcgcaccctggtggaagaggaacggctgcgctatctcaacgacgaggagcttattacccagcagctcaatgacctggagaaatcggtggagaagatccagagagacgtgtcccacaaccaccggctggtgcccggccctgagctggaggagaaggcactggtgctgaagcagctcggggagacgctgacagagctcaaggctcacttcccgggcctgcagagcaagatgcgggtggtgctgcgcgtggaggtggaggcggtgaagttcctgaaggaggagccccagcgcctggatgggctcctcaagcgctgccgcggggtcacggacacgctggcccagatccgaaggcaagtggatgagggtgtgtggccaccccccaacaatctcctgagtcagtcccccaagaaggtgacggcagagactgacttcaacaagagcgtggacttcgaaatgccaccccccagccccccgctgaacctgcatgagctgagcgggccagctgaaggagcctctcttacccccaaggggggcaaccccaccaaaggcctggacactcctggcaagagaagcgtggacaaagctgtgtctgttgaggctgcagagcgagactgggaggagaagcgggcagccctgacccagtacagtgccaaggacatcaaccggctgctggaagagacacaggcagagctgctcaaggccatccctgacctggactgtgccagcaaggcccatccaggcccggcccccactccagatcacaagccccccaaggccccccacggccagaaggcagccccccgaacggagcccagtgggaggaggggctcagatgagttgaccgtgccccgataccgcacagagaagccctccaagtcgcccccaccgccccctccccgccggagcttcccctcctcccatggcctgaccaccacacgtaccggagaggtggtggtcaccagcaagaaggactcggccttcatcaagaaggctgagtccgaggagctggaggtgcagaagccccaggtgaagctgcgccgggctgtgtctgaggtggcccgcccagcctccacaccacccatcatggcctcggccatcaaggacgaggatgacgaggatcgcatcatcgcagagctagagagtggcggaggcagtgtaccacccatgaaggtggtgactccgggggcctctcggctgaaggcggcccagggccaggcgggcagccccgacaaaagcaaacatggcaagcagagggccgagtacatgcggatccaggcccagcagcaggccactaaaccatctaaagagatgagcgggtcgaatgagacctcgagcccagtctcagaaaagccctcggcttccagaacctctatccctgtattgacttcctttggggcaaggaattcttccatctccttctagaagcccctcaccccgctgccccgcctgtccccctccctcactcctgccatttctcccctctcttccttcatctccaccccaccccaccctactccccagaccctggggcctggctggggaaggtccgcacctggggagagctgggagctgttgaaggtttggggggaggggaaacgggttgtgtttcttcatttctttttttgtttttgcctttgttggttcatccttgttttctagctttggatcatttttgtaccaaggcgagcaagcctttttgaaaaataacaaaagaggaaaaaaaaaatccctcctggaaaaaaaaaaaaaccctggaaaaaaaaaaaaaaaaa

SEQ ID NO: 53402 - DNA, 5026 bp, Homo sapiens
cagctagccgcctcctgcaggggctcgggagagcaattcggcggcccctgcagggcagctgaagccatggaagcctccgcaggtcgctgatcagggccaggcggctgcagcagcgactgcagaggcgctgcgccaagccgggccggagtggtgcgagccggcggggctgcggagggccagtggactcagcccccgggataccgcccatcccaccccttactcggacccacagcctcatggccatgtccctgccaggaagtagacggacctctgctggatcacgcaggcgcacctctccacctgtgagcgtgcgggatgcctacggcacctcttcgctcagcagcagcagcaattctggctcctacaagggcagtgacagcagtcccacgccaaggcgctccatgaaatacacgctgtgcagtgacaaccatggcatcaagcccccgaccccggagcagtacctgacccccctgcagcagaaggaggtgtgcatccggcacctgaaagcccggctgaaggacacacaggaccggctccaggaccgggacacagagattgatgacctgaagacgcagctgtcacgcatgcaggaggactggattgaggaggagtgccaccgcgtggaggcccagctggccctgaaggaggcccgaaaggagatcaagcagctcaagcaggtcatcgacactgtcaagaacaacctgattgacaaggacaaggggctgcagaagtacttcgtggacatcaacatccagaacaagaagctggagacgctgctgcacagcatggaggtggcccagaatggcatggccaaggaggatggcactggggagtcagccggtgggtcccctgcccgctccctcacccgcagctccacctacaccaagctgagtgacccggctgtctgtggtgaccgccagccgggtgatccctccagcggctctgctgaggatggggcagacagtggctttgcagcagccgatgacacactgagccggacggacgcgctggaagccagcagcctgctgtcgtcgggggtggactgtggcaccgaggagacctcgctgcacagctccttcggcctgggcccccgcttccctgccagcaacacctatgagaagctgctgtgtggcatggaggctggtgtgcaggccagctgcatgcaggagcgtgccatccagacagacttcgtgcagtaccagcctgaccttgacaccatcctggagaaagtgacccaggcccaggtctgtgggacagaccctgagtcaggggacaggtgcccagagctggatgcccacccttcagggcccagagaccccaactcagcagtggtggtgacagtgggtgatgagctagaggccccagagcccatcacccgtggacccaccccacagcggcctggtgccaaccccaaccctggccagtcggtgagcgtggtgtgccccatggaagaggaggaggaggctgccgtggctgagaaggagcccaagagctactggagccgccactacatcgtggatctgctggctgtggtggtgccggccgtgcccacggtggcctggctttgccgctcccagcggcgccagggccagcccatctacaacatcagctccctgctgcggggctgctgcactgtggccttgcactccatccgcaggatcagctgccgctcgctgagccagccgagtcccagcccagcgggcggcggctcccagctctgagggggcccattccggcagcggcgcctgcggcctgaccactgattgtagggatgccgttcccccctcccttctcccatgggcatcatcttatttatttagttttgggtgtggaactgtttctttttttcaagatgttaaaacagtcccgtggaaggagcaggggttggagaaaggcatcccaaagcttcgatggagagcagggaagggggacccaaggcaggaggtacaccagctggacaaattgcagggaggggagggagcgagggccaacccggcccctctgtccccttggctcttcagacagggccagccctgctcaggaagtctctggctgtcttcatgtggggaagccgggcttgagttgcccataggcccctgccctgcaccatcctgtccagtgccctgcgcactccatgccgtctcttccaagccaccttgcccgcagcccaggctcctgggccagtgctctctcctcaaatggaggcagccatggcctgaagtgcagatcactgacccagggctcagagcagaggccagaaccactgggccggccggcattccagcctccccagactgctgcccaccttgggactcaggagctcagtcaaggccacaggctggaggagagacggggctgggcgcaaggtggcggagggcagtgtgggttctgtgtctgtctgttcatcccaggctttcccgtcatccctttcctcttggcacttctgggtgtgtcagtcattattcctgtgaggtagctaagcccggcaagctcagtgctggggtaggagggcctgcctgagtcccagctcccagctggagaatccaccagcacaagaagaggaggcaggggcagaaacccaagggggctcccccagccttccaaggtgaggccatctcatctgcaggctgggaggcagggctggactcaggaacccacagcttactgaaaaagccagaggccatgactgcccccagaaacttgccccgagtttctctggggccctcgggcccaacttctgctttgcactatgttcactttggggttggttctcagccatccaagggtctccagtgaggtggctgcttgctgtctgagatgagggttcctaaaccttaaacctctctgcctctggaggagggtggggtattctggcaggatgaatcgcaggatggcgcgtactgaagccacgatgttcatccaggccaaagcagggtgtcctgggataggtttcctaggcaggggcgtggcagagcaggtaggcgccctgcagcctccctgctcccagcccaaggccagtcggcctgggaagttcactgccccaactcttttcccgggaccatactgagtcccccagccacgctgctgacattaccattattattttaccaagtaaactcactccttttcccccacaggggttacacccatctggttgtcccacccactcttcagaggctaggccccacctctgggggttggagggaccctgtgtcttactcgcccctctggcctaagggccactctggttatctgccaaggttgcttgccctcaccccaatgctccaacagccattgcctaactcatgggctctgcccttctgctcggtgccctccacgtgaggcggggcacctgcatgcactgggagggggcggctggcccagccctcggggcaggagccccctctgccacacgctttgtgcctccaaagctccccccgccttggtcagggcctcagaccagccaacctttgtggaataagccccagcccagccaaaccaaacccagatgcctgaggcctggctggggctgcccccgcaggacactgtggccatgccacggagggggcagtggacaaaaccaatccaaagccaagccgggactggctgcggacccagcctcctgtgccgcgcactcacggagctgcgtagtctcctcagacatagtcaaagctttgccgagaaaagaaatgtatgaactatatttgacaacataaaatctctctatttttcaccactggaatttagtcaagcttcaggcccctctgctcctgtctgtgtcttgcgtctgtggccttcctattgtgtcttgtgttttggtggatgtgacagggctggggccacagtctactctgtctctgctgctagagaagccacctgtggaggactgggctgtggttgggcctgaggcctgtggaggaggtgagtgtagccagcagcggccgtctactcctgttctggcctgagaccaccggtgtgggtcacgagggccctggcccacagtgttgagggtcctctctttcgggggctctcctggggccttcgatgggcttttcttcttgtcagtggagggagcagctccccactcagccctgggacaggccctgggactgtggtggccggtggccctggcccagctctggagtgcatgtgtgtgtgctcagatcccgcatctatgcaaaggtgcaggctgcctgtgaggctccaggcggtggaggtgcggcagctgctgctcaggtgccatgccctgaagaggcagggtacacatggggctgggagggcaaagatggggcggggcctccccctgagagagctcaccctccacagtgacccttttccttcctgcctaatacctcctcccgttgggctgtgacttttcctcctgccctcagcctctgaaacagaaatctttggggcctcccctttccccagcgtctggcaagagctgatgaggtcctgaggaacagtgtccccaggaaccaccttctggagcctagcggccagacgtggcttctcctgagttctagggctcgggccagagtggcactactgcccggccagtccaggctcaggcaggaatcggacgctggggcccgggctctgcacagagagctgggcttgagtggagtttattgtagatttctcccaaggggatcacttagcttctcactgacacacccttcccaattgccacaagcgcaggggtatcttacagcactttggggaggggtgggacaaactgcaaggttctggggccaaggcctacccaggggcctctgcccagagaactcacaaccccctctctgacctaggggacaatgcaaacaggtcacagtgcattcccatattaggccatccccttcacgaagaattcaggggatgtgggaagtggggaggcggggagggatcttgactcttgtctcctttgtccttttgttcagacagagttgtacctgcagcagacaactctgaattaaagcatgaaaacacagcaaaaaaaaaaaaaaaaaaaaaaaaaaaaaaaaaa

SEQ ID NO: 53403 - DNA, 2518 bp, Homo sapiens
ctattaacttgttcaaaaaagtatcaggagttgtcaaggcagagaagagagtgtttgcaaaagggggaaagtagtttgctgcctctttaagactaggactgagagaaagaagaggagagagaaagaaagggagagaagtttgagccccaggcttaagcctttccaaaaaataataataacaatcatcggcggcggcaggatcggccagaggaggagggaagcgctttttttgatcctgattccagtttgcctctctctttttttcccccaaattattcttcgcctgattttcctcgcggagccctgcgctcccgacacccccgcccgcctcccctcctcctctccccccgcccgcgggccccccaaagtcccggccgggccgagggtcggcggccgccggcgggccgggcccgcgcacagcgcccgcatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccaggccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctcaaaaagaaaaaggaaaaaaaaaaatcccatcacccacagcaaatgacagctgcaaaagagaacaccaatcccatccacactcacgcaaaaaccgcgatgccgacaagaaaacttttatgagagagatcctggacttctttttgggggactatttttgtacagagaaaacctggggagggtggggagggcgggggaatggaccttgtatagatctggaggaaagaaagctacgaaaaactttttaaaagttctagtggtacggtaggagctttgcaggaagtttgcaaaagtctttaccaataatatttagagctagtctccaagcgacgaaaaaaatgttttaatatttgcaagcaacttttgtacagtatttatcgagataaacatggcaatcaaaatgtccattgtttataagctgagaatttgccaatatttttcaaggagaggcttcttgctgaattttgattctgcagctgaaatttaggacagttgcaaacgtgaaaagaagaaaattattcaaatttggacattttaattgtttaaaaattgtacaaaaggaaaaaattagaataagtactggcgaaccatctctgtggtcttgtttaaaaagggcaaaagttttagactgtactaaattttataacttactgttaaaagcaaaaatggccatgcaggttgacaccgttggtaatttataatagcttttgttcgatcccaactttccattttgttcagataaaaaaaaccatgaaattactgtgtttgaaatattttcttatggtttgtaatatttctgtaaatttattgtgatattttaaggttttcccccctttattttccgtagttgtattttaaaagattcggctctgtattatttgaatcagtctgccgagaatccatgtatatatttgaactaatatcatccttataacaggtacattttcaacttaagtttttactccattatgcacagtttgagataaataaatttttgaaatatggacactgaaaaaaaaaaaaaaaaaa

SEQ ID NO: 53404 - DNA, 3219 bp, Homo sapiens
ggctgagggtccgcgccgccgcccgcccgctccttcccgctcggccgcggcctcagggacggatactccagcgcgcggttccaaccgaggcccgtggtttagccccacgaagatgaactgggcacccgcaacgtgctgggctctgctactggcggccgccttcctctgcgacagcggcgcagccaagggcggccgcggaggtgcgcggggcagtgcccggggaggggtccgcgggggcgcgcgcggggcctcgagggtgcgcgtgaggccggcgcagcgctacggtgccccgggttcctccctgcgcgtggctgccgccggggcggcagccggggcggcggcgggagcggccgcgggcctggcggcgggctcgggctggagaagggccgcgggacccggggaacgcggcctggaggacgaggaggacggggtgcccggaggcaacgggacaggccccggcatctacagctaccgggcgtggacttcgggcgctggacccacgcgcggcccgcgtctctgtctcgtgctgggcggcgccctcggagccctggggctgctgcggccctaggcctggctgggctcggggaccacatctggcccccggcccgcgccatcccccaggatcctccggcctgggctcccccttcctcccttgcccacggtcttggagccccactgggtgcaggagctgctggctgtccctgtggacccgccatccaccgtcctgcccacgccgcctcagcctgccacctcccacctagaggagaccatgggccctgccccacccactccaggatgttagggtcccctcagccaaaaaggcagctgcctgtggctcctgtaccaaccgcccagccacgctccatcgccgcccaaagggaggtgccaaggccaggaacccaagccaccccggctcccctcgcctgcccaggggccgtggtgactcacgggcagggaggcgacatcaggctggttctgccactgagcccctgaggaatctgaccctccccaaaagaagcagtgaaatggaccaaaggacttaagaatttggggggaagtgagggaaaaacgttaggtgctaaccacctgcccagaagagtggatctcacagcccaggaacattcccaagcaggaaaaccgtccgtccgaggaacgtccatcctggctctctgcggctggtgggaaaacacaccctgccctgaggggctgtccaggccttctcccccacaccctcaggccgagatccgtgagagacccactttgctccaacaacttgaaacaagtcactttaccctccttaggacccattttgggggggaaaaaccaacacattccagagctttccaagtcctttgaacttcaggttcacattcagggatcacacagttctgcctgttctcagggcacagcaactgccaatcccgctgaagaggcctccctgggcacagcacaggctgcacggtgcacgcatttccctgaaggcagccccttcttcggaagcagctgttccaggcctcggaacagggcctgggtatccgcgtggtgggctggcagctgacggcctgctcagtggagccaggagctaactcagaccccaaagcaagcagggggccagtggcggggcccagcgcccagcaggacacccatgcaagaggctgagccccccaacatccaaggacaggagagacatggagtggcgctggacagtcacgacaaggacttgcctccagcactggacacacctgtgttaagaccagccctctgcttcccagtcccgccagcctggggcatcctccatgggctcagcactgagaggtcttgggtctgccacgttctctagctctccagtcacccactcatccagggtaggaggggttctccctgcccccccccgtggccttgggatctcaccctctccatgtcctggggacagcctcgccctcagccggactgcatccctcctgggcctgagcctcgggactcagtggacaccaaagtcaagaccagcacccaccacgggccctgccagcctctgccttccccagctggcctgggttctggcctgggtgaggatctggaagctgttggcaggactcaaccaagcactgctctctagctccagggcactaagccacaggaggcagcgccctgcagcctcccgtccacactgccagcaatgcccctggcccagtgagcccagacgctcctccaccccttccagaccaagctcaacgcctccaagaccagcaggccaaggccaagccctgccccagatcctcataggcagagaagcccttctgacatttcccccaggaggcagggggtggtctgagtctcctcacagcagagagacccaccggagccccctcaactttgcagatgcccacctggaaaatgggctgagctgcaccagaccctcacacaccacagcactgcaagctgatggaatgttccagttatgatggacacttcgtgatctgcaatgactgttgattcagcacattagcatctgacacagccaacctgaatacttcctgccccaggcggtcagggttatggcacgatgcaggtggcactcaggggctaacttcaggctgatgagtgtgtggggtatggggcagcagaggcagccagccagcaaagaggggccactgagcaccagggccctggtggaggctgctgtgggacggtcaggccaccaccgcaaagaggcagccggagcttctgcacaggatgtccctggccccaggtcctgcagcaccttagtccatactaccagccccacccaccttccttcctcttccctcttctaggacacaggctgtggaccccttcaggtgcactataatggggctggaggggcccccacatctctcagccccactaatgcagaatcccactacccgtgagctagaaggtgctcagaggccaggggtctctactgcccatgccgggcggccttccagtcattgcacagcaaagccatgtgcagggcgtccccctcaaccctgccctgaacatgccccagggcactgaggggcgaagccagtgcttgggctctgctgctgggagtctctggtctgtgtctgtgtgtgcctgtaagtgtgaaataaacctctctgatggcagcaagcctctcacttgttgtaggactgcaagacactggaccgaaagcctccaacacaaaccctagctgccaacctgctcatttcttaggtt

SEQ ID NO: 53405 - DNA, 1352 bp, Homo sapiens
gaggaagagagcagctcgcttctaactggactgcacgttggtgacagcgtcccaagctggtgacagacccactctgtaactttcagctagattcagccaccagatcccagaaacatgacccttgctgcctacaaagagaagatgaaggagctcccgctggtgtccttgttctgctcctgcttcctggccgatcccctgaataagtcgtcctacaaatatgaaggctggtgtgggagacagtgtaggaggaaggatgaaagccagcggaaagacagtgctgactggagagaaagaagagctcaggcagacacggtggacctgaattggtgcgtcatttccgacatggaagtcatcgagctgaacaaatgcacctcgggccaatcctttgaagtcatcctgaagccaccctcctttgatggggttcccgagttcaacgcctccctgccaaggcggcgagacccatccctggaagagatccagaagaaactagaagcggctgaggagcgaaggaagtaccaggaagcggagctcctgaaacacctagcagagaaacgggaacatgagagagaggtgatccaaaaggccattgaggaaaacaacaacttcatcaagatggctaaggaaaaactggcccagaagatggaatccaacaaggagaacagggaggcccacctcgccgccatgttggaacggctgcaagagaaggacaagcacgccgaggaggtgcggaaaaacaaggagctgaaggaagaggcctccaggtaaagcctagaggccaaagaactttccaggtcagccggacagctccagcagctccacgttccaggcagcctcgcccgccggctgcgctcccagcactggggtttggggggaggggggtggccaaggggcgtttcctctgcttttggtgtttgtacatgttaagaattgaccagtgaagccatcctatttgtttccggggaacaatgacggggtgggagaggggagaggagagagtttgggaaagggagatggagaagaactcaaggacattgcaaccctgcccggcgcagatctgattttcacatctctacctggacattgagcctccaggcaccatgttgaggagagatgaaaaccagggcggtagaacttcagggtgaaggacagagtcctgggtggggcagcggctgcagggcgcaccagagaacccagccagaggggttgtgagtaccagtggtgttgcttccaccctgcagcaggtgggatgaggtctgtgtgtgtgtgtgaaccatcattttttgatcatcatgaccaatgaaacattgactccaaaaaaaaaaaaaaaaaaaaaaaaaaaaaaaaaaaaaaaa

SEQ ID NO: 53406 - DNA, 3947 bp, Homo sapiens
gggcagatggaggagggattgtaatggcggcagccggcagctccctgctctgacccacggcaggcacacagcaacgaccccttccccgcccctctcccggccggcctccgccccgcagccagcgcggggccaccctctccggcccttcccccagctgtcggcgtctcgccctgcgccccggccggggccccacacacaatggacgagcttgccggaggcggtggtggcggcccggggatggcggcccctccccggcagcagcagggacctggggggaacctgggcctttcgcccggggggaacggagcggcgggcggcgggggtcctccggcctccgagggagcgggtcccgcggcaggccccgagctgtcccggccgcagcagaacactatcccggggatactgcactacatccagcacgagtgggctcggttcgagatggagcgggcgcactgggaggtggaacgggccgaactgcaggcccggattgcatttctacaaggcgaaagaaaaggtcaagagaacctgaagaaggacttagtaagaagaataaagatgttagagtatgcattaaaacaagaaagggcaaaatatcacaaattaaaatatggcacggaactgaaccaaggtgacttgaaaatgccaacctttgagtcagaagaaaccaaagacacagaggctcccacagcacctcagaatagccagttaacgtggaagcaaggcagacagcttttaagacagtatcttcaggaagtaggttatacagatacaatattagatgtacggtctcagcgggtaaggtcattacttggactatctaattcagaaccaaatggatcagtagaaacaaagaatttagaacagatcctgaatggaggtgaatctcctaagcaaaagggacaagaaataaaaaggtcctctggtgatgttcttgagacgttcaatttcttagaaaatgccgatgacagtgatgaagatgaggaaaatgacatgatcgaaggcatcccagaaggaaaagacaaacatcggatgaataaacataaaataggtaatgaaggtttagctgctgacctaactgacgatcctgatactgaggaagcactgaaagaatttgattttttagtgactgctgaagatggtgaaggagctggagaagcacggagttcgggggatggcacagaatgggctgaaccaataacgtttccatctggaggaggcaagtcatttattatgggttctgatgatgttttgttaagtgtactgggccttggagaccttgcagacttgacggtaacaaatgatgcagactatagttatgatttgcctgctaataaagatgcctttcgaaagacatggaatcccaagtatacactacgtagccattttgatggagtacgggcattagcttttcatcctgtagaacctgtgctggttactgcttctgaggaccataccctgaaactttggaacctgcaaaaaacagttcctgccaaaaagagtgcctctttagatgtagagcctatctacacatttagggcccacatcggccctgttctgtcattagctattagttctaatggagaacagtgttttagtggtggtattgatgcaaccatccagtggtggaatatgccgagtcccagtgtagatccatatgatacatatgagccaaatgttctagctggcactttagttggtcatacagatgcagtttggggtcttgcttatagtggcataaaaaatcaattactgtcttgttcagcagatggcactgttaggttatggaatccacaagaaaaattgccatgtatttgcacttacaatggagataaaaagcatggaatacctacatcagttgactttataggctgtgatccagctcatatggtaacctctttcaacactggtagtgcagtaatttatgatttagaaacatcacagtcattggtgatactttcatcacaggtagattctggtttacaatctaataatcatatcaacagagtagtaagtcatcccacacttcctgttacaataactgctcatgaagatagacacatcaaattttttgacaataaaacgggtaaaatgatccattctatggtagctcacttggatgctgttacaagtctagcagtagatcctaatggaatctatttgatgtctggaagccatgactgttccatcagattatggaatttagacagcaagacatgtgtgcaagaaataacagctcacagaaagaaattggatgaatcaatttatgatgttgctttccactcgtcaaaagcatatatagctagtgcaggagctgatgctcttgccaaagtatttgtatgaatcaacaaaaacttgcatcgtaacaagatttgcttggacagaaagagggtctgcatcactgccatcagaaaggttactgatatgacactacatgtgatctgcctggtgaaggctatctggggcaggcacaaattggtggaaatcacatcttaatgtcaagctcattaagttaactgtaattactgtattttgtgggacaaagaaaaaaggactccagtatttgtggcctgtactggatgtgaactgagcgtatatctgtttttaggtgtctttaagccaatgtggagtctgatctttcaaaaaagtttttttttttctcttcttcttcttcttttttttttttttttttttttttttggactctgtgtgctgccttaggggttaggaatgtggtgctcttgttgggggaagtgagctccaagagtagctttttttcatctcttagtgatcttctgtttatcggttgaatgccacagattcccttttaaacttattttgctttaaaaaaaaaaaaaaagaaaaagaaaatttaacttaaaatattttagcattagttgcacaaaatgtttggataaaattctagtttttataagtctttttatatatttagcctgtcacaacagtgctcaagattgtattgaagtttttctgcattatacaaccctaaaacacagagatctcactgacccgttgccctgtaaccactttctttccttcttttgcctaatacagctcagctaagtccttccataaagatgctaaataactttcatcatcacataaatgtcttcataaaccaaggactattaagtgtattaaaatgaaacagtggggtttagtactccaaatgaactcttaaagaaaaaaactaatcttggcatcctatcactatgtgatattttgtacatcttactgtatttacaagtttatttatcaaggattatccatcttgctaatggcctattatttatttcactttttgttggtctttatatccttttattaatgtgctaaaggaacctgtatatctattttggaactctttgaatagtctaaaatagactaaaaatggagtattttatagtttaaattacaaaccaaggtggttccccctaagatatatatcttggtttaccatgattccaaacaaaactaacttgtttaaaaatatttggagtaaagttttatttgcattacaaataggatacaaaaatagttgaatcaggatacagaaatctgctgtgttttgactagttatccctgttttatttttttagatgtgcttaattttatggtgtaactaaagattttgtttgtgtaatgcatgattaagacaataaagtattttttctagtcttccgagaaacttttctgatcagtttgcgagttttgatgagttttgtaaggtttttgttttacaaactatgaatcagcaaatttttaagattgtaccacatagcaaacatacagctgttgaaaaataatgtatataaaatgcatataataaatattaaattgtgtacctgtatgttactgttggctacatcattttgtgttgaataataaagtgcaatactttattctccataattaaactaggaaatgga

SEQ ID NO: 53407 - DNA, 2514 bp, Homo sapiens
cgcgagcgtgtgcggggtgcgggcgcgggcgcgggcgcgggcgcgggcgcgtgcgggctgcgagccgggaggcggcggcggcgacggcgacggcggcggcatggcggagagcgaggccgagacccccagcaccccgggggagttcgagagcaagtacttcgagttccatggcgtgcggctgccgcccttctgccgcgggaagatggaggagatcgccaacttcccggtgcggcccagcgacgtgtggatcgtcacctaccccaagtccggcaccagcttgctgcaggaggtggtctacttggtgagccagggcgctgaccccgatgagatcggcttgatgaacatcgacgagcagctcccggtcctggagtacccacagccgggcctggacatcatcaaggaactgacctctccccgcctcatcaagagccacctgccctaccgctttctgccctctgacctccacaatggagactccaaggtcatctatatggctcgcaaccccaaggatctggtggtgtcttattatcagttccaccgctctctgcggaccatgagctaccgaggcacctttcaagaattctgccggaggtttatgaatgataagctgggctacggctcctggtttgagcacgtgcaggagttctgggagcaccgcatggactcgaacgtgctttttctcaagtatgaagacatgcatcgggacctggtgacgatggtggagcagctggccagattcctgggggtgtcctgtgacaaggcccagctggaagccctgacggagcactgccaccagctggtggaccagtgctgcaacgctgaggccctgcccgtgggccggggaagagttgggctgtggaaggacatcttcaccgtctccatgaatgagaagtttgacttggtgtataaacagaagatgggaaagtgtgacctcacgtttgacttttatttataataacagaaacaacaacctgcatgctcacaatacccagacagtctactagccaaaagtcctgtatgcattcatttattccttgctggacaaactctggaagcagcgtgtgaaacagcgggggaagggaagagcggcgtgagcggagggagtgtgatgattcccaaccgaaagcagctgtctcgcctttagaacgtgcagcctctccatgtctgattacaaacagtctccacattgcagttccaatggcctggaccgtaaggataaagcctgtaatatatgcaactagaatgtctgccttttcaaccccgtattatttattgtattttatagagcttttcactggaaatctacataaatgtcagtaaaccaaataaaagttcatttccaaggggaatcaggagcgagccacacccgaatggtagaaagatctcagggttaactctttatttttgtagttttattatctaaggcacagccattctgttctcacttggttctgagatagtggtgagaacagaggatgagttgggtctgttggggggaatctggacacttgtttattctgacggagttcacttcttcagaaccttcctgaaatgagcagaaattgttcactaggtcttcagaatggacgtccttctgccagagacttccagcgggcggctccaaaggcccaatgcagaggagcccgcggagcatgtgctgagggaagtctgcctggtgaggctggcaggtgggagtctaatgcagtcaggagcatttgcatgcagtgggtggagagtcggccaccaaaggaccgagttgcgctcggaatttgagctgaattccacagccttactttgtttcctgaagtgatagcctactaatgctggcaagcagatgcttaatagtaaatttctaaaatccccgggtctttatcattcagtttgttctgtgcacctgaggcgctcagccgtgggaggaccattttgcgagtgtagccctgtttcactcggatcaggttggcacggccgcctgcgtgtctgtccacctcatccctccgtgtatctgagggagtaaaggtgaggtctttattgcttcactgcctaattttctcacccacattcgctgaagcgatggagagtcgggggccagtagccagccaaccccgtggggaccggggttgtctgtcatttatgtggctggaaagcacccaaagtggtggtcaggagggtcgctgctgtggaaggggtctccgttcttggtgctgtatttgaaacgggtgtagagagaagcttgtgtttttgtttgtaatggggagaagcgtggccaggcaggtggcacgtggcatcgcatggtgggctcggcagcaccttgcctgtgtttctgtgagggaggctgctttctgtgaaatttcatttatatttttctatttttagtactgtatggatgttactgagcactacacatgatccttctgtgcttgcttgcatctttaataaagacatgttcccggcaaaaaaaaaaaaaaaaaaaaaaaaaaaaaaaaaaaaaaaaaaaaaaaaaaaaaaaaaaaaaaa

SEQ ID NO: 53408 - DNA, 2643 bp, Homo sapiens
cgcgagcgtgtgcggggtgcgggcgcgggcgcgggcgcgggcgcgggcgcgtgcgggctgcgagccgggaggcggcggcggcgacggcgacggcggcggcatggcggagagcgaggccgagacccccagcaccccgggggagttcgagagcaagtacttcgagttccatggcgtgcggctgccgcccttctgccgcgggaagatggaggagatcgccaacttcccggtgcggcccagcgacgtgtggatcgtcacctaccccaagtccggcaccagcttgctgcaggaggtggtctacttggtgagccagggcgctgaccccgatgagatcggcttgatgaacatcgacgagcagctcccggtcctggagtacccacagccgggcctggacatcatcaaggaactgacctctccccgcctcatcaagagccacctgccctaccgctttctgccctctgacctccacaatggagactccaaggtcatctatatggctcgcaaccccaaggatctggtggtgtcttattatcagttccaccgctctctgcggaccatgagctaccgaggcacctttcaagaattctgccggaggtttatgaatgataagctgggctacggctcctggtttgagcacgtgcaggagttctgggagcaccgcatggactcgaacgtgctttttctcaagtatgaagacatgcatcgggacctggtgacgatggtggagcagctggccagattcctgggggtgtcctgtgacaaggcccagctggaagccctgacggagcactgccaccagctggtggaccagtgctgcaacgctgaggccctgcccgtgggccgggcacattgcgtctttgctcggaagatcttcttgagttggtgagaatgcagggccgagtagccagctgcattgcttagatttgattcatgtcacagcataaattgtcttgattccaaatcctaaaccaggaagagttgggctgtggaaggacatcttcaccgtctccatgaatgagaagtttgacttggtgtataaacagaagatgggaaagtgtgacctcacgtttgacttttatttataataacagaaacaacaacctgcatgctcacaatacccagacagtctactagccaaaagtcctgtatgcattcatttattccttgctggacaaactctggaagcagcgtgtgaaacagcgggggaagggaagagcggcgtgagcggagggagtgtgatgattcccaaccgaaagcagctgtctcgcctttagaacgtgcagcctctccatgtctgattacaaacagtctccacattgcagttccaatggcctggaccgtaaggataaagcctgtaatatatgcaactagaatgtctgccttttcaaccccgtattatttattgtattttatagagcttttcactggaaatctacataaatgtcagtaaaccaaataaaagttcatttccaaggggaatcaggagcgagccacacccgaatggtagaaagatctcagggttaactctttatttttgtagttttattatctaaggcacagccattctgttctcacttggttctgagatagtggtgagaacagaggatgagttgggtctgttggggggaatctggacacttgtttattctgacggagttcacttcttcagaaccttcctgaaatgagcagaaattgttcactaggtcttcagaatggacgtccttctgccagagacttccagcgggcggctccaaaggcccaatgcagaggagcccgcggagcatgtgctgagggaagtctgcctggtgaggctggcaggtgggagtctaatgcagtcaggagcatttgcatgcagtgggtggagagtcggccaccaaaggaccgagttgcgctcggaatttgagctgaattccacagccttactttgtttcctgaagtgatagcctactaatgctggcaagcagatgcttaatagtaaatttctaaaatccccgggtctttatcattcagtttgttctgtgcacctgaggcgctcagccgtgggaggaccattttgcgagtgtagccctgtttcactcggatcaggttggcacggccgcctgcgtgtctgtccacctcatccctccgtgtatctgagggagtaaaggtgaggtctttattgcttcactgcctaattttctcacccacattcgctgaagcgatggagagtcgggggccagtagccagccaaccccgtggggaccggggttgtctgtcatttatgtggctggaaagcacccaaagtggtggtcaggagggtcgctgctgtggaaggggtctccgttcttggtgctgtatttgaaacgggtgtagagagaagcttgtgtttttgtttgtaatggggagaagcgtggccaggcaggtggcacgtggcatcgcatggtgggctcggcagcaccttgcctgtgtttctgtgagggaggctgctttctgtgaaatttcatttatatttttctatttttagtactgtatggatgttactgagcactacacatgatccttctgtgcttgcttgcatctttaataaagacatgttcccggcaaaaaaaaaaaaaaaaaaaaaaaaaaaaaaaaaaaaaaaaaaaaaaaaaaaaaaaaaaaaaaaaa

SEQ ID NO: 53409 - DNA, 2966 bp, Homo sapiens
cgcgcacagatgcgggttagactggcggggggaggaggcggaggagggaaggaagctgcatgcatgagacccacagactcttgcaagctggatgccctctgtggatgaaagatgtatcatggaatgaacccgagcaatggagatggatttctagagcagcagcagcagcagcagcaacctcagtccccccagagactcttggccgtgatcctgtggtttcagctggcgctgtgcttcggccctgcacagctcacgggcgggttcgatgaccttcaagtgtgtgctgaccccggcattcccgagaatggcttcaggacccccagcggaggggttttctttgaaggctctgtagcccgatttcactgccaagacggattcaagctgaagggcgctacaaagagactgtgtttgaagcattttaatggaaccctaggctggatcccaagtgataattccatctgtgtgcaagaagattgccgtatccctcaaatcgaagatgctgagattcataacaagacatatagacatggagagaagctaatcatcacttgtcatgaaggattcaagatccggtaccccgacctacacaatatggtttcattatgtcgcgatgatggaacgtggaataatctgcccatctgtcaaggctgcctgagacctctagcctcttctaatggctatgtaaacatctctgagctccagacctccttcccggtggggactgtgatctcctatcgctgctttcccggatttaaacttgatgggtctgcgtatcttgagtgcttacaaaaccttatctggtcgtccagcccaccccggtgccttgctctggaagcccaagtctgtccactacctccaatggtgagtcacggagatttcgtctgccacccgcggccttgtgagcgctacaaccacggaactgtggtggagttttactgcgatcctggctacagcctcaccagcgactacaagtacatcacctgccagtatggagagtggtttccttcttatcaagtctactgcatcaaatcagagcaaacgtggcccagcacccatgagaccctcctgaccacgtggaagattgtggcgttcacggcaaccagtgtgctgctggtgctgctgctcgtcatcctggccaggatgttccagaccaagttcaaggcccactttccccccagggggcctccccggagttccagcagtgaccctgactttgtggtggtagacggcgtgcccgtcatgctcccgtcctatgacgaagctgtgagtggcggcttgagtgccttaggccccgggtacatggcctctgtgggccagggctgccccttacccgtggacgaccagagccccccagcataccccggctcaggggacacggacacaggcccaggggagtcagaaacctgtgacagcgtctcaggctcttctgagctgctccaaagtctgtattcacctcccaggtgccaagagagcacccaccctgcttcggacaaccctgacataattgccagcacggcagaggaggtggcatccaccagcccaggcatcgacattgcagatgagattcctctaatggaagaagatccctaatatgggtcaagatccagatgactctcctgctccttcggggaaaggaccttgtatcttggagtgaggtcacagaaggatagagcctgggggcaaaatgtctaacttgtctacatggggaccacagttcacattatgcatctcaggctccacagtgaggctgacaaactgcaatggcagtgcttttaaatgagatttgaggattcaccaagacccatggggaaccggggcagcagggaagccctcgcgtggtcttggatgaggggtgttaaatgtgtatcgtgctgtggaacatgggacaattccacgcacatcccaccgaatcatcacgcatcccattgactggcaagtactccccgccccctctgaaagcatgtcacatcatgtaaatttgcttctaacatctgcttcaaactgtctctggactccaaatttggatgggtcagcctctgcagaaagtttgtgttgagatgctggaagaacagcagagcctcctgcaccctcagcaagggaccagctcccaaaggaaaggtccttgtgtgacatttggagaatcttccttcatccagacaactctactcgaagcaagacgaaagcaggatgtggcagttgcagtgagaaaggaaaggaaagatgggcagactctgctttctggaaatttcttcacaaagtagagctcatgaactctgtgctgtcttctggtaacatatcatcagtgtttgtattcatggtgtggcacatggatccatggcattgggtaaatctggtggtttttacacatggtcagaatgtgttcaaatacatctcatgatggagacagtaaccaaggtaatgttttgtttcagcattttaaaaagactccacttaacatttatctcagaatcatgagcctctctctagttgacaattgtcattgttcccccagccccaaattgaaccatacatttattttccaaaacagaaattgtttctgtaaacatatccgaccttcaaaagaagtgtgaggttggatttttcccccttttatttgtcctaagattccaggaggctggcctcccagcccagatagctcagccacctcacctgcctatcattcctgcattcctactttgagggtctcatcatgcccactgggtgttgttcctaagaaactgattgattaaaaaatttcccaaagtgtcctgaagtgtctcttcaaatacatgttgatctgtggagttgattcctttccttctcttggttttagacaaatgtaaacaaagctctgatccttaaaattgctatgctgatagagtggtgagggctggaagcttgatcaagtcctgtttcttcttgacacagactgattaaaaattaaaagaaaatgacagtttgaaaaa

SEQ ID NO: 53410 - DNA, 4066 bp, Homo sapiens
ggggctggagtggtggaaggggggtggcaggtctgcattgccgcttccctggtgccgggagcagtcgccgctgccgcctccgcccgcggccaggacccccgtcctcgcccgggactccttacccggggaacctagaccaggtctccagaggcttgtggaagagaagcaggcgacccttcctgagttatcctggcttagcctcccaatctggctccccttccccttcccattcccctgctccccctgtcccttccccatccacccaactgaactgggtataggtcaaagctcctctccttccttttccttcctaggcactcattggctaggacctgtttgctcttttttttgtgcccagagatactggaacacgcttcatctaagtaactgtggggaggggtctttttgactctacaagtccttgagcaaaaagctgaaaaagaagcaggaggtggagaagacccagtgaagtgccccaagccccatcatggaagagggcttccgagaccgggcagctttcatccgtggggccaaagacattgctaaggaagtcaaaaagcatgcggccaagaaggtggtgaagggcctggacagagtccaggacgaatattcccgaagatcgtactcccgctttgaggaggaggatgatgatgatgacttccctgctcccagtgatggttattaccgaggagaagggacccaggatgaggaggaaggtggtgcatccagtgatgctactgagggccatgacgaggatgatgagatctatgaaggggaatatcaggacattccccgggcagagtctgggggcaaaggcgagcggatggcagatggggcgcccctggctggagtaagggggggcttgagtgatggggagggtccccctgggggccggggggaggcacaacgacggaaagaacgagaagaactggcccaacagtatgaagccatcctacgggagtgtggccacggccgcttccagtggacactgtattttgtgcttggtctggcgctgatggctgacggtgtggaggtctttgtggtgggcttcgtgctgcccagcgctgagaaagacatgtgcctgtccgactccaacaaaggcatgctaggcctcatcgtctacctgggcatgatggtgggagccttcctctggggaggtctggctgaccggctgggtcggaggcagtgtctgctcatctcgctctcagtcaacagcgtcttcgccttcttctcatcttttgtccagggttacggcactttcctcttctgccgcctactttctggggttgggattggagggtccatccccattgtcttctcctatttctccgagtttctggcccaggagaaacgaggggagcatttgagctggctctgcatgttttggatgattggtggcgtgtacgcagctgctatggcctgggccatcatcccccactatgggtggagttttcagatgggttctgcctaccagttccacagctggagggtcttcgtcctcgtctgcgcctttccttctgtgtttgccattggggctctgaccacgcagcctgagagcccccgtttcttcctagagaatggaaagcatgatgaggcctggatggtgctgaagcaggtccatgataccaacatgcgagccaaaggacatcctgagcgagtgttctcagtaacccacattaagacgattcatcaggaggatgaattgattgagatccagtcggacacagggacctggtaccagcgctggggggtccgggccttgagcctaggggggcaggtttgggggaattttctctcctgttttggtcccgaatatcggcgcatcactctgatgatgatgggtgtgtggttcaccatgtcattcagctactatggcctgaccgtctggtttcctgacatgatccgccatctccaggcagtggactatgcatcccgcaccaaagtgttccccggggagcgcgtagggcatgtaacttttaacttcacgttggagaatcagatccaccgaggcgggcagtacttcaatgacaagttcattgggctgcggctcaagtcagtgtcctttgaggattccctgtttgaagagtgttattttgaggatgtcacatccagcaacacgtttttccgcaactgcacattcatcaacactgtgttctataacactgacctgttcgagtacaagtttgtgaacagccgtctgataaacagtacattcctgcacaacaaggagggctgcccgctagacgtgacagggacgggcgaaggtgcctacatggtatactttgtgagcttcctggggacactggcagtgcttcctgggaatatcgtgtctgccctgctcatggacaagatcggcaggctcagaatgcttgctggctccagcgtgatgtcctgtgtctcctgcttcttcctgtcttttgggaacagtgagtcggccatgatcgctctgctctgcctttttggcggggtcagcattgcatcctggaatgcgctggacgtgttgactgttgaactctacccctcagacaagaggaccacagcttttggcttcctgaatgccctgtgtaagctggcagctgtgctggggatcagcatcttcacatccttcgtgggaatcaccaaggctgcacccatcctctttgcctcagctgcccttgcccttggcagctctctggccctgaagctgcctgagacccgggggcaggtgctgcagtgaaggggtctctagggctttgggattggcaggcacactgtgagaccaacaactccttccttcccctccctgccctgccatcctgacctccagagccctcactccccactccccgtgtttggtgtcttagctgtgtgtgcgtgtgcgtgtgcatgtgtgtaaaccccgtgggcagggactacagggaaggctccttcatcccagttttgagatgaagctgtactccccatttcccactgcccttgactttgcacaagagaaggctgagccccatccttctccccctgttagagaggggcccttgcttccctgttccaggggttccagaataggcttcctgccttccccatcattccctctgcctaggccctggtgaaaccacaggtatgcaattatgctaggggctggggctctggtgtagaccatggaccaaaagaacttcttggagtctgaagagtgggcctcgggtgccctctcacatctcctgttggatgctgggggagaagcaataaacctcagccctctggcctccactttcctctcaatttgggctgcaaatatgaagcctgaattttatgaaattagctttctgattcttatttattaatagattaagttctgaggcagctccgcaggactgtgtgtgaatgtgtatgtatacttacatatgtgtgtgcatgtgccatggggcggggggtatcactatactgtcctcaaatataagccaagggtaatttcagcggatgcacacacaaccctgcctcccacagttcctcccctaatctggtttctgtgttgagcctgggatggaggagccctaggccagcctgggataagagtcccacagtctagggagatctgagggcatccgacaaggcccatctccttccctcctcaagaggcagaggcctcctctggagtgagaggctccacccactacagcacaggcgggaatagcacagctgccctcccatgctccctacctgtcccctcacagggaggggagcaggggagggaaagaaaccaggcatctggtcaaaccagcagatcaaaaagcacaaagagctggggcagaggcaggaagcaggggccctcctggcagctcctctgagtggggagaggttgggcagtgagtgagggacccctaatgcagggactagaagcctcagtttccccattttacccttccacacaatagcctctgtaggttaggctgccccatcccaccctactctgtgtggctgctttctttggtgccctcccctcaccccactgtagctgtgacgtgttgtagtttttagatgtttgtaaaatgtttaaaaaaatgttaaaagaaaaaaaaaaaaaaaaaaa

SEQ ID NO: 53411 - DNA, 4088 bp, Homo sapiens
gctgctctgcctgcatccggaggcggccgccagcggatttgccacccaggtcctaagactctcagtccagagagggccctgccccacacccagaaggaaggaatgctgcccagagatgaccagaggaatctagacagagcataaccttcggtggcaggacaaatcaggccagcacgcagtctgccaagtcctgctcgctccctgtcaagaaaaacagctggatccatttctaatcaacacttcccaacgcaacacttctgagtctctgaaggagaccagagcttgaaactttccagacttccaacagacatcgagtgcaaaaggatatttaggttgtctttgcacaaatctggttgatttgagagataaagggggggggaaccagtgtgactttcacctaagaagtcacatgaacatatttcacatttgaactacataatgaatgatggttattgaaatagcccaaacctctaccacagagcgagggatatagctcaaggggcaaccaggcagtcgcagaaccaaggaatggatgactacaagtatcaggacaattatgggggctatgctcccagtgatggctattaccgcggcaatgagtccaacccagaagaagatgcacagagtgatgtcaccgaaggccatgatgaggaagacgagatctatgagggcgagtaccagggtatccctcacccagatgatgtcaaggccaagcaggccaagatggcgccctccagaatggacagccttcggggccagacagacctgatggctgagaggctggaagatgaggagcagttggcccatcagtacgagaccatcatggatgagtgtggccatggccgcttccagtggatcctctttttcgtcttgggtttggccctgatggccgatggggtggaagtgttcgtggtgagttttgccctgcccagtgcagagaaggacatgtgtctgtccagttccaaaaaaggaatgctagggatgatagtctacttgggaatgatggcgggcgccttcatcctgggaggcctggctgataagctgggaaggaagcgagtcctcagcatgtctctggccgtcaatgcctccttcgcctccctctcttccttcgtgcagggatatggagccttcctcttctgccgactcatctcaggcatcggtattgggggtgctctaccgattgtttttgcctatttttctgaattcttgtctcgggagaagcgaggagaacacctcagttggctgggcatcttctggatgactgggggcctgtacgcatctgccatggcctggagcatcatcccacactatggctggggcttcagcatggggaccaattaccacttccatagctggagagtgtttgtcatcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtctgggataatgccctgtactgtgtgatggggccctacagaatgaatacactgattctggccgtggtttggtttgccatggcattcagttactatggactgacagtttggtttcctgatatgatccgctattttcaagatgaagaatacaagtctaaaatgaaggtgttttttggtgagcatgtgtacggcgccacaatcaacttcacgatggaaaatcagatccaccaacatgggaaacttgtgaatgataagttcacaagaatgtactttaaacatgtactctttgaggacacattctttgacgagtgctattttgaagacgtaacatcaacagatacctacttcaaaaattgtaccattgaatcaaccatcttttacaacacagacctctacgagcacaagttcatcaactgtcggtttatcaactccaccttcctggagcagaaggagggctgccacatggacttggagcaagataatgacttcctgatttacctcgtcagcttcctgggcagcctgtctgtcttacccgggaacatcatttctgccctgctcatggatagaattggaaggctcaagatgattggtggctccatgctaatctctgcagtctgctgcttcttcctgttttttggcaacagtgagtctgcaatgatcggctggcagtgcctgttctgtgggacaagcattgcagcctggaatgctctggatgtgatcacagtggagctgtatcccaccaaccagagagcaacagccttcggcattctcaatggattatgcaaatttggcgccatcctgggaaacaccatctttgcttcttttgttgggataaccaaagtggtccccatccttctggctgctgcttctctggttgggggtggcctgattgcccttcgactgccagagactcgagaacaggtcctgatgtgaacaacctatgggaaaaggaaaggtcgagagaatcttgtccaggacactgaaatgcatccacacttcctgcctatcacggtccggaggacaccttggatagcacgggaggagaagttgactttgtgacccctagtttaggacccacttcagctgtcaatatgtttgtaactcaggtgactgatttgggggtgccctgagccacccttagaatcacagagctgcgtgtttaacttcaagtcttcccagtccaaggcagggagaggattctccagtgagtgcacacactatgcgaggagcaagcatttctctaagtcaagtgcaaggacttaacttgcgtttgaaaaggaattagagggtcagaaacacccaggttcctccagaaagctccttggagcccaacaacttaacaaatcaacttggctggaagttagagtcattatatgaagattgggcttgaagtatatatttttgcatttaaaagtatcacctatcatattttccactcgaaaattgacatagtagcattgaggatacgctgatctagaaagccaagtatttgagcaacatctatagagatctacttttctcctatgtctcctaggctttccatgataattagggagagaagacatattgactctgactggacaccctgattcctccaaatatatataccactgtgtattaatctttctctcagtgttttataggagtactaacatttattgctctgtcaataatgaaaggctcgatgtaatatagctgtaatttactttccatatgaatacagtggctaggttcataaaagagaattgtgtgagtctgggattaccacatctaaaacattattctttaatgggataatacaattcattgagcagctaccacttaaaaaacttgcaggacagttagagcctgcatttctagttaagatggatcttgtaaatttaaaattggattaacattggagtgctggggtggctgcaataatttgggggctaactccatttggtttccaagatctcacttctgcattatctttatggctctttaaaccagccacctagccaatcaagggcaattcccatctcatccatcactcaggtctttgtaaagggtgcagccaagctctgcagacttttgcaggattgtctagcctgagtaccgggctacttcttaaatgccgtcactcctgctgagataaatgcgtctttaaaaatagtctctgtggcaggtcactgggggacaatgtacagcattctggccatccacttctttttcacttcatgttctaccccaagagactcccgatgtcggctgtggagggttaaagggatgaggctttcctttgtttagcaaatctgttcacagttcttgatgatgtattttatgatgcccagcttggaaatagttgctttccatagtctcaactgtattgtgtcatctcctgatgctgatttttgatcttttgttttattaaaaataattagtgaaaaaaaaaaaaaaaa

SEQ ID NO: 53412 - DNA, 3486 bp, Homo sapiens
ggctttgtctcgtgggctggtccccagcggctccctccccgaacagctgctgctccagggaggaagcggcgcgggtgctgtccagcttcccggtgctgaaaaccggagggctcgtcatccaccactaccatgtaagggccatgagaagggctcatcctggcgcagcgcggacatggaggaggacttattccagctaaggcagctgccggttgtgaaattccgtcgcacaggcgagagtgcaaggtcagaggacgacacggcttcaggagagcatgaagtccagattgaaggggtccacgtgggcctagaggctgtggagctggatgatggggcagctgtgcccaaggagtttgccaatcccactgatgatactttcatggtggaagatgcagtggaagccattggctttggaaaatttcagtggaagctgtctgttctcactggcttggcttggatggctgatgccatggagatgatgatcctcagcatcctggcaccacagctgcattgcgagtggaggctcccaagctggcaggtggcattgctgacctcggtggtctttgtaggcatgatgtccagctccacgctctggggaaatatctcagaccagtacggcaggaaaacagggctgaagatcagcgtgctgtggactctgtactatggcatccttagtgcatttgcgcccgtgtatagctggatcctggtgctccggggcctggtgggcttcgggatcggaggagttccccagtcggtgacgctgtatgccgagttccttcccatgaaagccagagctaaatgtattttgctgattgaggtattctgggccatcgggacagtgttcgaggtcgtcctggctgtgttcgtgatgcccagcctgggctggcgttggctgctcatcctctcagctgtcccgctcctcctctttgccgtgctgtgtttctggctgcctgaaagtgcaaggtatgatgtgctgtcagggaaccaggaaaaggcaatcgccaccttaaagaggatagcaactgaaaacggagctcccatgccgctggggaaactcatcatctccagacaggaagaccgaggcaaaatgagggaccttttcacaccccattttagatggacaactttgctgctgtggtttatatggttttccaatgcattctcttactacgggttagttctactcaccacagaactcttccaggcaggagatgtctgcggcatctccagtcggaagaaggctgtagaggcaaaatgcagcctggcctgcgagtacctgagtgaggaggattacatggacttgctgtggaccaccctctctgagtttccaggtgtccttgtgactctgtggattattgaccgcctggggcgcaagaagaccatggccctgtgctttgtcatcttctccttctgcagcctcctgctgtttatctgtgttggaagaaatgtgctcactctgttactcttcattgcaagagcgtttatttctggaggctttcaagcggcatatgtttacacacctgaggtctaccccacggcaacgcgggccctcggcctgggcacctgcagcggcatggcaagagtgggtgctctcatcactccgttcatcgcccaggtgatgctggaatcctctgtgtacctgactctggcagtttacagtggctgctgcctcctggctgccctggcctcctgctttttgcccattgagaccaaaggccgaggactgcaggagtccagccaccgggagtggggccaggagatggtcggccgaggaatgcacggtgcaggtgttaccaggtcgaactctggctctcaggaatagtgaccgatgggggactgagctggtctttgaggctgcagagcttggggggctggcaggccccaactggggcactgattgtcactgccgacatcaagaactcacccaagagtatgacctggaccaacagggttttgtgtcttgactcagtttgctcatcttcattgaggtccacccagggatggggagatgtttgctctagggggttctctgtatatgtggtgaaagctttgttcataacctgtggatctacatgggaagactacccatattaggagggtctggtaatgccagcaaccaatcagacaccacccagagtcacccggccaaaccctcagtgaacaaccaaaatatctctctgtagataccgtccaggctcaggcccatgtgacacctgctgtccacccaccggacctgttcagtaggtttctcccacactcacagccccaggctttcttctttgaaattgcaggcgatctaggtgtggtctgagcagctatttcctggcaggggccccccggtttgcctccctagagcctgaccagtggattctctggcagatggacatggtgcattcaaactggagccacatgcccccacccagccccctctggagttgccgttgttggcaccaagagatccagatgtgtccctggggacagctggtcttgcaccaggtgacaacctcagaacgccgttaccccctgggaactgaggactgaggccaaagtgaatcaagctgaagtcagagcacgggcctccccttctgaagcagcgaaggccacggttccgacttctttcctggccccctccttggtcaggctgaatggtgacttttattgttttttgagacggagtcttgatctgtcgcccaggctggagtgcagtagcgtgatctcggctcactgcaactctgcctcccgggttcaagcaattctcctgtctcagcctcccgagtagctgggattacaggtgcccacctgtactttttagtagagacagggtttcaccatgttggccaggctggtctcgaactcctgacctcaagtgatccacccgcctcggcctcccacagtgctgagattacaggtgggagccactgcacccggcctgaatgatgactcttgaggggaaaaagtttactcaggtttgcaggtacaaaatccaaaatccagggctttgggttttgtgcatgggtagacagctgaatgggcagagaaaccagaaggatgctacacccaccatctcatcccatggggatcaggggaccaggattccctgatgcgaagctgctcctctgtccagggacgtcttgatcattacacaaaggcagcccctggagttccattcatggagcctgccgtggagtggagaggggtgggaggactcaggtgtgtgaaatgtatatgttttcaaaggaagcagtgggaggccagttggttttgagttggtctccgcaggcaacatcacttctgggatttggtttactggagccttttttcccatggtgaaggcaggggacatagacaaggagggaggaagctggcagatcccatcaaaggccagagcagacagacctactgcttgaagtaaacattgcaaggaagccaatttgtgcgttcaactcttattaaaacatgtcagtgatggacattgaaaaaaaaaaaaaa

SEQ ID NO: 53413 - DNA, 2248 bp, Homo sapiens
cagtctgcggtgggcagcggaggagtcgtgtcgtgcctgagagcgcagctgtgctcctgggcaccgcgcagtccgcccccgcggctcctggccagaccacccctaggaccccctgccccaagtcgcagccatgaactacctgcggcgccgcctgtcggacagcaactttatggccaatctgccaaatgggtacatgacagacctgcagcgtccgcagccgcccccaccgccgcccggtgcccacagccccggagccacgcccggtcccgggaccgccactgccgagaggtcctccggggtcgccccagcggcctctccggccgcccctagccccgggtcctcggggggcggtggcttcttctcgtcgctgtccaacgcggtcaagcagaccacggcggcggcagctgccaccttcagcgagcaggtgggcggcggctctgggggcgcaggccgcgggggagccgcctccagggtgctgctggtcatcgacgagccgcacaccgactgggcaaaatacttcaaagggaaaaagatccatggagaaattgacattaaagtagaacaggccgaattctctgatctcaaccttgtggcccatgccaatggtggattctctgtggatatggaagttcttcggaatggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtggcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatgctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgggatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaacaaatcccagtctctgaccaatgccttcaaccttccagagccagccccgcccaggcccagccttagccaggacgaggtgaaagctgagaccatccgcagcctgaggaagtctttcgccagcctcttctccgactga

SEQ ID NO: 53414 - DNA, 2140 bp, Homo sapiens
cagtctgcggtgggcagcggaggagtcgtgtcgtgcctgagagcgcagctgtgctcctgggcaccgcgcagtccgcccccgcggctcctggccagaccacccctaggaccccctgccccaagtcgcagccatgaactacctgcggcgccgcctgtcggacagcaactttatggccaatctgccaaatgggtacatgacagacctgcagcgtccgcagccgcccccaccgccgcccggtgcccacagccccggagccacgcccggtcccgggaccgccactgccgagaggtcctccggggtcgccccagcggcctctccggccgcccctagccccgggtcctcggggggcggtggcttcttctcgtcgctgtccaacgcggtcaagcagaccacggcggcggcagctgccaccttcagcgagcaggtgggcggcggctctgggggcgcaggccgcgggggagccgcctccagggtgctgctggtcatcgacgagccgcacaccgactgggcaaaatacttcaaagggaaaaagatccatggagaaattgacattaaagtagaacaggccgaattctctgatctcaaccttgtggcccatgccaatggtggattctctgtggatatggaagttcttcggaatggggtgaaggtcgtgcggtctctgaagccggattttgtgctgatccgccagcacgccttcagcatggcacgcaacggagactaccgcagtttggtcattgggctgcagtatgctggaatccccagtgttaactccttgcattctgtctacaacttctgtgacaagccctgggtgtttgcccagatggttcgactgcataagaaactggggacagaagaattccctctaattgatcagaccttctaccccaatcacaaagaaatgctcagcagtacaacgtaccccgtggttgtgaagatggggcacgcacactctgggatgggcaaggtcaaggttgacaaccagcatgacttccaggacatcgcaagtgtcgtggcactgaccaagacgtatgccactgccgagcccttcatcgatgccaaatatgacgtgcgtgtccagaagattgggcagaactacaaggcctacatgaggacgtcagtgtcagggaactggaagaccaatactggctctgcgatgctggagcaaattgccatgtctgacagatacaagctgtgggtggacacgtgctcagagatttttgggggactggacatctgcgcagtggaagcgctacatggcaaggacggaagggatcacatcattgaggtggtgggttcctccatgccgctcattggtgaccaccaggatgaagacaaacagctcatcgtagagctcgtggtcaacaagatggctcaggccctgccccggcagcgacagcgggatgcctcccctggcaggggctcccatggccagactccgtccccaggggccctgcccttgggccgccagacctcccagcagcccgcagggcccccggctcagcagcgacccccaccacagggcggccctccacagccgggtccaggcccccagcgccagggacccccattgcagcagcgcccgcccccgcagggccagcagcacctttcaggccttggacccccagctggcagccccctgccccagcgccttccaagtcccacctcagcgccccagcagcccgcgtcccaggccgcgccgccgacccagggtcaaggccgccaatcccggccagtggcgggaggccccggggcgcctccagcagcccgcccgcccgcctctccgtctccccagcgccaggcgggccccccacaggctacccgtcagacatccgtctctggcccggctccgccaaaggcctctggggccccaccgggcgggcagcagcgccagggcccgccccagaaacccccaggcccagccggccccacacgccaggccagccaggcgggtcccgtgccccgcactgggccacccaccacgcagcagcctcggcccagcggcccgggccccgctggacgtcccaaaccacagctggcccagaaacccagccaggacgtgccgccacccgccaccgccgctgcagggggacctccgcacccccagctcaaagccagccccgcccaggcccagccttag

SEQ ID NO: 53415 - DNA, 3899 bp, Homo sapiens
tccgccgctgctgtctgcggggtctggcgccggggtctgagtctctgctggctaagccgccgcctcagccgcctcagtcgcctcaatctcgccttccgccctcgctctccctccgcgccaccagaccccgtagccccgcgcgcccccagccctttaagccagatgatgaacttcctgcggcgccggctgtcggacagcagcttcatcgccaacctgcccaacggctacatgaccgacctgcagcggcccgagccccagcagccgccgccgccgccgccccccggtccgggcgccgcctcggcctcggcggcgcccccgaccgcctcgccgggcccggagcggaggccgccgcccgcctcggcgcccgcgccgcagcccgcgccgacgccgtcggtgggcagcagcttcttcagctcgctgtcccaagccgtgaagcagacggccgcctcggctggcctggtggacgcgcccgctcccgcgcccgcagccgccaggaaggccaaggtgctgctggtggtcgacgagccgcacgccgactgggccaagtgctttcggggcaaaaaagtccttggagattatgatatcaaggtggaacaggcagaattttcagagctcaacctggtggcccatgcagatggcacctatgctgtggatatgcaggttctccggaatggcacaaaggttgtccggtccttccggccagacttcgtgctcatccggcagcatgcatttggcatggcggagaatgaggacttccgccacctgatcattggtatgcagtatgcaggcctccccagcatcaactcactggaatccatatacaacttctgtgacaagccatgggtgtttgcccagctggtcgctatctataagacactgggaggagaaaagttccctctcattgaacagacatactaccccaaccacaaagagatgctgacactgcccacgttccctgtggtggtgaagattggccacgctcactcaggcatgggcaaggtcaaagtggaaaaccactacgacttccaggacattgccagcgtggtggctctcacccagacctatgccactgcagagcctttcattgactccaagtatgacatccgggtccagaagattggcaacaactacaaggcttacatgaggacatcgatctcagggaactggaagacgaacactggctctgcgatgctggagcagattgccatgtcagacaggtacaaactgtgggtggacacctgctctgagatgtttggcggcctggacatctgtgctgtcaaagctgtacatggcaaagatgggaaagactacatttttgaggtcatggactgtagcatgccactgattggggaacatcaggtggaggacaggcaactcatcaccgaactagtcatcagcaagatgaaccagctgctgtccaggactcctgccctgtctcctcagagacccctaacaacccagcagccacagagcggaacacttaaggatccggactcaagcaagaccccacctcagcggccaccccctcaaggttgtttacagtatattctcgactgtaatggcattgcagtagggccaaaacaagtccaagcttcttaaaatgattggtggttaatttttcaaagcagaaattttaagccaaaaacaaacgaaaggaaagcggggaggggaaaacagaccctcccactggtgccgttgctgcgttctttcaatgctgactggactgtgtttttcctatgcagtgtcagctcctctgtctggttgtttacctgttcctgttcgtgcttgtaatgctcacttatgttttctctgtataacttgtgattccagggctgtttgtcaacagtatacaaaagaattgtgcctctcccaagtccagtgtgactttatcttctgggtggtttgatagtgtttttaaaagtaatatataatgtggggtgaaatgggagtaggggggtggacaggggagaaacgaaaaccacaaaaagaaaacccaactcctctcctccccccaagctcagttaaatcccccacctccaactttccctccaccagtgtgcttgggatcttcaatgaactgtgcttttcgctttctttctgcatgactattgtaactagatagaacattaagagattttcaagatcaaacttccatagcttcatccactgaatttgaaggcatccacctttttctccatttgctaaaatttggtgcagtttgagtttatgtgaataggctggctgtgcctgtagagctcttgtgtttttagtgatgacatgaaatacaaagaacaagctatttccaggaatgtgttctgtattttacatcccagtgtaccctttattttattattaactaattaactatgagatttttaaaaaatggggccgctgatgtgcaatatcaaagtgaacttgtgagtattttgtgtgtgttgatctcagttgtttcttcattgttgctgtttctggatccagccatgtgtgcgcttgtgtggacctgaggctgctttctgttcccaaagcttgacctgtgtacagagataattccttggcaatgttggacatagaatgcagggagctactgaaggtctgtcagggatttgtccattctgctcttggcctctcctgaggcctcataatgggagaccaaatcaaaaatgtcccatgtcacttgagtgggtacactgcctacagaaccttgaggttgactcctgcttcagttctcagctgtttaccacagccctccagggtccaaagattgaggagctttctctttcctgggaggaactgtctcagatttagcttgtgtgtgttttggacagaggctccacagcggtggctcttgaggaatcctcaccagtttgttctcttccctctgacaagcagcacctgagcagatgctgaggcagttcattaaaccaggcctcagcttcagtgcctcatcttgccatctcccggccaggctgggaacgggcaccaagcagccgcctctaacaaacaccatggtccgtggaagttcatgccagcagcttgcctttgagaagaaatgctgctggctctatttttacattcccttccacctctatactgtcatgtcaccgttctgaactcccagatctgagaaggaactagtgttggtggtatgtaacaagagttacgtatccaggggcttgtgccttggtttctcctttgattgctggtaaattctgaggccacagagaaatgcattgagtgtgaatgttgtcatctgtaatccctccctcagctgataatggtagttgatctgttgtaaatatatacatatatgcatatttgcacttccagatgggttgcataagaatcaggtccttaaatacctcccaatctgatgaaacgatagaataaagtaacatttcccagaatggaggaatacattattttatcgtatatttttgtccaagcgataagctgacggtggtattgcttctctgcatgttatcagtgtgtacatctggtgcttttcatgtgtcatttgtgagccacaaatgcaaagttgccatttgaattcagtcaggctacagggtggtgtcagtcaaggtctttcaggtgggggagaaattggttagggctcccactgccaaatgcaagcagatagcataacctgactgttatgtgccctcaggcagcatgcttagggacaactctgtggcctgggggacatctgtgtcacagtataggattgccattcaggtgttttgtacctatttctttcctgacgttgtcccctttttttgtactgatccaactgggagaacctcagccaatgctggaagtatgattgaagtacctctcttttgtgactcttgtacagcttaatgtgcaataaaggaaaagttatatctgaaaaaaaaaaaaaa

SEQ ID NO: 53416 - DNA, 2694 bp, Homo sapiens
tccgccgctgctgtctgcggggtctggcgccggggtctgagtctctgctggctaagccgccgcctcagccgcctcagtcgcctcaatctcgccttccgccctcgctctccctccgcgccaccagaccccgtagccccgcgcgcccccagccctttaagccagatgatgaacttcctgcggcgccggctgtcggacagcagcttcatcgccaacctgcccaacggctacatgaccgacctgcagcggcccgagccccagcagccgccgccgccgccgccccccggtccgggcgccgcctcggcctcggcggcgcccccgaccgcctcgccgggcccggagcggaggccgccgcccgcctcggcgcccgcgccgcagcccgcgccgacgccgtcggtgggcagcagcttcttcagctcgctgtcccaagccgtgaagcagacggccgcctcggctggcctggtggacgcgcccgctcccgcgcccgcagccgccaggaaggccaaggtgctgctggtggtcgacgagccgcacgccgactgggccaagtgctttcggggcaaaaaagtccttggagattatgatatcaaggtggaacaggcagaattttcagagctcaacctggtggcccatgcagatggcacctatgctgtggatatgcaggttctccggaatggcacaaaggttgtccggtccttccggccagacttcgtgctcatccggcagcatgcatttggcatggcggagaatgaggacttccgccacctgatcattggtatgcagtatgcaggcctccccagcatcaactcactggaatccatatacaacttctgtgacaagccatgggtgtttgcccagctggtcgctatctataagacactgggaggagaaaagttccctctcattgaacagacatactaccccaaccacaaagagatgctgacactgcccacgttccctgtggtggtgaagattggccacgctcactcaggcatgggcaaggtcaaagtggaaaaccactacgacttccaggacattgccagcgtggtggctctcacccagacctatgccactgcagagcctttcattgactccaagtatgacatccgggtccagaagattggcaacaactacaaggcttacatgaggacatcgatctcagggaactggaagacgaacactggctctgcgatgctggagcagattgccatgtcagacaggtacaaactgtgggtggacacctgctctgagatgtttggcggcctggacatctgtgctgtcaaagctgtacatggcaaagatgggaaagactacatttttgaggtcatggactgtagcatgccactgattggggaacatcaggtggaggacaggcaactcatcaccgaactagtcatcagcaagatgaaccagctgctgtccaggactcctgccctgtctcctcagagacccctaacaacccagcagccacagagcggaacacttaaggatccggactcaagcaagaccccacctcagcggccaccccctcaagggggccctgggcaaccccaaggaatgcagcccccaggcaaggtgctgcctccacgccggctcccccctggaccatcactgccaccttcctcctcttcctcctcttcttcctcctcctcggctcctcagcggccgggcggccccaccacccacggagatgcaccctccagcagcagctccctggcagaggcccagccacccctggctgctccaccacagaagccccagcctcacccacagctcaacaagtcgcagtccctgacaaatgccttcagcttctctgagtcctccttcttccggtcttcagccaatgaggatgaagccaaagcagagaccatccggagcttgaggaagtcctttgccagcctcttttcagattagctcttcagacacacggggcacccagcccaaccgggaaaggcatctaagacattcaccaacaacagtcagccagcttggtggttatgtcccatgaccttgacgtgtgtggtcccttcctctgctctgttgtactaagtgatgttgtgcagcccagaaaggaccatttgacagtctcagggcaggtgcctacccagcaaggggtacctggcatcagagaggaaagagctgcttccctgtagtcatgagagcttccttctgaagtcatcgttcgctgtgagtttagtggccttattgtgacagtgccatcatgtcttattcttccctgtgaaaccaggattaatcgtggactcctggcagcttaacctagctcagttgcagtgctaagcatgccccgcccccattcagtgatacctgtttgggaagtatatacttccccaaaagtactcttggccctaagttttaggaactttccccgacctggatcccttgtcatacctgtgttactgtttaaagcacacccacccaacttacaagatcttaggctgctgtggtggtgaagcaccttgagtctgctgatattcgggagaacaaggatctgcagtttccccttttctcccctctgaagagtggttcttatgtgcaatctgcagtaaccttgaactccagagctgcactatagaggagaatgcatgccactatgacagcagtatgccaagctttgtgttcatctcctaataaacgttaagacctttggtgtaataaaaaaaaaaaaaaaaaaaaaaa

SEQ ID NO: 53417 - DNA, 2054 bp, Homo sapiens
cgggaggcggcagcggctgcagcgttggtagcatcagcatcagcatcagcggcagcggcagcggcctcgggcggggccggccggacggacaggcggacagaaggcgccaggggcgcgcgtcccgcccgggccggccatggagggcgcctccttcggcgcgggccgcgcaggggccgccctggaccccgtgagctttgcgcggcggccccagaccctgctccgggtcgcgtcctgggtgttctccatcgccgtcttcgggcccatcgtcaacgagggctacgtgaacaccgacagcggccccgagctgcgctgcgtgttcaacgggaacgcgggcgcctgccgcttcggcgtcgcgctgggcctcggagccttcctcgcctgcgccgccttcctgctgctcgatgtgcgcttccagcaaatcagcagcgtccgcgaccgccggcgcgcggtgttgctggacctgggcttctcaggactctggtccttcctgtggttcgtgggcttctgcttcctcaccaatcagtggcagcgcacggcgccagggccggccacgacgcaggcgggggacgcggcgcgggccgccatcgccttcagcttcttctccatcctcagctgggtggcgctcaccgtgaaggccctgcagcggttccgcctgggcaccgacatgtcactcttcgccaccgaacagctgagcaccggggcgagccaggcctaccccggctatccggtgggcagcggcgtggagggcaccgagacctaccagagcccgcccttcaccgagaccctggacaccagccccaaagggtaccaggtgcccgcctactagcggctggcaggcacagaccagggctccaaggccaccccaccaacgcaggccccagggtctccgggacctcccttgggtccttccagctcagtgccgcggacagagtaggtggccgctttgcgccatccggggccaagagggggtggacccgcgtgtctgggctgcccctgccaagttcccccagtccctcagcacctggccccaggactgaggtcctgagaaggggatagcactgcccaggacgtgtgtccctagcctggaatggactggcctggggaaggctttcccctcttgggccacacctgctcactctggggttgggggtccagctgccctctacgatcaggtgcaggggctgcccaggacaaagcgggggcaggggaaagacaccaccctcgccccaagactggggatcctggccactgttcccatcccatgtccctgtgggtagtgactgtctcgtttctgtcatggtggtgcgtcccgtccggagccactctccactttctctcacaggctgctagaacagcccagccctgtcagtgttgtgatcatggtccagtcttcgggtttcacctcctagtactccacaagctgctcctctctctgtggccccggcccctgcccaggtgtgggtggttctggccaggaaggcacaaggtagctgtgggccaagacaccagccctgtcctagcccttcagtaagaccttgccaggagaggagaaggatgcctgggtgccaggcaagacaagcccctcagcaggagagaggcccagaggctccagctggccaccgtgccccacaagatggcccctgtgtggttccctttaccttggcttcctggcccagtccctgcctctccacctgcaccctgcttcctggcccagtcccaggttggagtccctctgcatagctgactactcatgcattgctcaaagctggcttttcacattaagtcaacaccaaacgtggttgccacatttcatcagacagacacctccctctggagatgcagttgagtgacaaccttgttacattgtagcctagaccaattctgtgtggatatttaagtgaacatgtttacaatttttgtatatatcactctctccctctcctgaaagaccagagattgtgtattttcagtgtcccatgttccgactgcaccttctttacaataaagactgtaactgagctgactgtgaaaaaaaaaaaaaaaaaaaaaaaaaa

SEQ ID NO: 53418 - DNA, 2449 bp, Homo sapiens
gccccctgcattgctgatgctgctgctggcggacatggacgtggtgaatcagctggtggctgggggtcagttccgggtggtcaaggagcccctcggctttgtgaaggtgctgcaatgggtcttcgccatcttcgcctttgccacatgcggcagctacagtggggagctccagctgagcgtggattgtgccaacaagaccgagagtgacctcagcatcgaggtcgagttcgagtaccccttcaggctgcaccaagtgtactttgatgcacccacctgccgagggggcaccaccaaggtcttcttagttggggactactcctcgtcagccgaattctttgtcaccgtggccgtgtttgccttcctctactccatgggggctctggccacctacatcttcctgcagaacaagtaccgagagaataacaaagggcccatgctggactttctggccacggctgtgttcgccttcatgtggctagttagctcatcggcatgggccaaggggctgtcagatgtgaagatggccacagacccagagaacattatcaaggagatgcctgtctgccgccagacagggaacacatgcaaggagctgagagaccctgtgacctcgggactcaacacctcggtggtgttcggcttcctgaacctggtgctctgggtcggcaacctgtggttcgtgtttaaggagacaggctgggccgccccgttcctgcgcgcgcctcccggcgcccccgagaaacaaccggcacccggggacgcctacggcgatgcaggctacgggcagggccccggcgggtacgggccccaggattcctacgggcctcagggcggctaccagcctgactatggtcaaccagccggcagcggtggcagtggctacgggcctcagggcgactatgggcagcaaggctacggcccgcagggtgcacccacctccttctccaatcagatgtagtctggtcagtgaagcccaggaggacctggggggggcaagagctcaggagaaggcctgccccccttcccacccctataccctaggtctccacccctcaagccaggagaccctgtctttgctgtttatatatatatatattatatataaatatctatttatctgtctgagccctgccctcactccactcccctcatccactaggtgcccagtcttgagtgggccccctctcttaccccgtccctttccctgcatcccttggcccctctctgtttaccctccctgtcccctgaggttaaggggatctaaaaggaggacagggagggaacagacctcggctgtgtggggagggtgggcgtgacttcagactctctcctctctctccctccactcctcccaactctggccttggttcctccagcaatgcctgcctgaacaaaggccgttagggaaatccaactccagggttaaagaaaggcagagattgggggggcttggggtagagaggacagtttaggacccaaggtggtcttggagaggaggtgtggagtggaggggtcagcaggggggttgggttccagacagagtggatctggagtctgaaggagaggagtgcgctagagcattctggggtggggcttggaagggcgctgagggcagggttctagaaggggcgaggctttaagcgaggcagaatggtgggctccagagtaggtgggtcttggattggtaccagagcctatggaaagggtgtggcttggaacatttgggagactgagcttgattctaaaggggacagatcttgagcaaggcaagaagtgggattcaggaatgggccaagccagggttccagacagggtggggcttagaatggggcttccatggtggtttcagaaagggcagcccctccccatggtgcagtgaagaaaatgttttacaatggctgggtttgggcagtggagaggggacttggataggagcttccagatgggttttgttaggggtgggggagaatggctctggctacgacttgggacggaagtggcctgagaagagtcgagtgatatggcttgtagggtgaggcgtgggatccagagagaagcaccccaccacacacacccttccccactcccgtgatgaaacagctaggttaataggaggacagaaccaacgggtctgtgggactggcccacccctcttcccccttcccctgcgccctccctccctccacacctccacccgtcctggggtggttggaggcctggtctggagcccctatcctgcaccctctgctatgtctgtgatgtcagtagtgcctgtgatcgtgtgttgccattttgtctggctgtggcccctccttctcccctccagacccctaccctttcccaaacccttcggtattgttcaaagaacccccctccccaaggaagaacaaatatgattctcctctcccaaataaactccttaaccacctagtcaaaaaaaaaaaaaaaa

SEQ ID NO: 53419 - DNA, 1102 bp, Homo sapiens
gcgccgcaaggcactgagcaggcgaaagagcgcgctcggacctccttcccggcggcagctaccgagagtgcggagcgaccagcgtgcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctgattcctcaattgaaaaacaagtggccctgttaaaggctctttatggacatggccagatctctcacaaaagacataaaacagattcctttgttggactaatgggcaaaagagctttaaattctgtggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatagctaacattttaaataaaagaaaaaatatcttgaaaaaaaaaaaaaaaaa

SEQ ID NO: 53420 - DNA, 1048 bp, Homo sapiens
gcgccgcaaggcactgagcaggcgaaagagcgcgctcggacctccttcccggcggcagctaccgagagtgcggagcgaccagcgtgcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctgattcctcaattgaaaaacaagtggccctgttaaaggctctttatggacatggccagatctctcacaaaatggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatagctaacattttaaataaaagaaaaaatatcttgaaaaaaaaaaaaaaaaa

SEQ ID NO: 53421 - DNA, 1057 bp, Homo sapiens
gcgccgcaaggcactgagcaggcgaaagagcgcgctcggacctccttcccggcggcagctaccgagagtgcggagcgaccagcgtgcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctggacatggccagatctctcacaaaagacataaaacagattcctttgttggactaatgggcaaaagagctttaaattctgtggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatagctaacattttaaataaaagaaaaaatatcttgaaaaaaaaaaaaaaaaa

SEQ ID NO: 53422 - DNA, 1003 bp, Homo sapiens
gcgccgcaaggcactgagcaggcgaaagagcgcgctcggacctccttcccggcggcagctaccgagagtgcggagcgaccagcgtgcgctcggaggaaccagagaaactcagcaccccgcgggactgtccgtcgcaaaatccaacatgaaaatcctcgtggccttggcagtcttttttcttgtctccactcagctgtttgcagaagaaataggagccaatgatgatctgaattactggtccgactggtacgacagcgaccagatcaaggaggaactgccggagccctttgagcatcttctgcagagaatcgcccggagacccaagcctcagcagttctttggattaatgggcaaacgggatgctggacatggccagatctctcacaaaatggcttatgaaaggagtgcaatgcagaattatgaaagaagacgttaataaactacctaacattatttattcagcttcatttgtgtcaatgggcaatgacaggtaaattaagacatgcactatgaggaataattatttatttaataacaattgtttggggttgaaaattcaaaaagtgtttatttttcatattgtgccaatatgtattgtaaacatgtgttttaattccaatatgatgactcccttaaaatagaaataagtggttatttctcaacaaagcacagtgttaaatgaaattgtaaaacctgtcaatgatacagtccctaaagaaaaaaaatcattgctttgaagcagttgtgtcagctactgcggaaaaggaaggaaactcctgacagtcttgtgcttttcctatttgttttcatggtgaaaatgtactgagattttggtattacactgtatttgtatctctgaagcatgtttcatgttttgtgactatatagagatgtttttaaaagtttcaatgtgattctaatgtcttcatttcattgtatgatgtgttgtgatagctaacattttaaataaaagaaaaaatatcttgaaaaaaaaaaaaaaaaa

SEQ ID NO: 53423 - DNA, 3186 bp, Homo sapiens
caggtgattatcctaattaatgtctatctaattaaattactgtcagcagctaaccaatggcaggagccgtttcatcggctgcacaagcagcaagatcaaaagtgagccttttctgattgctgcatagtgtcaattggccaatctcttctcccagggaaaaaaaaaagtaaatcaaacctttgagaagcatttgctggttgaagtgctttctgtctagtgagggggtctgtggatttctagtttatgataaataggactttaaaaaccagggacgggagggcgagtgttcaggttctagagctatgcagctggagcactgcctttctccttctatcatgctctccaagaaatttctcaatgtgagcagcagctacccacattcaggcggatccgagcttgtcttgcacgatcatcccattatctcgaccactgacaacctggagagaagttcacctttgaaaaaaattaccagggggatgacgaatcagtcagatacagacaattttcctgactccaaggactcaccaggggacgtccagagaagtaaactctctcctgtcttggacggggtctctgagcttcgtcacagtttcgatggctctgctgcagatcgctacctcctctctcagtccagccagccacagtctgcggccactgctcccagtgccatgttcccgtaccccggccagcacggaccggcgcaccccgccttctccatcggcagccctagccgctacatggcccaccacccggtcatcaccaacggagcctacaacagcctcctgtccaactcctcgccgcagggataccccacggccggctacccctacccacagcagtacggccactcctaccaaggagctccgttctaccagttctcctccacccagccggggctggtgcccggcaaagcacaggtgtacctgtgcaacaggcccctttggctgaaatttcaccggcaccaaacggagatgatcatcaccaaacagggaaggcgcatgtttccttttttaagttttaacatttctggtctcgatcccacggctcattacaatatttttgtggatgtgattttggcggatcccaatcactggaggtttcaaggaggcaaatgggttccttgcggcaaagcggacaccaatgtgcaaggaaatcgggtctatatgcatccggattcccccaacactggggctcactggatgcgccaagaaatctcttttggaaaattaaaacttacgaacaacaaaggagcttcaaataacaatgggcagatggtggttttacagtccttgcacaagtaccagccccgcctgcatgtggtggaagtgaacgaggacggcacggaggacactagccagcccggccgcgtgcagacgttcactttccctgagactcagttcatcgccgtcaccgcctaccagaacacggatattacacaactgaaaatagatcacaacccttttgcaaaaggatttcgggataattatgacacgatctacaccggctgtgacatggaccgcctgaccccctcgcccaacgactcgccgcgctcgcagatcgtgcccggggcccgctacgccatggccggctctttcctgcaggaccagttcgtgagcaactacgccaaggcccgcttccacccgggcgcgggcgcgggccccgggccgggtacggaccgcagcgtgccgcacaccaacgggctgctgtcgccgcagcaggccgaggacccgggcgcgccctcgccgcaacgctggtttgtgacgccggccaacaaccggctggacttcgcggcctcggcctatgacacggccacggacttcgcgggcaacgcggccacgctgctctcttacgcggcggcgggcgtgaaggcgctgccgctgcaggctgcaggctgcactggccgcccgctcggctactacgccgacccgtcgggctggggcgcccgcagtcccccgcagtactgcggcaccaagtcgggctcggtgctgccctgctggcccaacagcgccgcggccgccgcgcgcatggccggcgccaatccctacctgggcgaggaggccgagggcctggccgccgagcgctcgccgctgccgcccggcgccgccgaggacgccaagcccaaggacctgtccgattccagctggatcgagacgccctcctcgatcaagtccatcgactccagcgactcggggatttacgagcaggccaagcggaggcggatctcgccggccgacacgcccgtgtccgagagttcgtccccgctcaagagcgaggtgctggcccagcgggactgcgagaagaactgcgccaaggacattagcggctactatggcttctactcgcacagctaggccgcccctgcccgcccggccccgccgcggcccggacccccagccagcccctcacagctcttccccagctccgcctccccacactcctccttgcgcacccactcattttatttgaccctcgatggccgtctgcagcgaataagtgcaggtctccgagcgtgattttaaccttttttgcacagcagtctctgcaattagctcaccgaccttcaactttgctgtaaaccttttggttttcctacttactcttcttctgtggagttatcctcctacaattcccctccccctcgtctttctcttacctcctacttctctttcttgtaatgaaactcttcacctttaggagacctgggcagtcctgtcaggcagcagcgattccgacccgccaagtctcggcctccacattaaccataggatgttgactctagaacctggacccacccagcgcgtcctttcttatccccgagtggatggatggatggatggatggtagggatgttaataattttagtggaacaaagcctgtgaaatgattgtacatagtgttaatttattgtaacgaatggctagtttttattctcgtcaaggcacaaaaccagttcatgcttaacctttttttcctttcctttctttgcttttctttctctcctctcatactttctcttctctctcttttaattttcttgtgagataatattctaagaggctctagaaacatgaaatactcagtagtgatgggtttcccacttctcctcaatccgttgcatgaaataattactatgtgccctaatgcacacaaatagctaaggagaatccacccaaacacctttaaagg

SEQ ID NO: 53424 - DNA, 1817 bp, Homo sapiens
cggacctccacactgagccatgcccacccccgacgccaccacgccacaggccaagggcttccgcagggccgtgtctgagctggacgccaagcaggcagaggccatcatgtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctcta

SEQ ID NO: 53425 - DNA, 1910 bp, Homo sapiens
cggacctccacactgagccatgcccacccccgacgccaccacgccacaggccaagggcttccgcagggccgtgtctgagctggacgccaagcaggcagaggccatcatggtaagagggcagggcgccccggggcccagcctcacaggctctccgtggcctggaactgcagccccagctgcatcctacacccccaccccaaggtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctcta

SEQ ID NO: 53426 - DNA, 1898 bp, Homo sapiens
cggacctccacactgagccatgcccacccccgacgccaccacgccacaggccaagggcttccgcagggccgtgtctgagctggacgccaagcaggcagaggccatcatgggcgccccggggcccagcctcacaggctctccgtggcctggaactgcagccccagctgcatcctacacccccaccccaaggtccccgcggttcattgggcgcaggcagagcctcatcgaggacgcccgcaaggagcgggaggcggcggtggcagcagcggccgctgcagtcccctcggagcccggggaccccctggaggctgtggcctttgaggagaaggaggggaaggccgtgctaaacctgctcttctccccgagggccaccaagccctcggcgctgtcccgagctgtgaaggtgtttgagacgtttgaagccaaaatccaccatctagagacccggcccgcccagaggccgcgagctgggggcccccacctggagtacttcgtgcgcctcgaggtgcgccgaggggacctggccgccctgctcagtggtgtgcgccaggtgtcagaggacgtgcgcagccccgcggggcccaaggtcccctggttcccaagaaaagtgtcagagctggacaagtgtcatcacctggtcaccaagttcgaccctgacctggacttggaccacccgggcttctcggaccaggtgtaccgccagcgcaggaagctgattgctgagatcgccttccagtacaggcacggcgacccgattccccgtgtggagtacaccgccgaggagattgccacctggaaggaggtctacaccacgctgaagggcctctacgccacgcacgcctgcggggagcacctggaggcctttgctttgctggagcgcttcagcggctaccgggaagacaatatcccccagctggaggacgtctcccgcttcctgaaggagcgcacgggcttccagctgcggcctgtggccggcctgctgtccgcccgggacttcctggccagcctggccttccgcgtgttccagtgcacccagtatatccgccacgcgtcctcgcccatgcactcccctgagccggactgctgccacgagctgctggggcacgtgcccatgctggccgaccgcaccttcgcgcagttctcgcaggacattggcctggcgtccctgggggcctcggatgaggaaattgagaagctgtccacgctgtactggttcacggtggagttcgggctgtgtaagcagaacggggaggtgaaggcctatggtgccgggctgctgtcctcctacggggagctcctgcactgcctgtctgaggagcctgagattcgggccttcgaccctgaggctgcggccgtgcagccctaccaagaccagacgtaccagtcagtctacttcgtgtctgagagcttcagtgacgccaaggacaagctcaggagctatgcctcacgcatccagcgccccttctccgtgaagttcgacccgtacacgctggccatcgacgtgctggacagcccccaggccgtgcggcgctccctggagggtgtccaggatgagctggacacccttgcccatgcgctgagtgccattggctaggtgcacggcgtccctgagggcccttcccaacctcccctggtcctgcactgtcccggagctcaggccctggtgaggggctgggtcccgggtgccccccatgccctccctgctgccaggctcccactgcccctgcacctgcttctcagcgcaacagctgtgtgtgcccgtggtgaggttgtgctgcctgtggtgaggtcctgtcctggctcccagggtcctgggggctgctgcactgccctccgcccttccctgacactgtctgctgccccaatcaccgtcacaataaaagaaactgtggtctcta

SEQ ID NO: 53427 - DNA, 5815 bp, Homo sapiens
ggccactcttcgctcgggtaaacaggaaaggaaataccccttgtggattaaaatttaaaaaaaattctgttggggtcgaaggagggaggtggggtttgcctgcgcgcgtgttggactccggagagcaactcaggagcccgcgcggtcgtcgcctcccggcctggccatggactggcgggaagagggagcagggcgcccgggctgctcgggcccctagccgggcgctccctcgccaccggccccgctgcgggcctctaggggactgagacggtctcttgttcgcctggacggcgccggggagcggaggatctgcgctccgggtctccaggatgtgcccgtctgagatggggacgctgtggcaccactggtcgccggtactcatcagcctggccgccctgttttccaaagtgacggaaggtcgagggatccttgagagcatccagaggttttccttgctgcccacctacctccccgtgacctaccacatcaacaacgcggacgtctccttcttcctgaaggaggccaaccaggatatcatgaggaactccagcctgcagtcccgggtggagtcatttctgatttacaaatccaggaggctgcctgtcctcaatgccagctacgggcctttctccatcgagcaagtggtgccccaggatttaatgctaccttccaacccatttggattcaccaacaaattttctcttaactggaaactaaaagcccacatcctgcgggacaaagtctacctgagccggcccaaagtgcaggttctgttccacatcatgggcagagactgggacgaccgcagcgccggggagaagctgccgtgcctgagggtctttgctttccgagagacccgagaggtgcggggcagctgccggctgcagggggacctggggctgtgcgtggccgagctggagctcctgtccagctggttcagcccccccacggtggttgccgggaggaggaagtccgtggaccagccggaggggacccccgtggagctctactacaccgtgcacccagggggtgagagaggggactgcgtcagggaagacgcgaggagaagcaatgggatccggacaggccacagtgacatcgatgagtccgggccccccttgcagaggatcgggagcatcttcctttatcagacacacaggaaaccctccctgagagaactgcgtctggacaacagcgtggccatccactatataccaaagaccgtgaggaaaggagacgtgctgacttttcctgtttccatctccagaaattccactgaagatcgcttcacgttgagggcaaaggtgaagaaaggcgtgaacatcatcggcgtgcgagccagcagcccttccatttgggatgtcaaggagcgcacggattatactggaaagtatgcaccagctgtcatcgtttgtcagaagaaagcagctggctcagaaaacagtgcggatggcgcctcctacgaggtcatgcagatcgatgtggaggtggaagagcctggtgacctgccagccacacagctggtcacgtggcaggtcgagtaccccggagagatcacgtctgacttgggagtgtccaagatctatgtgagcccaaaggacttgattggagttgtgccgctggctatggaggcagaaatcctgaacacagccatcctcacggggaagacggtggccgtcccggtgaaagtggtctccgtggaggacgacggcacagtgacagagctgctggagtctgtggagtgtagatcgtctgatgaagacgtgattaaggtttctgacagatgtgactacgtctttgtcaatgggaaagaaatgaaaggcaaggtcaacgtggtggtgaacttcacctaccagcacctgagcagccccctggagatgacggtgtgggtgccccggcttccgctgcagatcgaggtctccgacaccgagctcaatcagatcaagggttggagagtgcccatcgtctccagcaggaggcctgccggggacagtgaagaggaggaggatgatgagcggaggggccgcggctgcaccctgcagtaccagcacgccatggtgcgggtcctgacgcagtttgtggctgaagcggccggccctgggggacacctggcccacctgctgggctcagactggcaagtggacatcacggagctgataaatgacttcatgcaggtggaggagcccaggatcgccaagctgcaaggcggacagattctgatggggcaggagcttgggatgaccaccattcagatcctgtctcctctgtcagacaccatcctcgctgaaaagaccatcactgtgctggacgagaaggtgaccatcacagacctcggggtgcagctggtgacagggctgtcactctccttgcagctcagcccaggaagcaacagggccatctttgccactgcagtgactcaggaacttctgcagaggccaaaacaggaagcagccatcagttgctgggtccagttcagtgatggctcagtcacgcccttggatatttacgatgggaaagacttctccttgatggccacatctttggatgagaaggtagtctccatccaccaagaccccaaattcaagtggcctatcattgctgcggaaacagaaggacaaggcaccctggtcaaggtggaaatggttattagtgaatcctgccagaaatccaagcggaagagtgtgttagctgttggaacggcaaacatcaaagttaaatttggccaaaacgatgctaaccccaacaccagtgacagcagacacacaggggcaggggttcacatggaaaacaatgtcagtgacagaaggcccaaaaaaccctcgcaggaatgggggagtcaggaaggacagtactatggcagttcttctatgggactcatggagggacggggcaccacgacagacaggtccatcctgcagaagaagaaaggccaggaaagccttttagatgacaacagccacttgcagaccatccccagcgacctcaccagcttcccagcccaggtggacctccccagaagcaatggggaaatggatgggaatgaccttatgcaggcatccaaagggctgagcgacttagaaattgggatgtatgctttgttgggagtcttctgtttggccattttggtcttcttgataaactgtgtgacctttgcattaaaatacagacacaaacaggttcccttcgaggagcaggaagggatgagtcactctcatgactgggttgggttaagcaaccggacagagctgttggagaatcacatcaactttgcctcctcgcaagatgagcaaatcactgccattgacaggggcatggatttcgaggaaagtaaatatctcctcagcacaaactcccaaaaaagcatcaatgggcagctgttcaaacctttgggacccatcatcattgatgggaaagatcagaaaagtgagcccccaacatcccctacctcaaaaaggaaaagggtaaaatttaccaccttcaccgccgtctcctcagacgacgagtaccccaccaggaactccatcgtgatgagtagcgaggatgacattaagtgggtctgccaggatctggaccctggggactgcaaagagctgcacaactacatggagaggttacatgaaaatgtgtaagccagacacacacagacattggttctcactcacctttcagcctttaattccaggatgtgtagcaacggtgcccccggaagagaaacaaagcagcaggacaaaataaggatgacactatccatacagcctcagccaatgaccccggctcggcggcgaggcctggagtccgcatcgacgcacacattccagagtacagtgtcttgcttaagaggtttatcatgcatggcaagatttttaagacttgaaacaaaaacgagttctgaatcactgagcgtctgagagcgtccaggaaagaacagcctctctctctcgaatcaaagcaatttggatattgtaaaatccacatggctccaatattcaatattgcagactatggaagaaaagtacaactcaggtggagcatccatggatcgcatccatggatcgcatccatggatcaatgggaggaagcgtgtcatcgaaactggagcagcacatcttgctgtgagcgcgatcacaggcagtccagtgccgccgtcagctgtgggaggcatgattgtgagtcactgtctctcaaaggctgggccagagctgtctcagatcatggacaggccaaggaagtggctgacaaggactgaaagggaacatgtgggctaacaggccacaaatacctttgtaactacatgccaaggacaaacacatggacgcaaatcctctgagcccttcagggtacttctttatttgtaaactaaggatactgggcatagaatttgaatcaggttcaaagaaccacgctcttttgattcatatcaagttcacaatgtatccatttctattcctccactgcattgccatcctccccaaagccgttggtcacctgtgggtgggggagggagagggcagtttgtagtatttgctgggtcttttttctccccctgggttttgtgtcaactcccaagtgacattctgtagagaagctccccccgcaacctgggcatatgccccacgccgtccgtctttgaagaggctggtctctaggcatgggcggtagtcacggtgaattccataccaggggatatacattcccttgctttactagaaagaaaacagggccacttgggatgggtctttcactgttcatggcagatctcctgtccaaagatgtggcctcgaggctgttgagacaaatcggggtgcctgtgtggaacgtgcagggcgtgtggagttgggggggttctgggtgtgaaagtggtggatccagcaggaagcccagcctcacacacaccggacagcacagaaaccttcttcatcttggaggtgcgaagggataaggggcatcagtgcatgtggtgaagatgcaggtttgcaagcacttggtcctgcagtcagccccgaaaggttcagcattgcttaagaccagccatgactctggatatccctgaatcccttcacttatgaagcctatgaagatgggggcaaggatacatcagagaattcctgcctcatctcacgctcactccaaggtagagaatggtgtgttgggtgattgccagccagataggatcctgcgaaagatggtcgggggcagcgggtggtgggcagaagaggccgtgctgttgaattgatcttctatttttccctctggtcattttctctctctctctgctcttcagttgtctgttttccagtctctctgtgtgtctgtctctgtatctctctcctcctttgaacctatcttctccctgcttcctctccatctcatctctgtaattttgagtgtgtgtctttactccttcttcctctccatagaattgaattctctttagatcatgtgtgtgtaaatttcaccagtttaccctcccaaccttagccctctcccctgcaactgtggtgctcttgagactgaggtttctgcagccagtaagtcacctgctcctgtccgcaagcttacctaccttgtttggttgggtgattaagctgtcaccccttttcaatgagaatcctttgctttcagtaacgtcctcatatttctttccattcttacctgtgtcatgttctgttgaatactgcagccgctgcccgcttccaaatccatctgcgtgtagaatgtactgtagattgtaagaatgtaatatatatttataaacttactgactgtaaatataaagtttgcattcagtgacaaaaaaaaaaaaaaaaaaaaaaaa

SEQ ID NO: 53428 - DNA, 3297 bp, Homo sapiens
tggaggggggaggtttttgttgaggagagcgcggccggagagcagagctccgggacccaggtgaccgggaaagcaggcagccccagcggcgggagcagccggcagcagcccaggcccggggactggggtgggggtgggaggggggctgaggggaggacctgaaggggggcggcagggcaaaagggacccctggagccctgccgccatcagagatcaagcatctggcatcagggatcttcggacccagcagaaggatccgccacaggggaggtgtcctcccagggaagccaacgagagattcacctgccccacatcaggagtgggccccccttactgacgctgctggcaaccatagcaggccccttaacccctcagtctcctccccatcaccctcctcaggccctttccccgcctccagctctcatctcaactcccagttcccagccctctaagccctagcacccccggctaccacctaaccctccaggtcttggccatactcacccccatcctgggacatttgccagatctctgggagggagatcgtttgtttaggcgatgccccctggtggcatgacagcgtctgcctagacccctgacccctagcactcaactccctgggcctcctttgtgtgaagagccgcccctctgcttagcagcgtggttgggggccaaagggaaagccagccccagctgggcccccgggccccaccacttatctccttgctgggcagctccccttggcctttgggcctctccctgctcccctcggcccctcctcctgggccgcctcaatgaaggagccggatgccatcaagctgtttgtggggcagatcccgaggcatctggaggagaaggacctgaagcccatcttcgaacagtttggtcggatctttgagctgactgtcatcaaggacaagtacaccgggctgcacaagggatgtgccttcctgacatactgtgcccgggattcagccctgaaggcccagagcgccctgcacgaacagaagacgcttccagggatgaacaggccgatccaggtcaagccagccgacagcgagagccgaggagaagaccggaagctctttgtggggatgctagggaagcagcagacagatgaggacgtccggaagatgtttgagcccttcgggaccatcgacgagtgcactgtgctccgggggccagatggcaccagcaaaggctgcgccttcgtgaagttccagacccacgctgaggcccaggcggccatcaacacccttcacagcagccggaccctgccaggtgcctcgtccagcctggtggtgaagtttgctgacactgagaaggagcgaggtctccgccgcatgcagcaggtggccacccagttgggcatgttcagccccatcgccctccagtttggagcctacagcgcctacacccaggccctgatgcagcagcaggcggccctggtagcggctcacagtgcctacctcagccccatggccaccatggctgccgtgcagatgcagcacatggctgccatcaatgccaatggcctcatcgccacccccatcaccccatcctcaggaaccagcacccctcctgccatcgctgccacgcctgtctctgccattccggctgccctgggcgtcaacggctacagcccggtgcccacccagcccactgggcagcctgcccctgatgctctgtatcccaacggggttcacccctacccagcccagagccccgcggcccccgtggaccccctgcagcaggcctacgcggggatgcagcactacacagcagcctacccagcagcctacagcctggttgcacctgcgttcccgcagcctccagccctggtcgcccagcagcccccaccaccacctcaacagcagcagcagcagcagcagcagcaacagcagcagcagcaaagagaaggccctgatggctgcaacatcttcatctaccacctgccccaggagttcactgactcagagatcctccagatgtttgtcccctttggccacgtcatctcagccaaagtctttgttgaccgagccaccaatcaaagcaaatgttttggctttgtgagtttcgacaatccggccagtgcccaggctgccatccaggccatgaatggcttccagatcggcatgaagcgcctcaaagtccagctaaagcggcctaaggatgccaaccggccctactgagggcccccaggtctggagatcccagaggaaggggcgcctcacaccctcttcccacgactggccccggccctctccgcacacctgccctgggccttgactgggttctggggcaaacgctgcttcgtggcccccgggggcacaagacaccggcccctcccacccccctgcctctctgaagggccatggctatgcttccctggctccaagggcccatttcctcctagatgcccttttggcctttgtgagggagcgaggaacaggctcgaaggctccggggtatctgccttctgctgggctcctgtgacaggccttctgtacccagcgtttgtacttgcctcccccaacagtgggcctgttctacccgtgcaggccccaggagagccgcaggggcctgccacacactcccagctcaccctcaccccagcctcttccccacattaggggtttcttggaagctggctctcactcccctccaccctcagctagaggtaggatatccctgattcctgggctcccagccttaaaactcactgcctcccccaagggccccctctaaggagggtgtgggggagccctgagggctgcctctctgccagtcagccacagagaccctcctcctttcacgaggaaaagaccttcccctgaacccctaaaaatgtttacagtctctgctggttccctctgtgtaaataccactaccacccgtgcgttatccagcccgcccggcctggcccggacgctgccatctctctttctgggagtttagacaatgttgcccttggatttttttctctctcttaatttctccctttgctttggggggtaattgggtattgggaggaggggtgtggggaggggtcaaggggtttattacctgatcattttctttaggaagaggttttagggaaaagaaaatggggtgggggtgggggtggtaaggggagaccggggagtcagtttcagacagttctctatgcttaacttatttatttattgcattttacttttaaagagttggtcttttctgtctaaataaagaaaaaagtttaaaagcatcaaataagagtcttggaaggttgagggtaggggattgttccctacccac

SEQ ID NO: 53429 - DNA, 5019 bp, Homo sapiens
gcctccgctgcagtcgctgcgtctccaagcaacatggctgacaaggccaagcctgccaaagctgccaacaggacgccccccaagtccccgggggacccctcgaaggaccgggcagccaagaggctgtcgctggaatcggagggtgctggtgagggggcagccgcatcccctgagctcagtgccctggaggaggccttccggcgctttgccgtgcacggggacgccagggccaccgggagggagatgcacggcaagaactggtcgaagctgtgcaaggactgccaggtgatcgacggcaggaacgtgaccgtcactgacgtggacatcgtcttcagcaagatcaaagggaagtcttgccggaccatcacctttgagcagttccaggaggcgctggaggagctcgccaagaagcgattcaaagacaagagcagcgaggaggccgttcgcgaggtgcacaggctcatcgagggcaaggcgcccatcatctcaggggtgacgaaagccatctcgtcgcccacagtgtcgaggctcacggacaccaccaagttcacgggctcccacaaggagcgcttcgacccctctggcaagggcaagggcaaggctggccgcgtggatctggtggacgagtcaggctatgtgtccggctacaagcacgcaggcacctacgaccagaaggtgcaagggggcaagtagcccccgctccatgcctcgcggcactgccggtgtccccagagcagggactctgtcacctcgcacttcattacattcctgtactaactggggcagaactcagacgggtgccccagagggggctggggggcggccaggcccaggcctccctcctgcccctcctcctaccggatgcccccagcactcccctctcaaaccaggtttgggccccagttcgctgaccctcctaatacacctgcctcgtcctcagccatttccaaagtgtctcgcggatcacaccacactgggcacgtggtttgcaggtcaaaggggcgttttaaagcagctggctgtcatggcaacaggaggctgtgctgacctcctgagcggcagacaccttccaggagccctgagggtggcaggagctaaccccaaccagcaggcaactaacacggaattggccccacaccggacgtgggaggtgtctgtggggcccgaggcctgtcctgtgtgcagcggacaccacggggccttcctgctttcctgggcagagggcagagtgaggccacctggcgggggtgctgggcgcctggcacatgtgtggggaagccggtcacatggacacacctgtgcacacatgcctacaggccagctctgtgccaagggcaacctaggtaaaacgaaagccgtcaggggcagtgggcggcttcccggctgaccacagtggcttggactgtgagggtagagtaggctcgctttgctttcctgagaagatgcggtggctgcctatgttctcagagcgggtctgggaagattcagaatgtccggtccctgtggtgttgccaggcaagagacacgaagtgccgagacactcctcgcctcaccgcgtgacagagcctctgcccggccctcccgttcgcccgtcctcactagctgcaccctgtttgctcgcagacctcccattgccacagcccaagcaccttcttcaactctcccaaaatggctcagcctaacctctcctggccaatcccccccgccggagagcaggacactagggaggacccccagtcctgcagtgtctgtgggggtttctctgccagcagggggctgagcagagcccatccaggacactccacactgccaggacacacccaggcggcccgcccttgcctgtctgcacctggggagaagccggcgctcctgctccctcctggggaggctgacgggtgtggccacccgctgtcacaatggcacactgccactgtcccttggcacgcacacagccacagccacacgtgtgacctgctgggccgtggttctggagtctacctgcggatgagcctgcggcagtcctggggaaacttttccagagcctgttagcccgtggctacggtcaggctctggccagggcagagggctgcccagggccaggctcacagtacaggagggtggcgaggcccctccctcactggcacgcatgagcaccacccgcctccccgactcccaagagtgcacctgctgcggccacagctccgtggaaggactccccctacctgagcagagcagaagccccagggcggagctcccagccagcatggtccgctgagggctggggggcggtctccgaggcccctcaacagagaagcctccacctgaggatggggaggacctggcaggcagcttccacggcagggctgggaagttcagtgcctggaaataaagagcaaggaaaaatggacctcaggcttcgtggctcctttaggatgtcacctcaccggcctggggaaggcggggggtgcccaagcccagccctgtgcccccgctgaacctggctggaccgcgtgtgaaaggcagaactaacgtgcggaaacatttgaaaacaactctgaatgtgcggttcggaatcacccgatcacagacgagcggtcaccggaatcgcccggtcacagacgagcagtcatcggactcacccgatcacagacgagcggtcaccggaatcgcccgatcacagacgagcggccaccggaatcgcccaatcacagacaagcagtcatcggaatcacccgatcacagacgagcagtcatcggactcacccgatcacagacgagcggtcaccagactcgcccgatcacagacgagcagtcatcggaatcacccgatcacagacgagcagtcatcggactcacccgatcacagacgagcggtcaccagaatcgcccgatcacagacgagcagtcatcggaatcacccgatcacagacgagtggccaccggaatcacccgataacagcccatcacaactccaaagcccttgtgttgaaaaggccgaggacgagtggtcaccaaacagggtggctccccaggtcccgaagcctgagacccggaaggccctggcacccttacaccctcggactcctgccctcctcggcctccctggccccagcgcggctccaccctgggctgcgtctcctggtcacaggctgcgtttctcctttctgtccgtgggcagcccagtccccacagtcacggccaagccacgcagaacgaacatgactccagaggacctcgccctggagctgagcctggcgccgggtcaggacggagggaagggcgggttggggtccgcgggtcctcacaccgcacggcaggcacagaggctcgccaggccctgatccggtctgtggggacgagggacactgaggagaggtgctgggcaccaggacgctgcctcctggtccctggttggcctcagacaagcacggcctcgagaaaagagccaagcgcatcgggagcacaccagaaaccggccctgagcacgagaagagcctccgcccggcccgggcaccacccgacctcgcagggagcaggccctgtcaccgacgggtcacctcgcccacacggccagcaccgactcaccacagcccttcccagacctggctggagtggccggagcggcggggctcatggctcccatcttggcccctggaggtgagctcattcacagaagtggtcccttcactctgagagagaaaatcgtggcgtgcatcccaaaccctaggccacgcctgtgggtttcgtgaatgagatcgaggctgctgtggcaccctgcccgtcctggcctggagcaccctgggatcctggagggagaggccccacgcccccactctccctccacacttccagggttggtgcccacgagttagaggcacggcctcccccagcggccctcaggcttttctcagacatgcgggagccaggagagcacccttctccactcagctccaaagcgaatctttgaaaacacccactcggctcccatctctgtcacctagccaggaggggtagcaaaaataaagtcacgaggacatagtggtcaccactgtcagttacaacttgtctgtggaatccgtaattgcatctgtgtgccgcctccgaacacagaacattgtttggacggcagccccactgcacataacagacccgtgcatcttcctcagtcagtttctgaatattgtgaattcaggcaggtgtgtgttctcttctgcatgtttttatgcactgccaattagcttctactaaccacggttcaacagaaaataaatgtgtatttgtgaataacaaactgcacaacctgcaaaccaggagagagggacaggttctgtcaggggtgacaccaggacacagggacaggttctgtcgggggtgacaccaggacacagggacaggttctgtcatgggtgacacgaggacacagggacaggttctatcatgggtgacaccaggagagagggacaggttctgttgggggtgacaagaggagacagggacaggttctgtcgggggtgacaccaggagagagggacaggttctgtcaggggtgacaccaggagagagggacaggttctgttgggggtgacaccaggacacaggaataggttctgtcgggaggacagtgctgatcgtgtctcagcatcaggaaaggagaaaggcagagggagagcgctgagaagactgttcacgccagagtgcttatttatttttaatttactgctataggataagcaaccaggtagtgttcctaacaattagcgttaccaaaattaaagttcaaattatatgtttaaaatattgtagaagatatatatttatactggactacttttacaccttctaatatcctgtccaagtttgggcgcagatggtggagttgggctggcatcatgtcctgtggccgccccacttgcctgttggtgccactccatcccgggccccagggatgccagctcagggctgaccacagcagccctgcgtgggcatcacctcctaccccagcccccatcctgggctgct

SEQ ID NO: 53430 - DNA, 4017 bp, Homo sapiens
agagatcttgcagccgcgagcgaagactgccctatcctcagactctaccgaaccccctgtggcctgcggagacgaggagacggacgggtctggtggccaatgagagcttcgatctcttgccccccgcccaatgggccgctgctcatgggccggggcgggactaggagggcaggtaggggcggtccgggctggcgcgcggcgcggcggctacgcggctgcggctcacagagctagcgcctctctgggtgtccgtgccagtgctgcgcgggaaggcaccaccaccacagccgccgccgctggccagggtgctggacaagacgggcccgtcggccacctcgccagctcaggcacccgctgcagccgtcgctgtctcctcccagaccggtccccatggaggagatggaagaggagttgaaatgccccgtgtgcggctccttctatcgggagcccatcatcctgccctgctctcacaatttgtgtcaggcgtgcgcccgcaacatcctggtgcagaccccagagtctgaatccccccagagccatcgggccgcgggctccggggtctccgactatgactatctggacctggacaagatgagcctatacagcgaggcggacagcggctatggctcctacggggggttcgccagcgcccccactaccccgtgccagaagtcccccaacggcgtccgcgtgtttcccccggctatgccgccaccggccacccacttgtcaccggccctggccccggtgccccgcaactcctgtatcacctgcccccagtgtcaccgcagcctcatcctggatgaccgggggctccgcggcttccccaagaatcgcgtactggaaggggtaattgaccgctaccagcagagcaaagccgcggccctcaagtgccagctctgcgagaaggcgcccaaggaagccaccgtcatgtgcgaacagtgcgatgtcttctactgcgatccgtgccgcctgcgctgccacccgccccgggggcccctagccaagcaccgcctggtgcccccggcccagggtcgtgtgagccggaggctgagcccacgcaaggtctccacctgcacagaccacgagctggagaaccacagcatgtactgcgtgcaatgcaagatgcccgtgtgctaccagtgcttggaggagggcaaacactccagccacgaagtcaaggctctgggggccatgtggaaactacataagagccagctctcccaggcgctgaacggactgtcagacagggccaaagaagccaaggagtttctggtacagctgcgcaacatggtccagcagatccaggagaacagtgtggagtttgaagcctgtctggtggcccaatgtgatgccctcatcgatgccctcaacagaagaaaagcccagctgctggcccgcgtcaacaaggagcatgagcacaagctgaaggtggttcgagatcagatctctcactgcacagtgaaattgcgccagaccacaggtctcatggagtactgcttggaggtgattaaggaaaatgatcctagtggttttttgcagatttctgacgccctcataagaagagtgcacctgactgaggatcagtggggtaaaggcacactcactccaaggatgaccacggactttgacttgagtctggacaacagccctctgctgcaatccatccaccagctggatttcgtgcaagtgaaagcttcctctccagtcccagcaacccctatcctacagctggaggaatgttgtacccacaacaacagcgctacgttgtcctggaaacagccacctctgtccacggtgcccgccgatggatacattctggagctggatgatggcaacggtggtcaattccgggaggtgtatgtggggaaggagacaatgtgcactgtggatggtcttcacttcaacagcacatacaacgctcgggtcaaggccttcaacaaaacaggagtcagcccgtacagcaagaccctggtcctccaaacgtctgagggtaaggcccttcagcagtatccctcagagcgagaactgcgtggcatctaaagtggctggcaagcccggaggtaaccccaccactgcccacattcctgaagtgtttccatgacttgctctgcattctgcacagagccgctgttcctctcctgcctttagagagcctatggtatgtggatgtgatcaaaccaaagattccacatcggcagttccaatggcttgggccggcggcttcctttgataacaatctaaataagctgcagttgaagaagctgaaaaatgaaggcctgaatgtgcccctggtgtgtaagacaaatgtatctaggctctagagcaggctcccattctccaccgatacacatcatgtgccagttttgcccagatgattctaaattactctgtagtacttgcttgttctgagggtgggacctaggttctttccagtcgtggatttgtatgactgaatgtgtttcaaatgggtggtggggtgctagagctgtttagagagggcctgttggctgctcctggcttacccacttagactgcctccgtttcatacccaaagcggaggccgtcagcaccaggattgagacttcctgtgggcaccaaacaggaagagaccagcaacttcgcattacccgccattttcatctttgccagtcccttcagtcttggctaggctaccgagagccaccatacaaggttcatctctagagaatttttgcttcttagctatactttaaatattttggtcatcaaagacaagtaatgtgtctcagatgagaggctgaatttgatggccagatataacctctgaggcttttaacattttcattttaagagtaagcaagacacatgaaattaaacctacaaggaggtatttgtggctggtgccaaagcattctgacactttggggtgtcattttaatcaaagaaatcacccccccacctcaccgggattctccataacttccctctgcagaactaattatgttgattttgttcaagttcaagatgttagctaaaagaactatggtggtgttttttttcccacttcccacaaacctcaacatgtgccagtcaccctaaaatgcttcacatggttaaaaacaagcacaattttgaatcctacagcaaggatgaaaggcccctagccgtgaaaacagtgctttggggagcagttgtcagtctaagtgatgctattccaagagaaggatatgctgagggaaaatgcccacatgacctgttcccatttggagtacagtgatgtggtagctacagcttcccccagaattatcattttagcaccttctctcagggatgacctatcagtttgagagcagttgcctcttttctcaaaataccatactaactgctaaagccctccaagagtctttcctagatgcaacgcagaaggcccttgctggtgatggcctcatttcccatgtgtgtacaaggtggtttgattgaagagtgaagtgcatgcctgcagagcagagagaaatttgtagcaatgttgctaatatgtgttatcagatctgcgggaaaactatttctattcataatacatcatgggaatcatactattctggtaaaaatcagttattagcataacagcctgagcacttatgtctctcgtttcatcctgcaggaggatgtagcgcctcagtttattttaatgttcataagattatggtgtctaatttaataaattacaggattggaactgcgatccttggtaccacagtcacagaactgggggtcattttctagatgaaacaaacggaacaagttctcttccaacaaagaaactgtactgtagaaattaatttcctccatgaattttatatattgtgtacaaatataaggtatgtatctgaatacaaagaaaagcctatcatcatatagatatcagtattctctgttactgcacagaagtaattttctcatgatgaaataaagttcacacacatactttctccaaaaaaaaaaaaaaaaaaaaaaaaaaaaaaaaaaaaaaaaaaa

SEQ ID NO: 53431 - DNA, 1999 bp, Homo sapiens
cccagccagaccccgcgccgcccgcgccccgctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaagcagctgggtcctccttatttctcctctcccttgattcggcctcctggccagggctgggacatcctccctgctgtcctctctcccccggcctcccagctgccaggaatttctgcgcctgtccaggctcagcaaggggtccaaagacattgttctttaaaaaaaaaaaaaaaaaa

SEQ ID NO: 53432 - DNA, 2045 bp, Homo sapiens
cccagccagaccccgcgccgcccgcgccccgctcgactccggaggctcccgcagccccggcgtccgccccgctgccccctcccccgggggccatgggggcgcccccgggctaccggccctcagcttgggtgcatctcctccaccagctgccccgcgccgacttccagctccgcccggtgcccagcgttttcgcgccccaagagcaggaataccagcaggccttgttgctggtggcggccttggcgggcctgggcttgggcctgagcctcattttcatcgctgtctacctcatccgcttctgctgctgccggccccccgagccccccgggtccaagatcccctcgcccgggggaggctgcgtcacctggagctgcattgtcgcccttctcgccggctgcactggcattggcatcggtttctatggcaacagtgagaccagtgatggggtgtcccagctcagctctgcgctgctgcacgccaaccacacactcagcaccattgaccacctggtgttggagacggtggagaggctgggcgaggcggtgaggacagagctgaccaccctggaggaggtgctcgagccgcgcacggagctggtggctgccgcccgaggggctcgacggcaggcggaggctgcggcccagcagctgcaggggctggccttctggcagggagtgcccctgagccccctgcaggtggctgaaaatgtgtcctttgtggaggagtacaggtggctggcctacgtcctcctgctgctcctggagctgctggtctgcctcttcaccctcctgggcctggcgaagcagagcaagtggctggtgatcgtgatgacagtcatgagtctcctggttctcgtcctgagctggggctccatgggcctggaggcagccacggccgtgggcctcagtgacttctgctccaatccagacccttatgttctgaacctgacccaggaggagacagggctcagctcagacatcctgagctattatctcctctgcaaccgggccgtctccaaccccttccaacagaggctgactctgtcccagcgagctctggccaacatccactcccagctgctgggcctggagcgagaagctgtgcctcagttcccttcagcgcagaagcctctgctgtccttggaggagactctgaatgtgacagaaggaaatttccaccagttggtggcactgctacactgccgcagcctgcacaaggactatggtgcagccctgcggggcctgtgcgaagacgccctggaaggcctgctcttcctgctactcttctccctgctgtctgcaggagcgctggccactgccctctgcagcctgccccgagcctgggccctcttcccacccagtgacgactacgatgacacagacgatgacgaccctttcaaccctcaggaatccaagcgctttgtgcagtggcagtcgtctatctgagcccctcctcccggctggactggagcctggctcccctcttcgttccttccctggctgccggaggagaccccactaacccagcctgcctgggctctgaccactaacactcttggccatggacagcctgcacaggaccgcctccctgctcttggccactgtgctcccatttctgtccttggccttgggagtagctgagggggcagactagggagtagggctggcaggggagggggcagacagcctcgcctcgcacccttcatccctggctgccggtcccatccttggagggactaagctgggggtgggggacatgagtccccctgctgcccctgccacatcccagtgggctctgaccccctgatctcaactcgtggcactaacttggaaaagggttgatttaaaataaaagggaagactattttacaagcagctgggtcctccttatttctcctctcccttgattcggcctcctggccagggctgggacatcctccctgctgtcctctctcccccggcctcccagctgccaggaatttctgcgcctgtccaggctcagcaaggggtccaaagacattgttctttaaaaaaaaaaaaaaaaaa

SEQ ID NO: 53433 - DNA, 2318 bp, Homo sapiens
cgcagggaccgtgctccgccgtctccgccgcatcttccaccctcgccgccgccgcagctccccgcgctcgtgccaccgccgccgcgtccaccctcagcgccaccgccatgcgggagatcgtgcacctgcaggccggccagtgcggcaaccagatcggggccaagttttgggaggttatcagtgacgaacatggcatcgaccccacaggcacataccatggggacagtgacctgcaactggagaggatcaacgtgtactacaacgaggccacaggaggaaattatgtccccagagcggtgctggtggacctggaacccggcaccatggactctgtccgttctggccccttcggtcagatctttcggccggacaacttcgtgtttggccaatccggagccggcaacaactgggcaaaggggcactacacggagggcgcagagctggtggacgctgtcctggacgtagtccggaaggaggccgagagctgcgactgccttcagggcttccagctgacccactcgctggggggtggcacggggtccggaatgggcacgctgctcatcagtaagatccgcgaggagttcccagaccgcatcatgaacaccttcagcgtggtgccctcgcccaaagtgtcagacacggtggtggagccctacaacgccacgctgtctgtgcaccagctggtggagaatacggatgagacctactgcatcgacaacgaggcactctacgacatctgtttccgcaccctcaagctgaccacccccacctacggggacctcaaccacctggtgtcggccaccatgagcggggtcaccacctgcctgcgcttcccgggccagctgaacgccgacctgcgcaagctggccgtcaacatggttccctttcctcgcctgcacttcttcatgcccggcttcgcacccctgaccagccggggcagccagcagtaccgggccctgacggtgcccgagctcacccagcagatgttcgatgccaagaacatgatggcggcgtgcgacccgcgccacggccgctacctgaccgtggccgccgtgttccggggccgcatgtccatgaaggaggtggacgagcagatgctgagcgtgcagagcaagaacagcagctacttcgtggagtggatccccaacaacgtgaagacggccgtgtgcgacatcccgccccgcggcctgaagatggccgcgaccttcatcggcaacagcacggccatccaggagctgttcaagcgcatctccgagcagttcacggccatgttccggcgcaaggccttcttgcactggtacacgggcgagggcatggacgagatggagttcaccgaggccgagagcaacatgaatgacctggtatctgagtaccagcagtaccaggacgccacggccgaggagggcgagttcgaggaggaggcggaggaggaggtggcctaggctgctcccatcgcttcccacctgtcccctcgaggcttctgacctttgatccgctaggccccccatctctgaaccctagagccccgctttccctccaaggctgactccccgctgaccctaacaatacctttggagctcgctttacctctggctacttcatctccgaccctggctcccctttgagccctaatttatctttaacccccttgagctcttccaaccttgacattcccaggaggagccccgcttcaccccttctgactctggaaaccgcacctttaactttgcagaccttccttcacccctgacttctgcttcacctttgacctctgccccccatgaatcccattttacctctagacctataagttctggtttatgtttgacccctccctctgagctgcacttcaccgctgaccttgcctcacctttaaccccccacctgagccccagctcctacctctgaccccaacttctctttgatctctgaatcccctctgactccaacttctctttcaccctctatgagtcccattttacttctacacctgcaagtcctggtttatattggacccctccctccgagctgcagttcacctttgaccttgcctcacctttcaccccccaccccccacagcgtcagctcctacctctgaccccagcttctctctgattcccacaggccccatgcatcctccctgcctcactcccctcagcccctgccgaccttagcttatctgggagagaaacaaggcctggtgcctgtgaggaagagaggtcacccctaccctccctccccgcttccctgcctcaccctcaataaataaattaattgttgtcatggaaaaaaaaaaaaaaaaaaaaaaaaaaaaaaaa

SEQ ID NO: 53434 - DNA, 9832 bp, Homo sapiens
atgtctctgctttgcgttggagtcaaaaaagccaagtttgatggtgcccaagagaaattcaacacgtacgtgaccctgaaagtgcagaatgtcaagagcacgaccatcgcggtgcggggcagccagcccagctgggagcaggatttcatgttcgagattaaccgtctggatttgggactgacggtggaggtgtggaataagggtctcatctgggacacaatggtgggcactgtgtggatcccactgaggaccatccgccagtccaatgaggagggccctggagagtggctgacgctggactcccaggtcatcatggcagacagtgagatctgtggcaccaaggaccccaccttccaccgcatcctcctggacacgcgctttgagctacccttagacattcctgaagaggaggctcgctactgggccaagaagctggagcagctcaatgctatgcgggaccaggatgaatattcgttccaagatgagcaagacaagcctctgcctgtccccagcaaccagtgctgcaactggaattattttggctggggtgagcagcacaacgatgaccccgacagtgcagtggatgatcgtgacagtgactaccgcagtgaaacgagcaacagcatcccgccgccctattatactacgtcacaacccaacgcctcagtccaccaatattctgttcgcccaccacccctgggctcccgggagtcctacagtgactccatgcacagttacgaggagttctctgagccacaagccctcagccccacgggtagcagccgctatgcctcttccggggagctgagccagggaagctctcagctgagcgaggacttcgaccctgacgagcacagcctgcagggctccgacatggaggatgagcgggaccgggactcctaccactcctgccacagctcggtcagctaccacaaagactcgcctcgctgggaccaggatgaggaagagctggaggaggacctggaggacttcctggaggaggaggagctgcctgaagatgaggaggagctggaggaggaggaggaggaggtgcctgacgatttgggcagctatgcccagcgtgaagacgtagctgtggctgagcccaaagacttcaaacgcatcagcctcccgccagctgccccagggaaggaggacaaggccccagtggcacccaccgaggcccccgacatggccaaggtggcccccaagccagccacgcccgacaaggtgcctgcagctgagcagatccctgaggctgagccacccaaggacgaggagagtttcaggccgagagaggatgaggaaggccaggaggggcaggactccatgtccagggccaaggccaactggctgcgtgccttcaacaaggtgcggatgcagctgcaggaggcccggggagaaggagagatgtctaaatccctatggttcaaaggcggcccagggggcggtctcatcatcatcgacagcatgccagacatccgcaagaggaaacctatcccactcgtgagcgacttggccatgtccctggtccagtccaggaaagcgggcatcacctcggccttggcctccagcacgttgaacaacgaggagctgaaaaaccacgtttacaagaagaccctgcaagccttaatctaccccatctcgtgcacgacgccacacaacttcgaagtgtggacggccaccacgcccacctactgctacgagtgcgaggggctgctgtggggcatcgcgaggcagggcatgcgctgcaccgagtgcggtgtcaagtgccacgagaagtgccaggacctgctcaacgccgactgcctgcagcgggctgcggagaagagctccaagcacggggcggaggaccggacacagaacatcatcatggtgctcaaggaccgcatgaagatccgggagcgcaacaagcccgagatcttcgagctcatccaggagatcttcgcggtgaccaagacggcgcacacgcagcagatgaaggcggtcaagcagagcgtgctggacggcacgtccaagtggtccgccaagatcagcatcaccgtggtctgcgcccagggcttgcaggcaaaggacaagacaggatccagtgacccctatgtcaccgtccaggtcgggaagaccaagaaacggacaaaaaccatctatgggaacctcaacccggtgtgggaggagaatttccactttgaatgtcacaattcctccgaccgcatcaaggtgcgcgtctgggacgaggatgacgacatcaaatcccgcgtgaaacagaggttcaagagggaatctgacgatttcctggggcagacgatcattgaggtgcggacgctcagcggcgagatggacgtgtggtacaacctggacaagcgaactgacaaatctgccgtgtcgggtgccatccggctccacatcagtgtggagatcaaaggcgaggagaaggtggccccgtaccatgtccagtacacctgtctgcatgagaacctgttccacttcgtgaccgacgtgcagaacaatggggtcgtgaagatcccagatgccaagggtgacgatgcctggaaggtttactacgatgagacagcccaggagattgtggacgagtttgccatgcgctacggcgtcgagtccatctaccaagccatgacccactttgcctgcctctcctccaagtatatgtgcccaggggtgcctgccgtcatgagcaccctgctcgccaacatcaatgcctactacgcacacaccaccgcctccaccaacgtgtctgcctccgaccgcttcgccgcctccaactttgggaaagagcgcttcgtgaaactcctggaccagctgcataactccctgcggattgacctctccatgtaccggaataacttcccagccagcagcccggagagactccaggacctcaaatccactgtggaccttctcaccagcatcaccttctttcggatgaaggtacaagaactccagagcccgccccgagccagccaggtggtaaaggactgtgtgaaagcctgccttaattctacctacgagtacatcttcaataactgccatgaactgtacagccgggagtaccagacagacccggccaagaagggggaagttctcccagaggaacaggggcccagcatcaagaacctcgacttctggtccaagctgattaccctcatagtgtccatcattgaggaagacaagaattcctacactccctgcctcaaccagtttccccaggagctgaatgtgggtaaaatcagcgctgaagtgatgtggaatctgtttgcccaagacatgaagtacgccatggaggagcacgacaagcatcgtctatgcaagagtgccgactacatgaacctccacttcaaggtgaaatggctctacaatgagtatgtgacggaacttcccgccttcaaggaccgcgtgcctgagtaccctgcatggtttgaacccttcgtcatccagtggctggatgagaatgaggaggtgtcccgggatttcctgcacggtgccctggagcgagacaagaaggatgggttccagcagacctcagagcatgccctattctcctgctccgtggtggatgttttctcccaactcaaccagagctttgaaatcatcaagaaactcgagtgtcccgaccctcagatcgtggggcactacatgaggcgctttgccaagaccatcagtaatgtgctcctccagtatgcagacatcatctccaaggactttgcctcctactgctccaaggagaaggagaaagtgccctgcattctcatgaataacactcaacagctacgagttcagctggagaagatgttcgaagccatgggaggaaaggagctggatgctgaagccagtgacatcctgaaggagcttcaggtgaaactcaataacgtcttggatgagctcagccgggtgtttgctaccagcttccagccgcacattgaagagtgtgtcaaacagatgggtgacatccttagccaggttaagggcacaggcaatgtgccagccagtgcctgcagcagcgtggcccaggacgcggacaatgtgttgcagcccatcatggacctgctggacagcaacctgaccctctttgccaaaatctgtgagaagactgtgctgaagcgagtgctgaaggagctgtggaagctggttatgaacaccatggagaaaaccatcgtcctgccgcccctcactgaccagacgatgatcgggaacctcttgagaaaacatggcaagggattagaaaagggcagggtgaaattgccaagccactcagacggaacccagatgatcttcaatgcagccaaggagctgggtcagctgtccaaactcaaggatcacatggtacgagaagaagccaagagcttgaccccaaagcagtgcgcggttgttgagttggccctggacaccatcaagcaatatttccacgcgggtggcgtgggcctcaagaagaccttcctggagaagagcccggacctgcaatccttgcgctatgccctgtcgctctacacgcaggccaccgacctgctaatcaagacctttgtacagacgcaatcggcccagggcttgggtgtagaagaccctgtgggtgaagtctctgtccatgttgagctgttcactcatccaggaactggggaacacaaggtcacagtgaaagtggtggctgccaatgacctcaagtggcagacttctggcatcttccggccgttcatcgaggtcaacatcattgggccccagctcagcgacaagaaacgcaagtttgcgaccaaatccaagaacaatagctgggctcccaagtacaatgagagcttccagttcacgctgagcgccgacgcgggtcccgagtgctatgagctgcaggtgtgcgtcaaggactactgcttcgcgcgcgaggaccgcacggtggggctggccgtgctgcagctgcgtgagctggcccagcgcgggagcgccgcctgctggctgccgctcggccgccgcatccacatggacgacacgggcctcacggtgctgcgaatcctctcgcagcgcagcaacgacgaggtggccaaggagttcgtgaagctcaagtcggacacgcgctccgccgaggagggcggtgccgcgcctgcgccttagcgcgggcggtcggccgagcggcactgcgcctgcgcggagggcgctgggcggggagggacggggcttgcgccttggtgggacctccccaggggcggggctcggggggctccacgccaagggtgggctgcgcctacgcccttgactcagctttcccttttggggaattaggaatggaggatgccccgccctctcgggaggccacgcccaagggcgcgacgaaggaaggagccacatccccaacttgaggccacgcccccagcacctagggggcattttgagctgggatgggggaaacctcgtccctatggaggaggccacatcccggggctctggtaccgggaggcaccacctcatgtcccctggaaaagccataagatgggacccagacccctgggaccccagaccaattgccaagtatggaaatctcagctccctcgagggggggccctgggcaaggggtagggctctctggagcgcccctctaggtggcctggggactggagggaccaggatgctggttggagggccccggaataccggagtccctttagatatttgtgcaaaaaataaatggggggaggggggaggatgggatttcaaaagcacatgcgcccttgggcgcccaaaccctgggggccgaggggacggctctggttccccacgctgcccctacttccctttgggagtttgcctctccctctcccccaacaaacccagtcctcatatcatagagttcaacacacccatttgacagatggcaaaactgaggcttaaagagctgcttgagacttggccaaggttccaggtgccataccctctgtgcccctcccttaggcctgtgtgccccatggaagggtgggctgagatcgggatgacctgacacagctccctattgctgctaattccccctcggcctcctccaaggggtgggaattccaggccaagacccctacttcgcctttccttctccggctgccaagcaggacctttgccctcagccctttctcctgggatctccatgggggatgccatgagggcctcccaccacaaaagagaatttgggatcccctggtcccaggtttctccatcccttcttccttttccagaattttccaaataggaaagaacagaaggagaccagaaactctaggggggagaaagagaatgagagaaagagaatgagagagagagaaacacaaacacagtgacacagtgagagcttagtctccaagagcctattcattgattcaaacacccaagccacaggatacctcagatggccctcttgccagctggaagctctttctccaatgagcaaagttacagtgacctggctggagttacctggtgcacataggaccttaggggaaagttcagcgtggactacacttgctctgggatctgcttttccacatgtgtgtatggcacgcctttttctgctggattgggaaggacaagattttgctgtgctagggagaaatgaaaacggggtgagctgagtagctgggtttctggaggatagaacatcagatggggaggctttccgaggtgaagaatgagagggaaccacttactagagagaaaagagctccaggcctggggaacagcacgtgcgaaggccaggagagaagaactgttgaaacaacgagaagggtggcacggctggagctgagccagcaagggggatcgtgaggagccttggggttggggagatctgcagaagcatcagaccaggcagggcctcgtacgcagtcctgaggagttttacttttattctaagacagttggggagctccaggagctgttttaagttggggagagactggattccagcctgcaaaagctgttttgtgaagactaaaaccagtgaggagaggtggaggtgctttggggacactgaaatggattcttggaaagattctgaaggctgtgttgaaaagacacctatagctgtggggacatgactataatcccagcatttggggagaccgaggctggcagatcacttaaggtcaggagtttgagaccagcctggccaacatggcgaaaccccatctctgctaaaaatacaaaaattagctgggtgcagtggtgcatgcctgtagtcccagctactcaggagactgaggcgggagaattgtttgaaccctggaggcagaggttgtagtgagtcgtgatcacacaactgcactccagcctgggcaacagaacaatactccattccctcccctctaccccaccaaaaaaaaaaaaaaatcctgcccttagatgagctctagggctgctgagtacagttgtcccagttgcacagtgcccaagggtttggcattgctaagaaggccacgtgcaaatcctagatattgagtgttgtatgtttgtgacgttggtttcccgacatgtgaatggcccaagtgtctggaagaagtggcgccactttctaatttgcttggagatgttgcatgtcccttaaattcagacaggtgcaggtaactggaggttctgaaccaaaggttaaaatgcaaattctcatacagggttgggaagttgtagccagggataagcttatgtgactgttatatggactgaggagcagatgtgaatttcgaaccatgacatggctgagggtaggggtcgggtggatggatgattcagggttgtaacccatagagcccaaaggggaagtgatctgtgacctggggtgagggtgatctggaagatttttggatggctggaaagaaatggggaagtcgagctgcctgagagagccaagttatttcccaaaagattccttaggagtctttctgttcaagacctccgtgtgtgtgtgtgtgtgtttagggttccccagcaatggcccaggcatgtgaaggaaacaagcttcttcagggaatatttgttgaatgagttttcctgactcccaggctagaactgtttttgcaatttccaccctcttttctttcccccagagaactcctattcgtccttcaaaacccatcacggaaacccctcttggagaaaaccctccttccttcccctcaggactttcccagccaccgtctctcctccagtccagcctgatgccatgggactgggggtttctctgtccagctctgtttctcccagactggggtctgaggactctcaggacccccaactttacctagcacaggctgggcacaagtgggtgacagggagtctacgcctagtggaattatgtattggggcagggtcagtgtgagaatacacatccgcatgcatgtctgtccatgtctgtccgtaccaaccttccccttccacacggacctgggcacataggaggtgtctgagcctgacacatgggacagagagtggacatggctgagacacggacagagaaaagacaaggagtccagggggctgaaagccttttgaaatcaggaagttcctgtattggcagaacaaagcccagagaggagcagggctttcctcaacgccacccagcaagtggacacagagcccggccttggatgacacctccagggttctgaaccctggacctcgctttatgcaaggagctggccccacatttccatgaatcggggaaacagcacaagaaggttggcctgtggcagggcaagggttaaaggggtgacattgagggatgcctcagagtcaaagtcccctgaccaagaggaatagagtagaaaacacagagacagagggtgagatcacgccccgatgaggacggagagagacagagatggagagagacatagaggtggaaatatacagagaaagataaatgcagagaccaaggcagggagtgtcgggggaagtaaagagggtgtcctgaagaaagaaggatctgttcactcttaccagtctgtcctcgaatgatttgcataaaatgaggaggtgcctgtccacacccccaattcctctctcaggccccagagcctgagacctcaccatgcccccatcagagatgcaaaaaactaaacacccaactagaaatccttgggacctctctcggctgggatctcagagcctttctgtcccctacccctaccccatgtgctgtcgattttgcagatggggacaacctggggcctcccggaactctgccaccctggggaagttgggggagggccttagtcccggatcacaaccccgtctgctccccagaatcctttcctaagaatcgttgaggaccaaagttgtctttgctgacacgtgttgcttttctctttgccttttattgtttcagagaaaaatcaagttgactgtgtcaagtaacaccccaccccttacccccgtccagccatagtggctctctggagacacaggtcacaggcggagggtcccctgatcatccccaaccacacagccagggggacttgacccctgtccacccctgtctcgtgctccctcagacccccacaaaccggccaagcagtccggggaggcttcccctccacacaactcttagcatgtgattgcagatgtgaaatcaaaacgttgtttgttttttgttttgttttgattctaccccgtcggtccagtgtctgcacagacgccttcatttctctgtaaatatgtgacttggaacaaatgtttaacacaaacgagaagtggtcatgaatgcatggtgttgagatgttttgcactattctgactttttggtctctgtaaaaatattttattaacagcagacattaaaaaaagaaaaaccacacacagc

SEQ ID NO: 53435 - DNA, 3749 bp, Homo sapiens
gcattgctgcgctcccgtgcccaagggagccacgcgccgcgtgcgcccggcagccggccgcccggaggcagcgcagtccgctggcatgggccccgggggcgccccgagctggggctccgggctgaggcgctaaagccgccctcccgcccgcggggccccgcgcccggcccgcccgcctgcccgcccgcggccatggccgtccggcccggcctgtggccagcgctcctgggcatagtcctcgccgcttggctccgcggctcgggtgcccagcagagtgccaccgtggccaacccagtgcctggtgccaacccggacctgcttccccacttcctggtggagcccgaggatgtgtacatcgtcaagaacaagccagtgctgcttgtgtgcaaggccgtgcccgccacgcagatcttcttcaagtgcaacggggagtgggtgcgccaggtggaccacgtgatcgagcgcagcacagacgggagcagtgggctgcccaccatggaggtccgcattaatgtctcaaggcagcaggtcgagaaggtgttcgggctggaggaatactggtgccagtgcgtggcatggagctcctcgggcaccaccaagagtcagaaggcctacatccgcatagcctatttgcgcaagaacttcgagcaggagccgctggccaaggaggtgtccctggagcagggcatcgtgctgccctgccgtccaccggagggcatccctccagccgaggtggagtggctccggaacgaggacctggtggacccgtccctggaccccaatgtatacatcacgcgggagcacagcctggtggtgcgacaggcccgccttgctgacacggccaactacacctgcgtggccaagaacatcgtggcacgtcgccgcagcgcctccgctgctgtcatcgtctacgtggacggcagctggagcccgtggagcaagtggtcggcctgtgggctggactgcacccactggcggagccgtgagtgctctgacccagcaccccgcaacggaggggaggagtgccagggcactgacctggacacccgcaactgtaccagtgacctctgtgtacacactgcttctggccctgaggacgtggccctctatgtgggcctcatcgccgtggccgtctgcctggtcctgctgctgcttgtcctcatcctcgtttattgccggaagaaggaggggctggactcagatgtggctgactcgtccattctcacctcaggcttccagcccgtcagcatcaagcccagcaaagcagacaacccccatctgctcaccatccagccggacctcagcaccaccaccaccacctaccagggcagtctctgtccccggcaggatgggcccagccccaagttccagctcaccaatgggcacctgctcagccccctgggtggcggccgccacacactgcaccacagctctcccacctctgaggccgaggagttcgtctcccgcctctccacccagaactacttccgctccctgccccgaggcaccagcaacatgacctatgggaccttcaacttcctcgggggccggctgatgatccctaatacaggaatcagcctcctcatccccccagatgccataccccgagggaagatctatgagatctacctcacgctgcacaagccggaagacgtgaggttgcccctagctggctgtcagaccctgctgagtcccatcgttagctgtggaccccctggcgtcctgctcacccggccagtcatcctggctatggaccactgtggggagcccagccctgacagctggagcctgcgcctcaaaaagcagtcgtgcgagggcagctgggaggatgtgctgcacctgggcgaggaggcgccctcccacctctactactgccagctggaggccagtgcctgctacgtcttcaccgagcagctgggccgctttgccctggtgggagaggccctcagcgtggctgccgccaagcgcctcaagctgcttctgtttgcgccggtggcctgcacctccctcgagtacaacatccgggtctactgcctgcatgacacccacgatgcactcaaggaggtggtgcagctggagaagcagctggggggacagctgatccaggagccacgggtcctgcacttcaaggacagttaccacaacctgcgcctatccatccacgatgtgcccagctccctgtggaagagtaagctccttgtcagctaccaggagatccccttttatcacatctggaatggcacgcagcggtacttgcactgcaccttcaccctggagcgtgtcagccccagcactagtgacctggcctgcaagctgtgggtgtggcaggtggagggcgacgggcagagcttcagcatcaacttcaacatcaccaaggacacaaggtttgctgagctgctggctctggagagtgaagcgggggtcccagccctggtgggccccagtgccttcaagatccccttcctcattcggcagaagataatttccagcctggacccaccctgtaggcggggtgccgactggcggactctggcccagaaactccacctggacagccatctcagcttctttgcctccaagcccagccccacagccatgatcctcaacctgtgggaggcgcggcacttccccaacggcaacctcagccagctggctgcagcagtggctggactgggccagccagacgctggcctcttcacagtgtcggaggctgagtgctgaggccggccaggcccgacacctacactctcaccagctttggcacccaccaaggacaggcagaagccggacaggggcccttccccacaccggggagagctgctcggacaggccccctcccggccgaagctgtcccttaatgctggtccttcagaccctgcccgaactcccacctctccatggcctgcctagccaggctggcactgccactcacactcggccccagggcccaggagggacagtgcctggagcctgggccaggcccagcccatctgtgtgtgtgtatgtgcgtgtgatgctacctctcctcccgtccctctccaggggccccgcatacacacggccatgcacgcacacactgggcctgggccagggccccagagctcctgcctgagctggaccttatgcaaacatttctgtgcctgctgggtaggggcacgtctgaggggccctgctccaagcctgcaggaccgagggccacagccggacagggggtagcccctggattcaggcacacgaccaccacacgagcacgtgccacgcatgcctcgtgtgctcatctcacacacacccccctcccgggtcacgcagacaccccccaaccacacacatctcatgctgtacacctgaggctgctcacgtctcacgcccagtgttggtgcacatttgcctctcacatgctgccctctccacccacccagggacaccccacggctcctccctgcccctgcccctcccccagccttgaggtgccctgcccggcggggcctgtgaatatgcaatgggagtcccaggctgtacagtggtgagtgtgtgtgtggcgtggcgtgcccgtccccagggctggctggtgccccacgcggggcctgtcatgtgaagctcgtgtcctgactttgtcttaagtgcattcacgcacttactcttggccttatgtacacagccttgcccggccgccggggcacataggggttttatcgggcgtgaatgtaaataaattatatatatatattgctaaaaaaaaaaaaaaaaaa

SEQ ID NO: 53436 - DNA, 1093 bp, Homo sapiens
ggccgcggaggaggtgcggccccaaggggaggaggtgcccgctcaccgcagaccgcccgcggcagaggccgccccggtcgcgccgcggcgggagcggccggtggaggctgcgcggccgagggggagggccgggggagcggacgtcgcctctgctggtctcccacctcccgccgccccccgcccgcaggctcccaagccttagtcggcgccgagcatcccgctgccccggaccctcccgcgggcgcgcaccaggctcaactcaggctcaggactgcaggtagacatctccactgcccaggaatcactgagcgtgcagacagcacagcctcctctgaaggccggccataccagagtcctgcctcggcatgggcctcaccattgaggcagctccactgtctgtgctggtctgagggtgctgcctgtcatgggggcagccatctcccagggggccctcatcgccatcgtctgcaacggtctcgtgggcttcttgctgctgctgctctgggtcatcctctgctgggcctgccattctcgctctgccgacgttgactctctctctgaatccagtcccaactccagccctggcccctgtcctgagaaggccccaccaccccagaagcccagccatgaaggcagctacctgctgcagccctgaaggcccctggcctagcctggagcccaggacctaagtccacctcacctagagcctggaattaggatcccagagttcagccagcctggggtccagaactcaagagtccgcctgcttggagctggacccagcggcccagagtctagccagcttggctccaataggagctcagtggccctaaggagatgggcctggggtgggggcttatgagttggtgctagagccagggccatctggactatgctccatcccaagggccaagggtcaggggccgggtccactctttccctaggctgagcacctctaggccctctaggttggggaagcaaactggaacccatggcaataataggagggtgtccaggctgggcccctcccctggtcctcccagtgtttgctggataataaatggaactatggctctacaaaaaaaaaaaaaaa

SEQ ID NO: 53437 - DNA, 2358 bp, Homo sapiens
aaaagctggaaccctgcccctttggagggggaggcggcggcggcggcggcggcggcggcggcggctgcgcgggcctcgggtgcgcgggcacgcgggactcccagctgtcaatcaggcgcgggctgagctctacgaggcggagcggcggcggtggcgacggcgatgggaccccagcgagagatctgcagctaggctggctgcacttgctccacgggtcaggggatcggagggggattgaagaatgcgccattaaaaggaaagatcaaggagtaaaccagaagaagaagaaaaagaggacttcaaagctgggaaggatgagttcttgcagcaacgtctgtgggtccaggcaggcacaggctgcagctgagggtggttaccagcgctatggagtccggtcctacctgcaccagttttatgaggactgtacagcctcaatttgggagtatgaggatgatttccagatccaaagatcacctaacaggtggagctcagtattctggaaggttggactcatctcaggtacagtttttgtgatcctcggattgactgttctggcagtgggctttcttgtgccccccaaaatcgaagcatttggcgaagccgattttgtggtggtcgacacacatgctgtccagtttaacagtgctctggacatgtacaagctggcaggagctgttctcttctgcattggaggcacgtccatggcagggtgcctgctgatgtcggtgtttgtaaagagctactccaaagaagaaaaattcctccagcagaagtttaaagaacgaatcgcagacaccaaagcccacacccagccggttacaaaagctccagggccaggggaaacaaagattccagtcactttgtccagggttcaaaatgtccagcctctactggcaacctgaaacctttcccaccccagttcttcttgtctgatttatgcccgtggttaaaaagagcaggccagttttcgagataaagaagatttggcgttgactgccctagggctgtgttcagctgtgggcaatataatgggtggactcacacttgctcagttcaggcagctctgctggagggcggtgccatgcctaagcctgtgcacatgcatccagctgcttaagatgggtgcttccttgtacccggccaccagaaaacccctggaactcctctttcatagatcgtgactttgtgttattttccgtgttgtttgaaagtgccgaacagtttagaccagctcaccaatggctaatgtggtccattttattttctaatattggtttatctaatgttttctgcgtggtgccgtcttccattcctgtctcactatgtgtaagattttgtcatatgtgttcatagaaacatggaattctctgattttgagccgaacatgagtttttagactgtatcttgacatgaggttcctgacattggatacaaagttatcagcattcacaaatctttttgttttctccattttttttccctttgagatgaagtgctgttcttttgcctaggttggagtacagcggtgaaatcatagcgcactgcagccttgaactcctgggctcaagcgatcctcccacctcagcctcccaagtagctgggactacaggcacctgccaccacccccagttaatattttttttaattttttttagaggcaggatcttgctgtccaattttttttaaaaagctaaaattgccaactttagaatcttgaccaaaaaaaattaattttaggagcatctatttatgcagtgttcaaaagtactgaattagaaaccaggaagttttagttccttctactacctgtgtgatcttggggaaattatttaacctctcagtcctaattttccccttctgtataatgggagttctggatcacaatatgtctgggctctcattacccaaacatctgagattccatttttgccatgtgtcatcgagtcgctccccaacagatgtttgtgatgtttttgtggctgtcaccatggtgggattctttcagaatgagactcctggaaattcactgagtcagcagccttcacaccatctacccttaaatatccaaccccagcaatttatacaacgctgtcatatttttaaaaaaacaaaagtaagccatcctcaaataaggaaccccttggtagatattaaccttaaaaagggttttcattctcaaacaagatgctttgttctccaacaagatgttcgtctcatcacttgcacttttgttttaatgtatggattcagattagactgagaaaaatggatggtattttcttaaaattgtgccaccttaaagcccccccccttttttttttcttccttcactggataaataaaatatgtgaacaagtg

SEQ ID NO: 53438 - DNA, 2014 bp, Homo sapiens
aggcggcttttggtcacaggctcccgagttctcctagctggggctgcggagctggggggagggaagagaggaaaggggagggggtgcctggagaggcggaggctcgcgcgcctgcgcatccagctccagggaccctaggttttctatgggattcccaatctgcagcagagatttacccgagcgtgttgcggcagcggctgggcttgcaaggcgcgatccaagagggatttaagcagcccagagctccagagaaaaagagagcgagagagaaccacacacagagacggcttaagcgtttacccgaattaaatatatatttttaaaaagaactgttgagttttatcattttcgttaagtgaccgtgcgcagcgctgtaactgcaggatggggaagcagaatagcaaactggcccctgaagtgatggaggacctggtgaagagcacagagtttaatgagcatgaactcaagcagtggtacaaaggatttctcaaggactgtccaagtgggaggctaaatctcgaggaatttcagcagctctatgtgaagttctttccttatggagacgcctccaagtttgcccagcatgccttccgaaccttcgacaagaatggggacggcaccattgacttccgagagttcatctgcgctctgtccatcacctccaggggcagctttgagcagaagctgaactgggccttcaatatgtatgacctggatggtgatggcaagatcacccgagtggagatgctggagatcatcgaggctatctacaaaatggtaggcactgtgatcatgatgaaaatgaatgaggatggcctgacgcctgagcagcgagtagacaagattttcagcaagatggataagaacaaagatgaccagattacactggatgaattcaaagaagctgcaaagagcgacccttccattgtattacttctgcagtgcgacatccagaaatgagctgatgtcaatgctatggactgcacaaaagtctcaatgttccattcagtctgcagctattcacacacacacacacacacacacacacacacacacacacacacacaaatattgcttggactacctataaatggacttgcttcttgtgtttgaaacactcgtgtgcatgagaatgtcatttgctaatgaattttaaaagcatatataaaacaaaacaaacaacctgccacaatgtgatatgtgtaatatcatttcataaaaatccctcttcctccaaagcctgggcagaaatgtgctgcaaagagttatatgacttcttgttcatgttttgctaatgctcgtatctccttgattacataatgttagtagcactgagacccccatggtaatgtaacttaattataagctatgtcactaccctcctgtaaaatactattggacagacacagagggacccttggctcctgtgtctggtccacacaccacagaagcttgtattatcagtgaatataaatgtactacatttgcatgccttttgggtttgccttaattcttacctcatttgcatcctatcgatctggaaagagctgttttggatgaatgcagtataaaatgtaaaaaccctgctaaatgacttattgattaagtatatctatctatatatacatatacacaaagatattatttatcgaaagtaaaaaagatggaagtgtattggtttctgtttgaattttcaaaggcttccaatgtggtggcaataaatgtcccaaataaatttataacaattgattttccccctaattcttattttataattttaaaattgcagcagttgctagcaacaacttactaaatctactcttaaatatacaactttggaatttgaagaattaatgacaacaaaagggaaaaaagcaactttccaacttttcatccaggctcccaaaagagggacaacgaacatggcatgtgaaaagtaaaacagatttgttcattccgaaaaaaaaatgttcattctatgacaataaattttatctcagtgtgaaaaaaaaaa

SEQ ID NO: 53439 - DNA, 2212 bp, Homo sapiens
ggcgctgcctcgtctctgctacccctggttgggcggccctgcgaagcagctccttcgggcagccccgggtcgcttagcggccaaggaggcttcagttctttgccgcctgcaaggcggagaccagaaggcggaatccacagctggcgacgcgggagcatctgctgtccaccagcggagcacaggccatcaaagccgcatctgaacttgaattctgtgcagctgattgcagagctggacccggatctgcgaccccctgtggacagaggttgaccgtaccccggagaggagctttctcacggagggcactggttgcagaggctggaagtgaaataaagacgcgctcttgtttcagagttcgtcccctgctgagataggaaggcagagccacctcctctcctctcccacctgcagattaagcttttctaaaaagcctaggcatcttcttatattcagataccctatcgtcgtcagtcatggctagcatcattgcacgtgtcggtaacagccggcggctgaatgcacccttgccgccttgggcccattccatgctgaggtccctggggagaagtctcggtcctataatggccagcatggcagacagaaacatgaagttgttctcggggagggtggtgccagcccaaggggaagaaacctttgaaaactggctgacccaagtcaatggcgtcctgccagattggaatatgtctgaggaggaaaagctcaagcgcttgatgaaaacccttaggggccctgcccgcgaggtcatgcgtgtgcttcaggcgaccaaccctaacctaagtgtggcagatttcttgcgagccatgaaattggtgtttggggagtctgaaagcagtgtgactgcccatggtaaattttttaacaccctacaagctcaaggggagaaagcctccctttatgtgatccgtttagaggtgcagctccagaacgctattcaggcaggcattatagctgagaaagatgcaaaccggactcgcttgcagcagctccttttaggcggtgagctgagtagggacctccgactcagacttaaggattttctcaggatgtatgcaaatgagcaggagcggcttcccaactttctggagttaatcagaatggtaagggaggaagaggattgggatgatgcttttattaaacggaagcgtccaaaaaggtctgagtcaatggtggagagggcagtcagccctgtggcatttcagggctccccaccgatagtgatcggcagtgctgactgcaatgtgatagagatagatgataccctcgacgactccgatgaggatgtgatcctggtggagtctcaggaccctccacttccatcctggggtgcccctcccctcagagacagggccagacctcaggatgaagtgctggtcattgattccccccacaattccagggctcagtttccttccaccagtggtggttctggctataagaataacggtcctggggagatgcgtagagccaggaagcgaaaacacacaatccgctgttcgtattgtggtgaggaaggccactcaaaagaaacctgtgacaacgagagtgacaaggcccaggtttttgagaatttgatcatcactctccaggagctgacccatactgagatggagaggtcaagagtggcccctggcgaatacaatgacttctctgagccactgtaagggaccacccccaggtttcagtgaacccttacctatattcagcatccagtagtgggaaaactggggtgggggtgggggtgggacttctaactgcatgaattaatccacaaagcggctatcttttggggtggagtagaaagggtcttggataccagcacattggagggagatagcctgacctctgtccttgctccttctccctgcagcctacgggtctgttttctgtgtgtgcccatttccttgacagctttattctttgtgaaagtggtataatttattgttaaatatttgaacaataaaaaaggtacaaaaagtgaagtacaaattacccaaatctctccacccttatataatcattgtcaaccctttgatgagtgatatttccctatacctatgtacccagatagatatatgcatagataaaagtgatgaaatataagtgctgttctatctgtattttttcaccaaacaatatatgttgtgagcttctatgtcaataaatatatatatcagcaaaaaaaaaaaaaaaa

SEQ ID NO: 53440 - DNA, 2466 bp, Homo sapiens
agttggtccgagctgccgaaaggtctggtcgcagagacaggaacgtgtaatcctcagcgtgctccagcccacagcttcgctctactgctcggcagggcagctggcctctgggcaccggcggcccctctgcctcgcggaaaagcctgatgaagtcctccgatattgatcaggatttattcacagacagttactgcaaggtgtgcagtgcacagctgatctccgaatcgcagcgtgtggcccactacgagagtcgaaaacatgcaagcaaagtccgactgtattacatgcttcaccccagggatggagggtgtcctgccaagaggctccggtcagaaaatggaagtgatgccgacatggtggataagaacaagtgctgcacactctgcaacatgtcattcacttcagcggtggtggccgattcccattatcaaggcaaaatccacgccaagaggttaaaactcttgctaggagagaagaccccattaaagaccacagcaacacccctgagcccacttaagcccccacggatggacactgctccggtggtcgcatctccctatcaaagaagagattcagacagatactgtgggctctgtgcagcctggtttaataaccctctgatggcccagcaacattatgatggcaagaaacacaaaaagaatgcggcaagagttgctttgttagaacaactggggacaaccctggatatgggggaactgagaggtctgaggcgcaattacagatgtaccatctgcagtgtctccctaaactcaatagaacagtatcatgcccatctgaaaggatctaaacaccagaccaacctgaagaataagtagtgaaagcatcaatcaagacataagaacaaaacattagcatttctctgccgtggagaattgcttatcaaccaccagaggaggcttctttcttgaacaataaacatttcttataaggattcacagattcacatacgactgatcttgatttttggaaatgaatgaggtttcttttttctttttcctttttttaattttggggtaagttatgatatttggatggatttttaaattctttcctgataacatatttagcacatgttctaaattataatcctatagcaaacagttggagcattattcaaactgaaagtggaaaaatttaaatttccaatttattctagatttcctcagagcataattattctgttaaatcctcaatgagtgtgatgtaaaccacctctatccagaaatatacattcttttctcatcatgttggacacagttgagggtgacatgcacagaactggaacagatcactattagtggaaaataccaaatggacaaataaataccagtcgttttctccgttctccaagcacaggagccaggtttaccatctgaacaatgaagacgaagggagtaaataaaggaagaattctcatcttttttcctgatcattcaaagaacagtttctcaaggttaagccaagtcctccttgcaagttgccaaataatagcttaggaaaagaattagtctgcctgcatgatgatcttcttaggcaaaaacgtcttcacagcccttgaccttggtgaatttttttccccaaaagcatccaaaagaagaattataaaccccagaacgagatggaaataaacaagtattttttttttatgatgtttggcctgaactgtgggctttaattgggggatactgatcgtttggaaagaagtgagaaaattctgaagaaatggcggccttgggctaggcggggtcccctatttcttctgtttctcactgaagtcctactgctgagccaagactcagtcactctggaaagagcatgaccgataaagaaaacagttcctttctgatggggagcgtctgagtgcagatcatgaggctctttctctaggtttaattcttttccatggtgaccggacttggtgtcttgtagcctggttacgaagtgggacgttgagcttctactgacgatgccctgcatggaccagctgggatctggctggggctgccctgtgtccctaacgaccataggcaatccatcttcttgtgtcagcaatttctggacacccactgttttccaccaagagctgaggtggcaacaactcagtgagcaataaacaaaatgacacagaaatgcacagtgttgttatgaaggagcctgtttacctgtgttcaaaatctggcaccattcccttgagcagggcccgctcaggagggaccaggtctgccagtttctgtgcctgcagagagacgaagccccacgagccacaccctactctacaagaggaaagggggttggatgggaagaatctattttgctgttttggaaagcacacagccgacctacaaacctcctgtgatggtgtttcttcggatgtgtaaaataaggctttatttgtcaattccgctgtaaaataagcattgtccgagtaaaaacagcagcaacaac

SEQ ID NO: 53441 - protein, 362 aa, Homo sapiens
MARLRDCLPRLMLTLRSLLFWSLVYCYCGLCASIHLLKLLWSLGKGPAQTFRRPAREHPPACLSDPSLGTHCYVRIKDSGLRFHYVAAGERGKPLMLLLHGFPEFWYSWRYQLREFKSEYRVVALDLRGYGETDAPIHRQNYKLDCLITDIKDILDSLGYSKCVLIGHDWGGMIAWLIAICYPEMVMKLIVINFPHPNVFTEYILRHPAQLLKSSYYYFFQIPWFPEFMFSINDFKVLKHLFTSHSTGIGRKGCQLTTEDLEAYIYVFSQPGALSGPINHYRNIFSCLPLKHHMVTTPTLLLWGENDAFMEVEMAEVTKIFVKNYFRLTILSEASHWLQQDQPDIVNKLIWTFLKEETRKKD

SEQ ID NO: 53442 - protein, 88 aa, Homo sapiens
MALQADFDRAAEDVRKLKARPDDGELKELYGLYKQAIVGDINIACPGMLDLKGKAKWEAWNLKKGLSTEDATSAYISKAKELIEKYGI

SEQ ID NO: 53443 - protein, 88 aa, Homo sapiens; identical to SEQ ID NO: 53442

SEQ ID NO: 53444 - protein, 512 aa, Homo sapiens
MDLKESPSEGSLQPSSIQIFANTSTLHGIRHIFVYGPLTIRRVLWAVAFVGSLGLLLVESSERVSYYFSYQHVTKVDEVVAQSLVFPAVTLCNLNGFRFSRLTTNDLYHAGELLALLDVNLQIPDPHLADPSVLEALRQKANFKHYKPKQFSMLEFLHRVGHDLKDMMLYCKFKGQECGHQDFTTVFTKYGKCYMFNSGEDGKPLLTTVKGGTGNGLEIMLDIQQDEYLPIWGETEETTFEAGVKVQIHSQSEPPFIQELGFGVAPGFQTFVATQEQRLTYLPPPWGECRSSEMGLDFFPVYSITACRIDCETRYIVENCNCRMVHMPGDAPFCTPEQHKECAEPALGLLAEKDSNYCLCRTPCNLTRYNKELSMVKIPSKTSAKYLEKKFNKSEKYISENILVLDIFFEALNYETIEQKKAYEVAALLGDIGGQMGLFIGASILTILELFDYIYELIKEKLLDLLGKEEDEGSHDENVSTCDTMPNHSETISHTVNVPLQTTLGTLEEIAC

SEQ ID NO: 53445 - protein, 563 aa, Homo sapiens
MSRIGGAGLPAAALTGPGRFRMAREEPAPAALAAAGQPGGGRGGERALQGPGVARRGRPSLSRAKLHGLRHMCAGRTAAGGSFQRRALWVLAFCTSFGLLLSWSSNRLLYWLSFPSHTRVHREWSRQLPFPAVTVCNNNPLRFPRLSKGDLYYAGHWLGLLLPNRTARPLVSELLRGDEPRRQWFRKLADFRLFLPPRHFEGISAAFMDRLGHQLEDMLLSCKYRGELCGPHNFSSVFTKYGKCYMFNSGEDGKPLLTTVKGGTGNGLEIMLDIQQDEYLPIWGETEETTFEAGVKVQIHSQSEPPFIQELGFGVAPGFQTFVATQEQRLTYLPPPWGECRSSEMGLDFFPVYSITACRIDCETRYIVENCNCRMVHMPGDAPFCTPEQHKECAEPALGLLAEKDSNYCLCRTPCNLTRYNKELSMVKIPSKTSAKYLEKKFNKSEKYISENILVLDIFFEALNYETIEQKKAYEVAALLGDIGGQMGLFIGASILTILELFDYIYELIKEKLLDLLGKEEDEGSHDENVSTCDTMPNHSETISHTVNVPLQTTLGTLEEIAC

SEQ ID NO: 53446 - protein, 724 aa, Homo sapiens
MPRNSGAGYGCPHGDPSMLDSRETPQESRQDMIVRTTQEKLKTSSLTDRQPLSKESLNHALELSVPEKVNNAQWDAPEEALWTTRADGRVRLRIDPSCPQLPYTVHRMFYEALDKYGDLIALGFKRQDKWEHISYSQYYLLARRAAKGFLKLGLKQAHSVAILGFNSPEWFFSAVGTVFAGGIVTGIYTTSSPEACQYIAYDCCANVIMVDTQKQLEKILKIWKQLPHLKAVVIYKEPPPNKMANVYTMEEFMELGNEVPEEALDAIIDTQQPNQCCVLVYTSGTTGNPKGVMLSQDNITWTARYGSQAGDIRPAEVQQEVVVSYLPLSHIAAQIYDLWTGIQWGAQVCFAEPDALKGSLVNTLREVEPTSHMGVPRVWEKIMERIQEVAAQSGFIRRKMLLWAMSVTLEQNLTCPGSDLKPFTTRLADYLVLAKVRQALGFAKCQKNFYGAAPMMAETQHFFLGLNIRLYAGYGLSETSGPHFMSSPYNYRLYSSGKLVPGCRVKLVNQDAEGIGEICLWGRTIFMGYLNMEDKTCEAIDEEGWLHTGDAGRLDADGFLYITGRLKELIITAGGENVPPVPIEEAVKMELPIISNAMLIGDQRKFLSMLLTLKCTLDPDTSDQTDNLTEQAMEFCQRVGSRATTVSEIIEKKDEAVYQAIEEGIRRVNMNAAARPYHIQKWAILERDFSISGGELGPTMKLKRLTVLEKYKGIIDSFYQEQKM

SEQ ID NO: 53447 - protein, 426 aa, Homo sapiens
MSGGVYGGDEVGALVFDIGSFSVRAGYAGEDCPKADFPTTVGLLAAEEGGGLELEGDKEKKGKIFHIDTNALHVPRDGAEVMSPLKNGMIEDWECFRAILDHTYSKHVKSEPNLHPVLMSEAPWNTRAKREKLTELMFEQYNIPAFFLCKTAVLTAFANGRSTGLVLDSGATHTTAIPVHDGYVLQQGIVKSPLAGDFISMQCRELFQEMAIDIIPPYMIAAKEPVREGAPPNWKKKEKLPQVSKSWHNYMCNEVIQDFQASVLQVSDSPYDEQVAAQMPTVHYEMPNGYNTDYGAERLRIPEGLFDPSNVKGLSGNTMLGVGHVVTTSIGMCDIDIRPGLYGSVIVTGGNTLLQGFTDRLNRELSQKTPPSMRLKLIASNSTMERKFSPWIGGSILASLGTFQQMWISKQEYEEGGKQCVERKCP

SEQ ID NO: 53448 - protein, 769 aa, Homo sapiens
MRLLRRWAFAALLLSLLPTPGLGTQGPAGALRWGGLPQLGGPGAPEVTEPSRLVRESSGGEVRKQQLDTRVRQEPPGGPPVHLAQVSFVIPAFNSNFTLDLELNHHLLSSQYVERHFSREGTTQHSTGAGDHCYYQGKLRGNPHSFAALSTCQGLHGVFSDGNLTYIVEPQEVAGPWGAPQGPLPHLIYRTPLLPDPLGCREPGCLFAVPAQSAPPNRPRLRRKRQVRRGHPTVHSETKYVELIVINDHQLFEQMRQSVVLTSNFAKSVVNLADVIYKEQLNTRIVLVAMETWADGDKIQVQDDLLETLARLMVYRREGLPEPSDATHLFSGRTFQSTSSGAAYVGGICSLSHGGGVNEYGNMGAMAVTLAQTLGQNLGMMWNKHRSSAGDCKCPDIWLGCIMEDTGFYLPRKFSRCSIDEYNQFLQEGGGSCLFNKPLKLLDPPECGNGFVEAGEECDCGSVQECSRAGGNCCKKCTLTHDAMCSDGLCCRRCKYEPRGVSCREAVNECDIAETCTGDSSQCPPNLHKLDGYYCDHEQGRCYGGRCKTRDRQCQVLWGHAAADRFCYEKLNVEGTERGSCGRKGSGWVQCSKQDVLCGFLLCVNISGAPRLGDLVGDISSVTFYHQGKELDCRGGHVQLADGSDLSYVEDGTACGPNMLCLDHRCLPASAFNFSTCPGSGERRICSHHGVCSNEGKCICQPDWTGKDCSIHNPLPTSPPTGETERYKGPSGTNIIIGSIAGAVLVAAIVLGGTGWGFKNIRRGRSGGA

SEQ ID NO: 53449 - protein, 1311 aa, Homo sapiens
MDLFDFFRDWDLEQQCHYEQDRSALKKREWERRNQEVQQEDDLFSSGFDLFGEPYKVAEYTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVASSLLAPSSGLSVQNFPPGLYCKTSMGQQKPTAYVRPMDGQDQAPDISPTLKPSIEFENSFGNLSFGTLLDGKPSAASSKTKLPKFTILQTSEVSLPSDPSCVEEILREMTHSWPTPLTSMHTAGHSEQSTFSIPGQESQHLTPGFTLQKWNDPTTRASTKSVSFKSMLEDDLKLSSDEDDLEPVKTLTTQCTATELYQAVEKAKPRNNPVNPPLATPQPPPAVQASGGSGSSSESESSSESDSDTESSTTDSESNEAPRVATPEPEPPSTNKWQLDKWLNKVTSQNKSFICGQNETPMETISLPPPIIQPMEVQMKVKTNASQVPAEPKERPLLSLIREKARPRPTQKIPETKALKHKLSTTSETVSQRTIGKKQPKKVEKNTSTDEFTWPKPNITSSTPKEKESVELHDPPRGRNKATAHKPAPRKEPRPNIPLAPEKKKYRGPGKIVPKSREFIETDSSTSDSNTDQEETLQIKVLPPCIISGGNTAKSKEICGASLTLSTLMSSSGSNNNLSISNEEPTFSPIPVMQTEILSPLRDHENLKNLWVKIDLDLLSRVPGHSSLHAAPAKPDHKETATKPKRQTAVTAVEKPAPKGKRKHKPIEVAEKIPEKKQRLEEATTICLLPPCISPAPPHKPPNTRENNSSRRANRRKEEKLFPPPLSPLPEDPPRRRNVSGNNGPFGQDKNIAMTGQITSTKPKRTEGKFCATFKGISVNEGDTPKKASSATITVTNTAIATATVTATAIVTTTVTATATATATTTTTTTTISTITSTITTGLMDSSHLEMTSWAALPLLSSSSTNVRRPKLTFDDSVHNADYYMQEAKKLKHKADALFEKFGKAVNYADAALSFTECGNAMERDPLEAKSPYTMYSETVELLRYAMRLKNFASPLASDGDKKLAVLCYRCLSLLYLRMFKLKKDHAMKYSRSLMEYFKQNASKVAQIPSPWVSNGKNTPSPVSLNNVSPINAMGNCNNGPVTIPQRIHHMAASHVNITSNVLRGYEHWDMADKLTRENKEFFGDLDTLMGPLTQHSSMTNLVRYVRQGLCWLRIDAHLL

SEQ ID NO: 53450 - protein, 499 aa, Homo sapiens
MCELYSKRDTLGLRKKHIGPSCKVFFASDPIKIVRAQRQYMFDENGEQYLDCINNVAHVGHCHPGVVKAALKQMELLNTNSRFLHDNIVEYAKRLSATLPEKLSVCYFTNSGSEANDLALRLARQFRGHQDVITLDHAYHGHLSSLIEISPYKFQKGKDVKKEFVHVAPTPDTYRGKYREDHADSASAYADEVKKIIEDAHNSGRKIAAFIAESMQSCGGQIIPPAGYFQKVAEYVHGAGGVFIADEVQVGFGRVGKHFWSFQMYGEDFVPDIVTMGKPMGNGHPVACVVTTKEIAEAFSSSGMEYFNTYGGNPVSCAVGLAVLDIIENEDLQGNAKRVGNYLTELLKKQKAKHTLIGDIRGIGLFIGIDLVKDHLKRTPATAEAQHIIYKMKEKRVLLSADGPHRNVLKIKPPMCFTEEDAKFMVDQLDRILTVLEEAMGTKTESVTSENTPCKTKMLKEAHIELLRDSTTDSKENPSRKRNGMCTDTHSLLSKRLKT

SEQ ID NO: 53451 - protein, 536 aa, Homo sapiens
MCSKPEDPVEYLESCLQKVKELGGCDKVKWDTFVSQEKKTLPPLNGGQSRRSFLRNVMPENSNFPYRRYDRLPPIHQFSIESDTDLSETAELIEEYEVFDPTRPRPKIILVIGGPGSGKGTQSLKIAERYGFQYISVGELLRKKIHSTSSNRKWSLIAKIITTGELAPQETTITEIKQKLMQIPDEEGIVIDGFPRDVAQALSFEDQICTPDLVVFLACANQRLKERLLKRAEQQGRPDDNVKATQRRLMNFKQNAAPLVKYFQEKGLIMTFDADRDEDEVFYDISMAVDNKLFPNKEAAAGSSDLDPSMILDTGEIIDTGSDYEDQGDDQLNVFGEDTMGGFMEDLRKCKIIFIIGGPGSGKGTQCEKLVEKYGFTHLSTGELLREELASESERSKLIRDIMERGDLVPSGIVLELLKEAMVASLGDTRGFLIDGYPREVKQGEEFGRRIGDPQLVICMDCSADTMTNRLLQRSRSSLPVDDTTKTIAKRLEAYYRASIPVIAYYETKTQLHKINAEGTPEDVFLQLCTAIDSIF

SEQ ID NO: 53452 - protein, 562 aa, Homo sapiens
MNTNDAKEYLARREIPQLFESLLNGLMCSKPEDPVEYLESCLQKVKELGGCDKVKWDTFVSQEKKTLPPLNGGQSRRSFLRNVMPENSNFPYRRYDRLPPIHQFSIESDTDLSETAELIEEYEVFDPTRPRPKIILVIGGPGSGKGTQSLKIAERYGFQYISVGELLRKKIHSTSSNRKWSLIAKIITTGELAPQETTITEIKQKLMQIPDEEGIVIDGFPRDVAQALSFEDQICTPDLVVFLACANQRLKERLLKRAEQQGRPDDNVKATQRRLMNFKQNAAPLVKYFQEKGLIMTFDADRDEDEVFYDISMAVDNKLFPNKEAAAGSSDLDPSMILDTGEIIDTGSDYEDQGDDQLNVFGEDTMGGFMEDLRKCKIIFIIGGPGSGKGTQCEKLVEKYGFTHLSTGELLREELASESERSKLIRDIMERGDLVPSGIVLELLKEAMVASLGDTRGFLIDGYPREVKQGEEFGRRIGDPQLVICMDCSADTMTNRLLQRSRSSLPVDDTTKTIAKRLEAYYRASIPVIAYYETKTQLHKINAEGTPEDVFLQLCTAIDSIF

SEQ ID NO: 53453 - protein, 264 aa, Homo sapiens
MRKLFSFGRRLGQALLDSMDQEYAGRGYHIRDWELRKIHRAAIKGDAAEVEHCLTRRFRDLDARDRKDRTVLHLTCAHGRVEVVTLLLSRRCQINIYDRLNRTPLMKAVHCQEEACAIILLEHGANPNIKDIYSNTALHYAVYNKGTSLAEKLLSHHANIEALNEEGNTPLLFAINSRRQQIVEFLLKNQANLHAIDNFRRTALMLAVQHNSSSIVSLLLQQNINIFSQDLFGQTAEDYAVCYNFRSIQQQILEHKNKILKSHL

SEQ ID NO: 53454 - protein, 332 aa, Homo sapiens
MLPVRCVPAPATLRLRAEEPGLRRQLSEEPSPRSSPLLLRRLSVEESGLGLGLGPGRSPHLRRLSRAGPRLLSPDAEELPAAPPPSAVPLEPSEHEWLVRTAGGRWTHQLHGLLLRDRGLAAKRDFMSGFTALHWAAKSGDGEMALQLVEVARRSGAPVDVNARSHGGYTPLHLAALHGHEDAAVLLVVRLGAQVHVRDHSGRRAYQYLRPGSSYALRRLLGDPGLRGTTEPDATGGGSGSLAARRPVQVAATILSSTTSAFLGVLADDLMLQDLARGLKKSSSFSKFLSASPMAPRKKTKIRGGLPAFSEISRRPTPGPLAGLVPSLPPTT

SEQ ID NO: 53455 - protein, 510 aa, Homo sapiens
MMWQCHLSAQDYRYYPVDGYSLLKRFPLHPLTGPRCPVQTVGQWLESIGLPQYENHLMANGFDNVQFMGSNVMEDQDLLEIGILNSGHRQRILQAIQLLPKMRPIGHDGYHPTSVAEWLDSIELGDYTKAFLINGYTSMDLLKKIWEVELINVLKINLIGHRKRILASLGDRLHDDPPQKPPRSITLREPSGNHTPPQLSPSLSQSTYTTGGSLDVPHIIMQGDARRRRNENYFDDIPRSKLERQMAQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVQIDPSEQKTLANLPWIVEPGQEAKRGINTKYETTIF

SEQ ID NO: 53456 - protein, 837 aa, Homo sapiens
MNHLEGSAEVEVTDEAAGGEVNESVEADLEHPEVEEEQQQPPQQQHYVGRHQRGRALEDLRAQLGQEEEERGECLARSASTESGFHNHTDTAEGDVIAAARDGYDAERAQDPEDESAYAVQYRPEAEEYTEQAEAEHAEATHRRALPNHLHFHSLEHEEAMNAAYSGYVYTHRLFHRGEDEPYSEPYADYGGLQEHVYEEIGDAPELDARDGLRLYEQERDEAAAYRQEALGARLHHYDERSDGESDSPEKEAEFAPYPRMDSYEQEEDIDQIVAEVKQSMSSQSLDKAAEDMPEAEQDLERPPTPAGGRPDSPGLQAPAGQQRAVGPAGGGEAGQRYSKEKRDAISLAIKDIKEAIEEVKTRTIRSPYTPDEPKEPIWVMRQDISPTRDCDDQRPMDGDSPSPGSSSPLGAESSSTSLHPSDPVEASTNKESRKSLASFPTYVEVPGPCDPEDLIDGIIFAANYLGSTQLLSDKTPSKNVRMMQAQEAVSRIKMAQKLAKSRKKAPEGESQPMTEVDLFISTQRIKVLNADTQETMMDHPLRTISYIADIGNIVVLMARRRMPRSNSQENVEASHPSQDGKRQYKMICHVFESEDAQLIAQSIGQAFSVAYQEFLRANGINPEDLSQKEYSDLLNTQDMYNDDLIHFSKSENCKDVFIEKQKGEILGVVIVESGWGSILPTVIIANMMHGGPAEKSGKLNIGDQIMSINGTSLVGLPLSTCQSIIKGLKNQSRVKLNIVRCPPVTTVLIRRPDLRYQLGFSVQNGIICSLMRGGIAERGGVRVGHRIIEINGQSVVATPHEKIVHILSNAVGEIHMKTMPAAMYRLLTAQEQPVYI

SEQ ID NO: 53457 - protein, 749 aa, Homo sapiens
MAHRKLESVGSGMLDHRVRPGPVPHSQEPESEDMELPLEGYVPEGLELAALRPESPAPEEQECHNHSPDGDSSSDYVNNTSEEEDYDEGLPEEEEGITYYIRYCPEDDSYLEGMDCNGEEYLAHSAHPVDTDECQEAVEEWTDSAGPHPHGHEAEGSQDYPDGQLPIPEDEPSVLEAHDQEEDGHYCASKEGYQDYYPEEANGNTGASPYRLRRGDGDLEDQEEDIDQIVAEIKMSLSMTSITSASEASPEHGPEPGPEDSVEACPPIKASCSPSRHEARPKSLNLLPEAKHPGDPQRGFKPKTRTPEERLKWPHEQVCNGLEQPRKQQRSDLNGPVDNNNIPETKKVASFPSFVAVPGPCEPEDLIDGIIFAANYLGSTQLLSERNPSKNIRMMQAQEAVSRVKRMQKAAKIKKKANSEGDAQTLTEVDLFISTQRIKVLNADTQETMMDHALRTISYIADIGNIVVLMARRRMPRSASQDCIETTPGAQEGKKQYKMICHVFESEDAQLIAQSIGQAFSVAYQEFLRANGINPEDLSQKEYSDIINTQEMYNDDLIHFSNSENCKELQLEKHKGEILGVVVVESGWGSILPTVILANMMNGGPAARSGKLSIGDQIMSINGTSLVGLPLATCQGIIKGLKNQTQVKLNIVSCPPVTTVLIKRPDLKYQLGFSVQNGIICSLMRGGIAERGGVRVGHRIIEINGQSVVATAHEKIVQALSNSVGEIHMKTMPAAMFRLLTGQETPLYI

SEQ ID NO: 53458 - protein, 2303 aa, Homo sapiens
MASSVAPYEQLVRQVEALKAENSHLRQELRDNSSHLSKLETETSGMKEVLKHLQGKLEQEARVLVSSGQTEVLEQLKALQMDITSLYNLKFQPPTLGPEPAARTPEGSPVHGSGPSKDSFGELSRATIRLLEELDRERCFLLNEIEKEEKEKLWYYSQLQGLSKRLDELPHVETQFSMQMDLIRQQLEFEAQHIRSLMEERFGTSDEMVQRAQIRASRLEQIDKELLEAQDRVQQTEPQALLAVKSVPVDEDPETEVPTHPEDGTPQPGNSKVEVVFWLLSMLATRDQEDTARTLLAMSSSPESCVAMRRSGCLPLLLQILHGTEAAAGGRAGAPGAPGAKDARMRANAALHNIVFSQPDQGLARKEMRVLHVLEQIRAYCETCWDWLQARDGGPEGGGAGSAPIPIEPQICQATCAVMKLSFDEEYRRAMNELGGLQAVAELLQVDYEMHKMTRDPLNLALRRYAGMTLTNLTFGDVANKATLCARRGCMEAIVAQLASDSEELHQVVSSILRNLSWRADINSKKVLREAGSVTALVQCVLRATKESTLKSVLSALWNLSAHSTENKAAICQVDGALGFLVSTLTYKCQSNSLAIIESGGGILRNVSSLVATREDYRQVLRDHNCLQTLLQHLTSHSLTIVSNACGTLWNLSARSARDQELLWDLGAVGMLRNLVHSKHKMIAMGSAAALRNLLAHRPAKHQAAATAVSPGSCVPSLYVRKQRALEAELDARHLAQALEHLEKQGPPAAEAATKKPLPPLRHLDGLAQDYASDSGCFDDDDAPSSLAAAAATGEPASPAALSLFLGSPFLQGQALARTPPTRRGGKEAEKDTSGEAAVAAKAKAKLALAVARIDQLVEDISALHTSSDDSFSLSSGDPGQEAPREGRAQSCSPCRGPEGGRREAGSRAHPLLRLKAAHASLSNDSLNSGSASDGYCPREHMLPCPLAALASRREDPRCGQPRPSRLDLDLPGCQAEPPAREATSADARVRTIKLSPTYQHVPLLEGASRAGAEPLAGPGISPGARKQAWLPADHLSKVPEKLAAAPLSVASKALQKLAAQEGPLSLSRCSSLSSLSSAGRPGPSEGGDLDDSDSSLEGLEEAGPSEAELDSTWRAPGATSLPVAIPAPRRNRGRGLGVEDATPSSSSENYVQETPLVLSRCSSVSSLGSFESPSIASSIPSEPCSGQGSGTISPSELPDSPGQTMPPSRSKTPPLAPAPQGPPEATQFSLQWESYVKRFLDIADCRERCRLPSELDAGSVRFTVEKPDENFSCASSLSALALHEHYVQQDVELRLLPSACPERGGGAGGAGLHFAGHRRREEGPAPTGSRPRGAADQELELLRECLGAAVPARLRKVASALVPGRRALPVPVYMLVPAPAPAQEDDSCTDSAEGTPVNFSSAASLSDETLQGPPRDQPGGPAGRQRPTGRPTSARQAMGHRHKAGGAGRSAEQSRGAGKNRAGLELPLGRPPSAPADKDGSKPGRTRGDGALQSLCLTTPTEEAVYCFYGNDSDEEPPAAAPTPTHRRTSAIPRAFTRERPQGRKEAPAPSKAAPAAPPPARTQPSLIADETPPCYSLSSSASSLSEPEPSEPPAVHPRGREPAVTKDPGPGGGRDSSPSPRAAEELLQRCISSALPRRRPPVSGLRRRKPRATRLDERPAEGSRERGEEAAGSDRASDLDSVEWRAIQEGANSIVTWLHQAAAATREASSESDSILSFVSGLSVGSTLQPPKHRKGRQAEGEMGSARRPEKRGAASVKTSGSPRSPAGPEKPRGTQKTTPGVPAVLRGRTVIYVPSPAPRAQPKGTPGPRATPRKVAPPCLAQPAAPAKVPSPGQQRSRSLHRPAKTSELATLSQPPRSATPPARLAKTPSSSSSQTSPASQPLPRKRPPVTQAAGALPGPGASPVPKTPARTLLAKQHKTQRSPVRIPFMQRPARRGPPPLARAVPEPGPRGRAGTEAGPGARGGRLGLVRVASALSSGSESSDRSGFRRQLTFIKESPGLRRRRSELSSAESAASAPQGASPRRGRPALPAVFLCSSRCEELRAAPRQGPAPARQRPPAARPSPGERPARRTTSESPSRLPVRAPAARPETVKRYASLPHISVARRPDGAVPAAPASADAARRSSDGEPRPLPRVAAPGTTWRRIRDEDVPHILRSTLPATALPLRGSTPEDAPAGPPPRKTSDAVVQTEEVAAPKTNSSTSPSLETREPPGAPAGGQLSLLGSDVDGPSLAKAPISAPFVHEGLGVAVGGFPASRHGSPSRSARVPPFNYVPSPMVVAATTDSAAEKAPATASATLLE

SEQ ID NO: 53459 - protein, 164 aa, Homo sapiens
MEEEAETEEQQRFSYQQRLKAAVHYTVGCLCEEVALDKEMQFSKQTIAAISELTFRQCENFAKDLEMFARHAKRTTINTEDVKLLARRSNSLHMQEAAGIRKSSLLTFLAWWFEWTSQASAGPLIGEEAREVARRQEGAPPQQSARRDRMPCRNFFWKTFSSCK

SEQ ID NO: 53460 - protein, 225 aa, Homo sapiens
MLGLDACELGAQLLELLRLALCARVLLADKEGGPPAVDEVLDEAVPEYRAPGRKSLLEIRQLDPDDRSLAKYKRVLLGPLPPAVDPSLPNVQVTRLTLLSEQAPGPVVMDLTGDLAVLKDQVFVLKEGVDYRVKISFKVHREIVSGLKCLHHTYRRGLRVDKTVYMVGSYGPSAQEYEFVTPVEEAPRGALVRGPYLVVSLFTDDDRTHHLSWEWGLCICQDWKD

SEQ ID NO: 53461 - protein, 782 aa, Homo sapiens
MNSAEQTVTWLITLGVLESPKKTISDPEGFLQASLKDGVVLCRLLERLLPGTIEKVYPEPRSESECLSNIREFLRGCGASLRLETFDANDLYQGQNFNKVLSSLVTLNKVTADIGLGSDSVCARPSSHRIKSFDSLGSQSLHTRTSKLFQGQYRSLDMTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHSEELGEFMETKGASSPGILVLTTGLSKPFMRLDKYPTLLKELERHMEDYHTDRQDIQKSMAAFKNLSAQCQEVRKRKELELQILTEAIRNWEGDDIKTLGNVTYMSQVLIQCAGSEEKNERYLLLFPNVLLMLSASPRMSGFIYQGKLPTTGMTITKLEDSENHRNAFEISGSMIERILVSCNNQQDLQEWVEHLQKQTKVTSVGNPTIKPHSVPSHTLPSHPVTPSSKHADSKPAPLTPAYHTLPHPSHHGTPHTTINWGPLEPPKTPKPWSLSCLRPAPPLRPSAALCYKEDLSKSPKTMKKLLPKRKPERKPSDEEFASRKSTAALEEDAQILKVIEAYCTSAKTRQTLNSTWQGTDLMHNHVLADDDQPSLDSLGRRSSLSRLEPSDLSEDSDYDSIWTAHSYRMGSTSRKSCCSYISHQN

SEQ ID NO: 53462 - protein, 717 aa, Homo sapiens
MATPAAVNPPEMASDIPGSVTLPVAPMAATGQVRMAGAMPARGGKRRSGMDFDDEDGEGPSKFSRENHSEIERRRRNKMTQYITELSDMVPTCSALARKPDKLTILRMAVSHMKSMRGTGNKSTDGAYKPSFLTEQELKHLILEAADGFLFVVAAETGRVIYVSDSVTPVLNQPQSEWFGSTLYEQVHPDDVEKLREQLCTSENSMTGRILDLKTGTVKKEGQQSSMRMCMGSRRSFICRMRCGNAPLDHLPLNRITTMRKRFRNGLGPVKEGEAQYAVVHCTGYIKAWPPAGMTIPEEDADVGQGSKYCLVAIGRLQVTSSPVCMDMNGMSVPTEFLSRHNSDGIITFVDPRCISVIGYQPQDLLGKDILEFCHPEDQSHLRESFQQVVKLKGQVLSVMYRFRTKNREWMLIRTSSFTFQNPYSDEIEYIICTNTNVKQLQQQQAELEVHQRDGLSSYDLSQVPVPNLPAGVHEAGKSVEKADAIFSQERDPRFAEMFAGISASEKKMMSSASAAGTQQIYSQGSPFPSGHSGKAFSSSVVHVPGVNDIQSSSSTGQNMSQISRQLNQSQVAWTGSRPPFPGQQIPSQSSKTQSSPFGIGTSHTYPADPSSYSPLSSPATSSPSGNAYSSLANRTPGFAESGQSSGQFQGRPSEVWSQWQSQHHGQQSGEQHSHQQPGQTEVFQDMLPMPGDPTQGTGNYNIEDFADLGMFPPFSE

SEQ ID NO: 53463 - protein, 390 aa, Homo sapiens
MKEGRGSFSVERGPRKERETAQSGMWKGNSPAGSQGAAMEGTGGELGGQGNWGPEDAPGLLARASLIMLPWPLPLASSALTLLFGALTSLFLWYCYRLGSQDMQALGAGSRAGGVRGGPVGCSEAGGPSPGGPGDPGEGPRTEGLVSRRLRAYARRYSWAGMGRVRRAAQGGPGPGRGPGVLGIQRPGLLFLPDLPSAPFVPRDAQRHDVELLESSFPAILRDFGAVSWDFSGTTPPPRGWSPPLAPGCYQLLLYQAGRCQPSNCRRCPGAYRALRGLRSFMSANTFGNAGFSVLLPGARLEGRCGPTNARVRCHLGLKIPPGCELVVGGEPQCWAEGHCLLVDDSFLHTVAHNGSPEDGPRVVFIVDLWHPNVAGAERQALDFVFAPDP

SEQ ID NO: 53464 - protein, 1013 aa, Homo sapiens
MGDKKDDKDSPKKNKGKERRDLDDLKKEVAMTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 53465 - protein, 334 aa, Homo sapiens
MPKRRDILAIVLIVLPWTLLITVWHQSTLAPLLAVHKDEGSDPRRETPPGADPREYCTSDRDIVEVVRTEYVYTRPPPWSDTLPTIHVVTPTYSRPVQKAELTRMANTLLHVPNLHWLVVEDAPRRTPLTARLLRDTGLNYTHLHVETPRNYKLRGDARDPRIPRGTMQRNLALRWLRETFPRNSSQPGVVYFADDDNTYSLELFEEMRSTRRVSVWPVAFVGGLRYEAPRVNGAGKVVGWKTVFDPHRPFAIDMAGFAVNLRLILQRSQAYFKLRGVKGGYQESSLLRELVTLNDLEPKAANCTKILVWHTRTEKPVLVNEGKKGFTDPSVEI

SEQ ID NO: 53466 - protein, 334 aa, Homo sapiens; identical to SEQ ID NO: 53465

SEQ ID NO: 53467 - protein, 1584 aa, Homo sapiens
MRGQAAAPGPVWILAPLLLLLLLLGRRARAAAGADAGPGPEPCATLVQGKFFGYFSAAAVFPANASRCSWTLRNPDPRRYTLYMKVAKAPVPCSGPGRVRTYQFDSFLESTRTYLGVESFDEVLRLCDPSAPLAFLQASKQFLQMRRQQPPQHDGLRPRAGPPGPTDDFSVEYLVVGNRNPSRAACQMLCRWLDACLAGSRSSHPCGIMQTPCACLGGEAGGPAAGPLAPRGDVCLRDAVAGGPENCLTSLTQDRGGHGATGGWKLWSLWGECTRDCGGGLQTRTRTCLPAPGVEGGGCEGVLEEGRQCNREACGPAGRTSSRSQSLRSTDARRREELGDELQQFGFPAPQTGDPAAEEWSPWSVCSSTCGEGWQTRTRFCVSSSYSTQCSGPLREQRLCNNSAVCPVHGAWDEWSPWSLCSSTCGRGFRDRTRTCRPPQFGGNPCEGPEKQTKFCNIALCPGRAVDGNWNEWSSWSACSASCSQGRQQRTRECNGPSYGGAECQGHWVETRDCFLQQCPVDGKWQAWASWGSCSVTCGAGSQRRERVCSGPFFGGAACQGPQDEYRQCGTQRCPEPHEICDEDNFGAVIWKETPAGEVAAVRCPRNATGLILRRCELDEEGIAYWEPPTYIRCVSIDYRNIQMMTREHLAKAQRGLPGEGVSEVIQTLVEISQDGTSYSGDLLSTIDVLRNMTEIFRRAYYSPTPGDVQNFVQILSNLLAEENRDKWEEAQLAGPNAKELFRLVEDFVDVIGFRMKDLRDAYQVTDNLVLSIHKLPASGATDISFPMKGWRATGDWAKVPEDRVTVSKSVFSTGLTEADEASVFVVGTVLYRNLGSFLALQRNTTVLNSKVISVTVKPPPRSLRTPLEIEFAHMYNGTTNQTCILWDETDVPSSSAPPQLGPWSWRGCRTVPLDALRTRCLCDRLSTFAILAQLSADANMEKATLPSVTLIVGCGVSSLTLLMLVIIYVSVWRYIRSERSVILINFCLSIISSNALILIGQTQTRNKVMCTLVAAFLHFFFLSSFCWVLTEAWQSYMAVTGHLRNRLIRKRFLCLGWGLPALVVAISVGFTKAKGYSTMNYCWLSLEGGLLYAFVGPAAAVVLVNMVIGILVFNKLVSKDGITDKKLKERAGASLWSSCVVLPLLALTWMSAVLAVTDRRSALFQILFAVFDSLEGFVIVMVHCILRREVQDAVKCRVVDRQEEGNGDSGGSFQNGHAQLMTDFEKDVDLACRSVLNKDIAACRTATITGTLKRPSLPEEEKLKLAHAKGPPTNFNSLPANVSKLHLHGSPRYPGGPLPDFPNHSLTLKRDKAPKSSFVGDGDIFKKLDSELSRAQEKALDTSYVILPTATATLRPKPKEEPKYSIHIDQMPQTRLIHLSTAPEASLPARSPPSRQPPSGGPPEAPPAQPPPPPPPPPPPPQQPLPPPPNLEPAPPSLGDPGEPAAHPGPSTGPSTKNENVATLSVSSLERRKSRYAELDFEKIMHTRKRHQDMFQDLNRKLQHAAEKDKEVLGPDSKPEKQQTPNKRPWESLRKAHGTPTWVKKELEPLQPSPLELRSVEWERSGATIPLVGQDIIDLQTEV

SEQ ID NO: 53468 - protein, 1572 aa, Homo sapiens
MTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGSERCPWASLLLPCSACGAVPSPLLSSASARNAMASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEVMHTRKRHSELYHELNQKFHTFDRYRSQSTAKREKRWSVSSGGAAERSVCTDKPSPGERPSLSQHRRHQSWSTFKSMTLGSLPPKPRERLTLHRAAAWEPTEPPDGDFQTEV

SEQ ID NO: 53469 - protein, 521 aa, Homo sapiens
MSLSRSEEMHRLTENVYKTIMEQFNPSLRNFIAMGKNYEKALAGVTYAAKGYFDALVKMGELASESQGSKELGDVLFQMAEVHRQIQNQLEEMLKSFHNELLTQLEQKVELDSRYLSAALKKYQTEQRSKGDALDKCQAELKKLRKKSQGSKNPQKYSDKELQYIDAISNKQGELENYVSDGYKTALTEERRRFCFLVEKQCAVAKNSAAYHSKGKELLAQKLPLWQQACADPSKIPERAVQLMQQVASNGATLPSALSASKSNLVISDPIPGAKPLPVPPELAPFVGRMSAQESTPIMNGVTGPDGEDYSPWADRKAAQPKSLSPPQSQSKLSDSYSNTLPVRKSVTPKNSYATTENKTLPRSSSMAAGLERNGRMRVKAIFSHAAGDNSTLLSFKEGDLITLLVPEARDGWHYGESEKTKMRGWFPFSYTRVLDSDGSDRLHMSLQQGKSSSTGNLLDKDDLAIPPPDYGAASRAFPAQTASGFKQRPYSVAVPAFSQGLDDYGARSMSSGSGTLVSTV

SEQ ID NO: 53470 - protein, 671 aa, Homo sapiens
MAQLFLPLLAALVLAQAPAALADVLEGDSSEDRAFRVRIAGDAPLQGVLGGALTIPCHVHYLRPPPSRRAVLGSPRVKWTFLSRGREAEVLVARGVRVKVNEAYRFRVALPAYPASLTDVSLALSELRPNDSGIYRCEVQHGIDDSSDAVEVKVKGVVFLYREGSARYAFSFSGAQEACARIGAHIATPEQLYAAYLGGYEQCDAGWLSDQTVRYPIQTPREACYGDMDGFPGVRNYGVVDPDDLYDVYCYAEDLNGELFLGDPPEKLTLEEARAYCQERGAEIATTGQLYAAWDGGLDHCSPGWLADGSVRYPIVTPSQRCGGGLPGVKTLFLFPNQTGFPNKHSRFNVYCFRDSAQPSAIPEASNPASNPASDGLEAIVTVTETLEELQLPQEATESESRGAIYSIPIMEDGGGGSSTPEDPAEAPRTLLEFETQSMVPPTGFSEEEGKALEEEEKYEDEEEKEEEEEEEEVEDEALWAWPSELSSPGPEASLPTEPAAQEESLSQAPARAVLQPGASPLPDGESEASRPPRVHGPPTETLPTPRERNLASPSPSTLVEAREVGEATGGPELSGVPRGESEETGSSEGAPSLLPATRAPEGTRELEAPSEDNSGRTAPAGTSVQAQPVLPTDSASRGGVAVVPASGNSAQGSTALSILLLFFPLQLWVT

SEQ ID NO: 53471 - protein, 225 aa, Homo sapiens
MAELKSLSGDAYLALSHGYAAAAAGLAYGAAREPEAARGYGTPGPGGDLPAAPAPRAPAQAAESSGEQSGDEDDAFEQRRRRRGPGSAADGRRRPREQRSLRLSINARERRRMHDLNDALDGLRAVIPYAHSPSVRKLSKIATLLLAKNYILMQAQALDEMRRLVAFLNQGQGLAAPVNAAPLTPFGQATVCPFSAGAALGPCPDKCAAFSGTPSALCKHCHEKP

SEQ ID NO: 53472 - protein, 149 aa, Homo sapiens [sequence omitted]

SEQ ID NO: 53473 - protein, 485 aa, Homo sapiens
MARLTESEARRQQQQLLQPRPSPVGSSGPEPPGGQPDGMKDLDAIKLFVGQIPRHLDEKDLKPLFEQFGRIYELTVLKDPYTGMHKGCAFLTYCARDSAIKAQTALHEQKTLPGMARPIQVKPADSESRGGRDRKLFVGMLNKQQSEEDVLRLFQPFGVIDECTVLRGPDGSSKGCAFVKFSSHTEAQAAIHALHGSQTMPGASSSLVVKFADTDKERTLRRMQQMVGQLGILTPSLTLPFSPYSAYAQALMQQQTTVLSTSGSYLSPGVAFSPCHIQQIGAVSLNGLPATPIAPASGLHSPPLLGTTAVPGLVAPITNGFAGVVPFPGGHPALETVYANGLVPYPAQSPTVAETLHPAFSGVQQYTAMYPTAAITPIAHSVPQPPPLLQQQQREGPEGCNLFIYHLPQEFGDTELTQMFLPFGNIISSKVFMDRATNQSKCFGFVSFDNPASAQAAIQAMNGFQIGMKRLKVQLKRPKDPGHPY

SEQ ID NO: 53474 - protein, 3926 aa, Homo sapiens
MGNEVSLEGGAGDGPLPPGGAGPGPGPGPGPGAGKPPSAPAGGGQLPAAGAARSTAVPPVPGPGPGPGPGPGPGSTSRRLDPKEPLGNQRAASPTPKQASATTPGHESPRETRAQGPAGQEADGPRRTLQVDSRTQRSGRSPSVSPDRGSTPTSPYSVPQIAPLPSSTLCPICKTSDLTSTPSQPNFNTCTQCHNKVCNQCGFNPNPHLTQVKEWLCLNCQMQRALGMDMTTAPRSKSQQQLHSPALSPAHSPAKQPLGKPDQERSRGPGGPQPGSRQAETARATSVPGPAQAAAPPEVGRVSPQPPQPTKPSTAEPRPPAGEAPAKSATAVPAGLGATEQTQEGLTGKLFGLGASLLTQASTLMSVQPEADTQGQPAPSKGTPKIVFNDASKEAGPKPLGSGPGPGPAPGAKTEPGARMGPGSGPGALPKTGGTTSPKHGRAEHQAASKAAAKPKTMPKERAICPLCQAELNVGSKSPANYNTCTTCRLQVCNLCGFNPTPHLVEKTEWLCLNCQTKRLLEGSLGEPTPLPPPTSQQPPVGAPHRASGTSPLKQKGPQGLGQPSGPLPAKASPLSTKASPLPSKASPQAKPLRASEPSKTPSSVQEKKTRVPTKAEPMPKPPPETTPTPATPKVKSGVRRAEPATPVVKAVPEAPKGGEAEDLVGKPYSQDASRSPQSLSDTGYSSDGISSSQSEITGVVQQEVEQLDSAGVTGPHPPSPSEIHKVGSSMRPLLQAQGLAPSERSKPLSSGTGEEQKQRPHSLSITPEAFDSDEELEDILEEDEDSAEWRRRREQQDTAESSDDFGSQLRHDYVEDSSEGGLSPLPPQPPARAAELTDEDFMRRQILEMSAEEDNLEEDDTATSGRGLAKHGTQKGGPRPRPEPSQEPAALPKRRLPHNATTGYEELLPEGGSAEATDGSGTLQGGLRRFKTIELNSTGSYGHELDLGQGPDPSLDREPELEMESLTGSPEDRSRGEHSSTLPASTPSYTSGTSPTSLSSLEEDSDSSPSRRQRLEEAKQQRKARHRSHGPLLPTIEDSSEEEELREEEELLREQEKMREVEQQRIRSTARKTRRDKEELRAQRRRERSKTPPSNLSPIEDASPTEELRQAAEMEELHRSSCSEYSPSPSLDSEAEALDGGPSRLYKSGSEYNLPTFMSLYSPTETPSGSSTTPSSGRPLKSAEEAYEEMMRKAELLQRQQGQAAGARGPHGGPSQPTGPRGLGSFEYQDTTDREYGQAAQPAAEGTPASLGAAVYEEILQTSQSIVRMRQASSRDLAFAEDKKKEKQFLNAESAYMDPMKQNGGPLTPGTSPTQLAAPVSFSTPTSSDSSGGRVIPDVRVTQHFAKETQDPLKLHSSPASPSSASKEIGMPFSQGPGTPATTAVAPCPAGLPRGYMTPASPAGSERSPSPSSTAHSYGHSPTTANYGSQTEDLPQAPSGLAAAGRAAREKPLSASDGEGGTPQPSRAYSYFASSSPPLSPSSPSESPTFSPGKMGPRATAEFSTQTPSPAPASDMPRSPGAPTPSPMVAQGTQTPHRPSTPRLVWQESSQEAPFMVITLASDASSQTRMVHASASTSPLCSPTETQPTTHGYSQTTPPSVSQLPPEPPGPPGFPRVPSAGADGPLALYGWGALPAENISLCRISSVPGTSRVEPGPRTPGTAVVDLRTAVKPTPIILTDQGMDLTSLAVEARKYGLALDPIPGRQSTAVQPLVINLNAQEHTFLATATTVSITMASSVFMAQQKQPVVYGDPYQSRLDFGQGGGSPVCLAQVKQVEQAVQTAPYRSGPRGRPREAKFARYNLPNQVAPLARRDVLITQMGTAQSIGLKPGPVPEPGAEPHRATPAELRSHALPGARKPHTVVVQMGEGTAGTVTTLLPEEPAGALDLTGMRPESQLACCDMVYKLPFGSSCTGTFHPAPSVPEKSMADAAPPGQSSSPFYGPRDPEPPEPPTYRAQGVVGPGPHEEQRPYPQGLPGRLYSSMSDTNLAEAGLNYHAQRIGQLFQGPGRDSAMDLSSLKHSYSLGFADGRYLGQGLQYGSVTDLRHPTDLLAHPLPMRRYSSVSNIYSDHRYGPRGDAVGFQEASLAQYSATTAREISRMCAALNSMDQYGGRHGSGGGGPDLVQYQPQHGPGLSAPQSLVPLRPGLLGNPTFPEGHPSPGNLAQYGPAAGQGTAVRQLLPSTATVRAADGMIYSTINTPIAATLPITTQPASVLRPMVRGGMYRPYASGGITAVPLTSLTRVPMIAPRVPLGPTGLYRYPAPSRFPIASSVPPAEGPVYLGKPAAAKAPGAGGPSRPEMPVGAAREEPLPTTTPAAIKEAAGAPAPAPLAGQKPPADAAPGGGSGALSRPGFEKEEASQEERQRKQQEQLLQLERERVELEKLRQLRLQEELERERVELQRHREEEQLLVQRELQELQTIKHHVLQQQQEERQAQFALQREQLAQQRLQLEQIQQLQQQLQQQLEEQKQRQKAPFPAACEAPGRGPPLAAAELAQNGQYWPPLTHAAFIAMAGPEGLGQPREPVLHRGLPSSASDMSLQTEEQWEASRSGIKKRHSMPRLRDACELESGTEPCVVRRIADSSVQTDDEDGESRYLLSRRRRARRSADCSVQTDDEDSAEWEQPVRRRRSRLPRHSDSGSDSKHDATASSSSAAATVRAMSSVGIQTISDCSVQTEPDQLPRVSPAIHITAATDPKVEIVRYISAPEKTGRGESLACQTEPDGQAQGVAGPQLVGPTAISPYLPGIQIVTPGPLGRFEKKKPDPLEIGYQAHLPPESLSQLVSRQPPKSPQVLYSPVSPLSPHRLLDTSFASSERLNKAHVSPQKHFTADSALRQQTLPRPMKTLQRSLSDPKPLSPTAEESAKERFSLYQHQGGLGSQVSALPPNSLVRKVKRTLPSPPPEEAHLPLAGQASPQLYAASLLQRGLTGPTTVPATKASLLRELDRDLRLVEHESTKLRKKQAELDEEEKEIDAKLKYLELGITQRKESLAKDRGGRDYPPLRGLGEHRDYLSDSELNQLRLQGCTTPAGQFVDFPATAAAPATPSGPTAFQQPRFQPPAPQYSAGSGGPTQNGFPAHQAPTYPGPSTYPAPAFPPGASYPAEPGLPNQQAFRPTGHYAGQTPMPTTQSTLFPVPADSRAPLQKPRQTSLADLEQKVPTNYEVIASPVVPMSSAPSETSYSGPAVSSGYEQGKVPEVPRAGDRGSVSQSPAPTYPSDSHYTSLEQNVPRNYVMIDDISELTKDSTSTAPDSQRLEPLGPGSSGRPGKEPGEPGVLDGPTLPCCYARGEEESEEDSYDPRGKGGHLRSMESNGRPASTHYYGDSDYRHGARVEKYGPGPMGPKHPSKSLAPAAISSKRSKHRKQGMEQKISKFSPIEEAKDVESDLASYPPPAVSSSLVSRGRKFQDEITYGLKKNVYEQQKYYGMSSRDAVEDDRIYGGSSRSRAPSAYSGEKLSSHDFSGWGKGYEREREAVERLQKAGPKPSSLSMAHSRVRPPMRSQASEEESPVSPLGRPRPAGGPLPPGGDTCPQFCSSHSMPDVQEHVKDGPRAHAYKREEGYILDDSHCVVSDSEAYHLGQEETDWFDKPRDARSDRFRHHGGHAVSSSSQKRGPARHSYHDYDEPPEEGLWPHDEGGPGRHASAKEHRHGDHGRHSGRHTGEEPGRRAAKPHARDLGRHEARPHSQPSSAPAMPKKGQPGYPSSAEYSQPSRASSAYHHASDSKKGSRQAHSGPAALQSKAEPQAQPQLQGRQAAPGPQQSQSPSSRQIPSGAASRQPQTQQQQQGLGLQPPQQALTQARLQQQSQPTTRGSAPAASQPAGKPQPGPSTATGPQPAGPPRAEQTNGSKGTAKAPQQGRAPQAQPTPGPGPAGVKAGARPGGTPGAPAGQPGADGESVFSKILPGGAAEQAGKLTEAVSAFGKKFSSLW

SEQ ID NO: 53475 - protein, 282 aa, Homo sapiens
MESRMWPALLLSHLLPLWPLLLLPLPPPAQGSSSSPRTPPAPARPPCARGGPSAPRHVCVWERAPPPSRSPRVPRSRRQVLPGTAPPATPSGFEEGPPSSQYPWAIVWGPTVSREDGGDPNSANPGFLDYGFAAPHGLATPHPNSDSMRGDGDGLILGEAPATLRPFLFGGRGEGVDPQLYVTITISIIIVLVATGIIFKFCWDRSQKRRRPSGQQGALRQEESQQPLTDLSPAGVTVLGAFGDSPTPTPDHEEPRGGPRPGMPHPKGAPAFQLNRIPLVNL

SEQ ID NO: 53476 - protein, 131 aa, Homo sapiens
MGGSQRGTCHQQPSLSTFLFSVFFKVFPVARPELFQNEEDTWRNLHVHRPICKRTCEPTLLPQLEELISNTFTQEVFTEHLLCALFSGVGARGQTTLTSLCSQGWSAAARSRLTASSASRVHAILLPQPPE

SEQ ID NO: 53477 - protein, 342 aa, Homo sapiens
MAAVALMPPPLLLLLLLASPPAASAPSARDPFAPQLGDTQNCQLRCRDRDLGPQPSQAGLEGASESPYDRAVLISACERGCRLFSICRFVARSSKPNATQTECEAACVEAYVKEAEQQACSHGCWSQPAEPEPEQKRKVLEAPSGALSLLDLFSTLCNDLVNSAQGFVSSTWTYYLQTDNGKVVVFQTQPIVESLGFQGGRLQRVEVTWRGSHPEALEVHVDPVGPLDKVRKAKIRVKTSSKAKVESEEPQDNDFLSCMSRRSGLPRWILACCLFLSVLVMLWLSCSTLVTAPGQHLKFQPLTLEQHKGFMMEPDWPLYPPPSHACEDSLPPYKLKLDLTKL

SEQ ID NO: 53478 - protein, 287 aa, Homo sapiens
MALGLLIAVPLLLQAAPRGAAHYEMMGTCRMIWEPYTAAPGGEPPGAKAHNPGPSTAALEVMQDLSANPPPPFIQGPKGDPGRPGKPGPRGPPGEPGPPGPRGPPGEKGDSGRPGLPGLQLTAGTASGVGVVGGGAGVGGDSEGEVTSALSATFSGPKIAFYVGLKSPHEGYEVLKFDDVVTNLGNHYDPTTGKFSCQVRGIYFFTYHILMRGGDGTSMWADLCKNGQVRASAIAQDADQNYDYASNSVVLHLDSGDEVYVKLDGGKAHGGNNNKYSTFSGFLLYPD

SEQ ID NO: 53479 - protein, 255 aa, Homo sapiens
MVLLLVILIPVLVSSAGTSAHYEMLGTCRMVCDPYGGTKAPSTAATPDRGLMQSLPTFIQGPKGEAGRPGKAGPRGPPGEPGPPGPMGPPGEKGEPGRQGLPGPPGAPGLNAAGAISAATYSTVPKIAFYAGLKRQHEGYEVLKFDDVVTNLGNHYDPTTGKFTCSIPGIYFFTYHVLMRGGDGTSMWADLCKNNQVRASAIAQDADQNYDYASNSVVLHLEPGDEVYIKLDGGKAHGGNNNKYSTFSGFIIYAD

SEQ ID NO: 53480 - protein, 329 aa, Homo sapiens
MLPLLLGLLGPAACWALGPTPGPGSSELRSAFSAARTTPLEGTSEMAVTFDKVYVNIGGDFDVATGQFRCRVPGAYFFSFTAGKAPHKSLSVMLVRNRDEVQALAFDEQRRPGARRAASQSAMLQLDYGDTVWLRLHGAPHYALGAPGATFSGYLVYADADADAPARGPPAPPEPRSAFSAARTRSLVGSDAGPGPRHQPLAFDTEFVNIGGDFDAAAGVFRCRLPGAYFFSFTLGKLPRKTLSVKLMKNRDEVQAMIYDDGASRRREMQSQSVMLALRRGDAVWLLSHDHDGYGAYSNHGKYITFSGFLVYPDLAPAAPPGLGASELL

SEQ ID NO: 53481 - protein, 280 aa, Homo sapiens
MDLQGRGVPSIDRLRVLLMLFHTMAQIMAEQEVENLSGLSTNPEKDIFVVRENGTTCLMAEFAAKFIVPYDVWASNYVDLITEQADIALTRGAEVKGRCGHSQSELQVFWVDRAYALKMLFVKESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIMVTLAIYHVHHKMTANQVQIPRDRSQYKHMG

SEQ ID NO: 53482 - protein, 335 aa, Homo sapiens
MFLATLSFLLPFAHPFGTVSCEYMLGSPLSSLAQVNLSPFSHPKVHMDPNYCHPSTSLHLCSLAWSFTRLLHPPLSPGISQVVKDHVTKPTAMAQGRVAHLIEWKGWSKPSDSPAALESAFSSYSDLSEGEQEARFAAGVAEQFAIAEAKLRAWSSVDGEDSTDDSYDEDFAGGMDTDMAGQLPLGPHLQDLFTGHRFSRPVRQGSVEPESDCSQTVSPDTLCSSLCSLEDGLLGSPARLASQLLGDELLLAKLPPSRESAFRSLGPLEAQDSLYNSPLTESCLSPAEEEPAPCKDCQPLCPPLTGSWERQRQASDLASSGVVSLDEDEAEPEEQ

SEQ ID NO: 53483 - protein, 206 aa, Homo sapiens
MHQIYSCSDENIEVFTTVIPSKVSSPARRRAKSSQHLLTKNVVIESDLYTHQPLELLPHRGDRRDPGDRRRFGRLQTARPPTAHPAKASARPVGISEPKTSNLCGNRAYGKSLIPPVPRISVKTSASASLEATAMGTEKGAVLMRGSRHLKKMTEEYPALPQGAEASLPLTGSASCGVPGILRKMWTRHKKKSEYVGATNSAFEAD

SEQ ID NO: 53484 - protein, 328 aa, Homo sapiens
MEIVWEVLFLLQANFIVCISAQQNSPKIHEGWWAYKEVVQGSFVPVPSFWGLVNSAWNLCSVGKRQSPVNIETSHMIFDPFLTPLRINTGGRKVSGTMYNTGRHVSLRLDKEHLVNISGGPMTYSHRLEEIRLHFGSEDSQGSEHLLNGQAFSGEVQLIHYNHELYTNVTEAAKSPNGLVVVSIFIKVSDSSNPFLNRMLNRDTITRITYKNDAYLLQGLNIEELYPETSSFITYDGSMTIPPCYETASWIIMNKPVYITRMQMHSLRLLSQNQPSQIFLSMSDNFRPVQPLNNRCIRTNINFSLQGKDCPNNRAQKLQYRVNEWLLK

SEQ ID NO: 53485 - protein, 370 aa, Homo sapiens
MGGGDGAAFKRPGDGARLQRVLGLGSRREPRSLPAGGPAPRRTAPPPPGHASAGPAAMSSHIAKSESKTSLLKAAAAAASGGSRAPRHGPARDPGLPSRRLPGSCPATPQSSGDPSSRRPLCRPAPREEGARGSQRVLPQAHCRPREALPAAASRPSPSSPLPPARGRDGEERGLSPALGLRGSLRARGRGDSVPAAASEADPFLHRLRPMLSSAFGQDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 53486 - protein, 167 aa, Homo sapiens
MGNCVKYPLRNLSRKDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 53487 - protein, 227 aa, Homo sapiens
MGNCVKYPLRNLSRKMCQEEQTSYMVVQTSEEGLAADAELPGPLLMLAQNCAVMHNLLGPACIFLRKGFAENRQPDRSLRPEEIEELREAFREFDKDKDGYINCRDLGNCMRTMGYMPTEMELIELSQQINMNLGGHVDFDDFVELMGPKLLAETADMIGVKELRDAFREFDTNGDGEISTSELREAMRKLLGHQVGHRDIEEIIRDVDLNGDGRVDFEEFVRMMSR

SEQ ID NO: 53488 - protein, 2339 aa, Homo sapiens [sequence omitted]

SEQ ID NO: 53489 - protein, 315 aa, Homo sapiens
MRMCDRGIQMLITTVGAFAAFSLMTIAVGTDYWLYSRGVCRTKSTSDNETSRKNEEVMTHSGLWRTCCLEGAFRGVCKKIDHFPEDADYEQDTAEYLLRAVRASSVFPILSVTLLFFGGLCVAASEFHRSRHNVILSAGIFFVSAGLSNIIGIIVYISANAGDPGQRDSKKSYSYGWSFYFGAFSFIIAEIVGVVAVHIYIEKHQQLRAKSHSEFLKKSTFARLPPYRYRFRRRSSSRSTEPRSRDLSPISKGFHTIPSTDISMFTLSRDPSKITMGTLLNSDRDHAFLQFHNSTPKEFKESLHNNPANRRTTPV

SEQ ID NO: 53490 - protein, 476 aa, Homo sapiens [sequence omitted]

SEQ ID NO: 53491 - protein, 489 aa, Homo sapiens
MATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKSDGVKKRKSSSSVQLMESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 53492 - protein, 478 aa, Homo sapiens
MATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKSDGVKESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 53493 - protein, 501 aa, Homo sapiens
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDDISQAAKDLVTRLMEVEQDQRITAEEAISHEWISGNAASDKNIKDGVCAQIEKNFARAKWKKAVRVTTLMKRLRAPEQSSTAAAQSASATDTATPGAAGGATAAAASGATSAPEGDAARAAKSDNVAPADRSATPATDGSATPATDGSVTPATDGSITPATDGSVTPATDRSATPATDGRATPATEESTVPTTQSSAMLATKAAATPEPAMAQPDSTAPEGATGQAPPSSKGEEAAGYAQESQREEAS

SEQ ID NO: 53494 - protein, 116 aa, Homo sapiens
MESSRVRLLPLLGAALLLMLPLLGTRAQEDAELQPRALDIYSAVDDASHEKELIEALQEVLKKLKSKRVPIYEKKYGQVPMCDAGEQCAVRKGARIGKLCDCPRGTSCNSFLLKCL

SEQ ID NO: 53495 - protein, 957 aa, Homo sapiens
MYGSARTITNLEGSPSRSPRLPRSPRLGHRRTSSGGGGGTGKTLSMENIQSLNAAYATSGPMYLSDHEGVASTTYPKGTMTLGRATNRAVYGGRVTAMGSSPNIASAGLSHTDVLSYTDQHGGLTGSSHHHHHQVPSMLRQVRDSTMLDLQAQLKELQRENDLLRKELDIKDSKLGSSMNSIKTFWSPELKKERVLRKEEAARMSVLKEQMRVSHEENQHLQLTIQALQDELRTQRDLNHLLQQESGNRGAEHFTIELTEENFRRLQAEHDRQAKELFLLRKTLEEMELRIETQKQTLNARDESIKKLLEMLQSKGLPSKSLEDDNERTRRMAEAESQVSHLEVILDQKEKENIHLREELHRRSQLQPEPAKTKALQTVIEMKDTKIASLERNIRDLEDEIQMLKANGVLNTEDREEEIKQIEVYKSHSKFMKTKIDQLKQELSKKESELLALQTKLETLSNQNSDCKQHIEVLKESLTAKEQRAAILQTEVDALRLRLEEKESFLNKKTKQLQDLTEEKGTLAGEIRDMKDMLEVKERKINVLQKKIENLQEQLRDKDKQLTNLKDRVKSLQTDSSNTDTALATLEEALSEKERIIERLKEQRERDDRERLEEIESFRKENKDLKEKVNALQAELTEKESSLIDLKEHASSLASAGLKRDSKLKSLEIAIEQKKEECSKLEAQLKKAHNIEDDSRMNPEFADQIKQLDKEASYYRDECGKAQAEVDRLLEILKEVENEKNDKDKKIAELESLTLRHMKDQNKKVANLKHNQQLEKKKNAQLLEEVRRREDSMADNSQHLQIEELMNALEKTRQELDATKARLASTQQSLAEKEAHLANLRIERRKQLEEILEMKQEALLAAISEKDANIALLELSASKKKKTQEEVMALKREKDRLVHQLKQQTQNRMKLMADNYDDDHHHYHHHHHHHHHRSPGRSQHSNHRPSPDQDDEEGIWA

SEQ ID NO: 53496 - protein, 201 aa, Homo sapiens
MGSGRRALSAVPAVLLVLTLPGLPVWAQNDTEPIVLEGKCLVVCDSNPATDSKGSSSSPLGISVRAANSKVAFSAVRSTNHEPSEMSNKTRIIYFDQILVNVGNFFTLESVFVAPRKGIYSFSFHVIKVYQSQTIQVNLMLNGKPVISAFAGDKDVTREAATNGVLLYLDKEDKVYLKLEKGNLVGGWQYSTFSGFLVFPL

SEQ ID NO: 53497 - protein, 115 aa, Homo sapiens
MNSGVCLCVLMAVLAAGALTQPVPPADPAGSGLQRAEEAPRRQLRVSQRTDGESRAHLGALLARYIQQARKAPSGRMSIVKNLQNLDPSHRISDRDYMGWMDFGRRSAEEYEYPS

SEQ ID NO: 53498 - protein, 801 aa, Homo sapiens
MWTSGRMSNAKNWLGLGMSLYFWGLMDLTTTVLSDTPTPQGELEALLSDKPQSHQRTKRSWVWNQFFVLEEYTGTDPLYVGKLHSDMDRGDGSIKYILSGEGAGIVFTIDDTTGDIHAIQRLDREERAQYTLRAQALDRRTGRPMEPESEFIIKIQDINDNEPKFLDGPYVATVPEMSPVGTSVIQVTATDADDPTYGNSARVVYSILQGQPYFSVDSKTGVIRTALMNMDREAKEYYEVIIQAKDMGGQLGGLAGTTTVNITLSDVNDNPPRFPQKHYQMSVLESAPISSTVGRVFAKDLDEGINAEMKYTIVDGDGADAFDISTDPNFQVGIITVKKPLSFESKKSYTLKVEGANPHLEMRFLNLGPFQDTTTVHISVEDVDEPPVFEPGFYFVEVPEDVAIGTTIQIISAKDPDVTNNSIRYSIDRSSDPGRFFYVDITTGALMTARPLDREEFSWHNITVLAMEMNNPSQVGSVPVTIKVLDVNDNAPEFPRFYEAFVCENAKAGQLIQTVSAVDQDDPRNGQHFYYSLAPEAANNPNFTIRDNQDNTARILTRRSGFRQQEQSVFHLPILIADSGQPVLSSTGTLTIQVCSCDDDGHVMSCSPEAYMLPVSLSRGALIAILACIFVLLVLVLLILSMRRHRKQPYIIDDEENIHENIVRYDDEGGGEEDTEAFDIAAMWNPREAQAGAAPKTRQDMLPEIESLSRYVPQTCAVNSTVHSYVLAKLYEADMDLWAPPFDSLQTYMFEGDGSVAGSLSSLQSATSDSEQSFDFLTDWGPRFRKLAELYGASEGPAPLW

SEQ ID NO: 53499 - protein, 789 aa, Homo sapiens
MRTYHYIPLFIWTYMFHTVDTILLQEKPNSYLSSKKIAGLTKDDGKMLRRTKRGWMWNQFFLLEEYTGTDTQYVGKLHTDQDKGDGNLKYILTGDGAGSLFVIDENTGDIHAAKKLDREEKSLYILRAKAIDRKTGRQVEPESEFIIKIHDINDNEPKFTKDLYTASVPEMSGVGTSVIQVTATDADDANYGNSAKVVYSILQGQPYFSVDPESGIIKTALPDMSRENREQYQVVIQAKDMGGQMGGLSGTTTVNITLTDVNNNPPRFPQSTYQFNSPESVPLGTHLGRIKANDPDVGENAEMEYSIAEGDGADMFDVITDKDTQEGIITVKQNLDFENQMLYTLRVDASNTHPDPRFLHLGPFKDTAVVKISVEDIDEPPVFTKVSYLIEVDEDVKEGSIIGQVTAYDPDARNNLIKYSVDRHTDMDRIFGIHSENGSIFTLKALDRESSPWHNITVTATEISNPKQSSHIPVFIRILDINDHAPEFAMYYETFVCENAKPGQLIQTVSVMDKDDPPRGHKFFFEPVPEFTLNPNFTIVDNKDNTAGIMTRKDGYSRNKMSTYLLPILIFDNDYPIQSSTGTLTIRVCACDNQGNMQSCTAEALILSAGLSTGALVAILLCVLILLILVVLFAALKRQRKKEPLIISKDDVRDNIVTYNDEGGGEEDTQAFDIGTLRNPEAREDSKLRRDVMPETIFQIRRTVPLWENIDVQDFIHRRLKENDADPSAPPYDSLATYAYEGNDSIADSLSSLESLTADCNQDYDYLSDWGPRFKKLADMYGGDDSDRD

SEQ ID NO: 53500 - protein, 307 aa, Homo sapiens
MGTVLSLSPSYRKATLFEDGAATVGHYTAVQNSKNAKDKNLKRHSIISVLPWKRIVAVSAKKKNSKKVQPNSSYQNNITHLNNENLKKSLSCANLSTFAQPPPAQPPAPPASQLSGSQTGGSSSVKKAPHPAVTSAGTPKRVIVQASTSELLRCLGEFLCRRCYRLKHLSPTDPVLWLRSVDRSLLLQGWQDQGFITPANVVFLYMLCRDVISSEVGSDHELQAVLLTCLYLSYSYMGNEISYPLKPFLVESCKEAFWDRCLSVINLMSSKMLQINADPHYFTQVFSDLKNESGQEDKKRLLLGLDR

SEQ ID NO: 53501 - protein, 367 aa, Homo sapiens
MGTVLSLSPASSAKGRRPGGLPEEKKKAPPAGDEALGGYGAPPVGKGGKGESRLKRPSVLISALTWKRLVAASAKKKKGSKKVTPKPASTGPDPLVQQRNRENLLRKGRDPPDGGGTAKPLAVPVPTVPAAAATCEPPSGGSAAAQPPGSGGGKPPPPPPPAPQVAPPVPGGSPRRVIVQASTGELLRCLGDFVCRRCYRLKELSPGELVGWFRGVDRSLLLQGWQDQAFITPANLVFVYLLCRESLRGDELASAAELQAAFLTCLYLAYSYMGNEISYPLKPFLVEPDKERFWQRCLRLIQRLSPQMLRLNADPHFFTQVFQDLKNEGEAAASGGGPPSGGAPAASSAARDSCAAGTKHWTMNLDR

SEQ ID NO: 53502 - protein, 836 aa, Homo sapiens
MHAQRQFVVAAVRAEVRRHEVAKQALNRLRKLAERVDDPELQDSIQASLDSIREAVINSQEWTLSRSIPELRLGVLGDARSGKSSLIHRFLTGSYQVLEKTESEQYKKEMLVDGQTHLVLIREEAGAPDAKFSGWADAVIFVFSLEDENSFQAVSRLHGQLSSLRGEGRGGLALALVGTQDRISASSPRVVGDARARALCADMKRCSYYETCATYGLNVDRVFQEVAQKVVTLRKQQQLLAACKSLPSSPSHSAASTPVAGQASNGGHTSDYSSSLPSSPNVGHRELRAEAAAVAGLSTPGSLHRAAKRRTSLFANRRGSDSEKRSLDSRGETTGSGRAIPIKQSFLLKRSGNSLNKEWKKKYVTLSSNGFLLYHPSINDYIHSTHGKEMDLLRTTVKVPGKRPPRAISAFGPSASINGLVKDMSTVQMGEGLEATTPMPSPSPSPSSLQPPPDQTSKHLLKPDRNLARALSTDCTPSGDLSPLSREPPPSPMVKKQRRKKLTTPSKTEGSAGQAEEENFEFLIVSSTGQTWHFEAASFEERDAWVQAIESQILASLQCCESSKVKLRTDSQSEAVAIQAIRNAKGNSICVDCGAPNPTWASLNLGALICIECSGIHRNLGTHLSRVRSLDLDDWPRELTLVLTAIGNDTANRVWESDTRGRAKPSRDSSREERESWIRAKYEQLLFLAPLSTSEEPLGRQLWAAVQAQDVATVLLLLAHARHGPLDTSVEDPQLRSPLHLAAELAHVVITQLLLWYGADVAARDAQGRTALFYARQAGSQLCADILLQHGCPGEGGSAATTPSAATTPSITATPSPRRRSSAASVGRADAPVALV

SEQ ID NO: 53503 - protein, 411 aa, Homo sapiens
MQCSWKAVLLLALASIAIQYTAIRTFTAKSFHTCPGLAEAGLAERLCEESPTFAYNLSRKTHILILATTRSGSSFVGQLFNQHLDVFYLFEPLYHVQNTLIPRFTQGKSPADRRVMLGASRDLLRSLYDCDLYFLENYIKPPPVNHTTDRIFRRGASRVLCSRPVCDPPGPADLVLEEGDCVRKCGLLNLTVAAEACRERSHVAIKTVRVPEVNDLRALVEDPRLNLKVIQLVRDPRGILASRSETFRDTYRLWRLWYGTGRKPYNLDVTQLTTVCEDFSNSVSTGLMRPPWLKGKYMLVRYEDLARNPMKKTEEIYGFLGIPLDSHVARWIQNNTRGDPTLGKHKYGTVRNSAATAEKWRFRLSYDIVAFAQNACQQVLAQLGYKIAASEEELKNPSVSLVEERDFRPFS

SEQ ID NO: 53504 - protein, 229 aa, Homo sapiens
MADDFGFFSSSESGAPEAAEEDPAAAFLAQQESEIAGIENDEGFGAPAGSHAAPAQPGPTSGAGSEDMGTTVNGDVFQEANGPADGYAAIAQADRLTQEPESIRKWREEQRKRLQELDAASKVTEQEWREKAKKDLEEWNQRQSEQVEKNKINNRIADKAFYQQPDADIIGYVASEEAFVKESKEETPGTEWEKVAQLCDFNPKSSKQCKDVSRLRSVLMSLKQTPLSR

SEQ ID NO: 53505 - protein, 125 aa, Homo sapiens
MLSARDRRDRHPEEGVVAELQGFAVDKAFLTSHKGILLETELALTLIIFICFTASISAYMAAALLEFFITLAFLFLYATQYYQRFDRINWPCLVFGIILVSIFAYDAFKIYRTEMAPGASQGDQQ

SEQ ID NO: 53506 - protein, 156 aa, Homo sapiens
MLSARDRRDRHPEEGVVAELQGFAVDKAFLTSHKGILLETELALTLIIFICFTASISAYMAAALLEFFITLAFLFLYATQYYQRFDRINWPCLDFLRCVSAIIIFLVVSFAAVTSRDGAAIAAFVFGIILVSIFAYDAFKIYRTEMAPGASQGDQQ

SEQ ID NO: 53507 - protein, 160 aa, Homo sapiens
MAFTFAAFCYMLTLVLCASLIFFVIWHIIAFDELRTDFKNPIDQGNPARARERLKNIERICCLLRKLVVPEYSIHGLFCLMFLCAAEWVTLGLNIPLLFYHLWRYFHRPADGSEVMYDAVSIMNADILNYCQKESWCKLAFYLLSFFYYLYSMVYTLVSF

SEQ ID NO: 53508 - protein, 1040 aa, Homo sapiens
MGTATRRKPHLLLVAAVALVSSSAWSSALGSQTTFGPVFEDQPLSVLFPEESTEEQVLLACRARASPPATYRWKMNGTEMKLEPGSRHQLVGGNLVIMNPTKAQDAGVYQCLASNPVGTVVSREAILRFGFLQEFSKEERDPVKAHEGWGVMLPCNPPAHYPGLSYRWLLNEFPNFIPTDGRHFVSQTTGNLYIARTNASDLGNYSCLATSHMDFSTKSVFSKFAQLNLAAEDTRLFAPSIKARFPAETYALVGQQVTLECFAFGNPVPRIKWRKVDGSLSPQWTTAEPTLQIPSVSFEDEGTYECEAENSKGRDTVQGRIIVQAQPEWLKVISDTEADIGSNLRWGCAAAGKPRPTVRWLRNGEPLASQNRVEVLAGDLRFSKLSLEDSGMYQCVAENKHGTIYASAELAVQALAPDFRLNPVRRLIPAARGGEILIPCQPRAAPKAVVLWSKGTEILVNSSRVTVTPDGTLIIRNISRSDEGKYTCFAENFMGKANSTGILSVRDATKITLAPSSADINLGDNLTLQCHASHDPTMDLTFTWTLDDFPIDFDKPGGHYRRTNVKETIGDLTILNAQLRHGGKYTCMAQTVVDSASKEATVLVRGPPGPPGGVVVRDIGDTTIQLSWSRGFDNHSPIAKYTLQARTPPAGKWKQVRTNPANIEGNAETAQVLGLTPWMDYEFRVIASNILGTGEPSGPSSKIRTREAAPSVAPSGLSGGGGAPGELIVNWTPMSREYQNGDGFGYLLSFRRQGSTHWQTARVPGADAQYFVYSNESVRPYTPFEVKIRSYNRRGDGPESLTALVYSAEEEPRVAPTKVWAKGVSSSEMNVTWEPVQQDMNGILLGYEIRYWKAGDKEAAADRVRTAGLDTSARVSGLHPNTKYHVTVRAYNRAGTGPASPSANATTMKPPPRRPPGNISWTFSSSSLSIKWDPVVPFRNESAVTGYKMLYQNDLHLTPTLHLTGKNWIEIPVPEDIGHALVQIRTTGPGGDGIPAEVHIVRNGGTSMMVENMAVRPAPHPGTVISHSVAMLILIGSLEL

SEQ ID NO: 53509 - protein, 155 aa, Homo sapiens
MYRHKNSWRLGLKYPPSSKEETQVPKTLISGLPGRKSSSRVGEKLQSAHKMPLSPGLLLLLLSGATATAALPLEGGPTGRDSEHMQEAAGIRKSSLLTFLAWWFEWTSQASAGPLIGEEAREVARRQEGAPPQQSARRDRMPCRNFFWKTFSSCK

SEQ ID NO: 53510 - protein, 557 aa, Homo sapiens
MSDPEMGWVPEPPTMTLGASRVELRVSCHGLLDRDTLTKPHPCVLLKLYSDEQWVEVERTEVLRSCSSPVFSRVLALEYFFEEKQPLQFHVFDAEDGATSPRNDTFLGSTECTLGQIVSQTKVTKPLLLKNGKTAGKSTITIVAEEVSGTNDYVQLTFRAYKLDNKDLFSKSDPFMEIYKTNEDQSDQLVWRTEVVKNNLNPSWEPFRLSLHSLCSCDVHRPLKFLVYDYDSSGKHDFIGEFTSTFQEMQEGTANPGQEMQWDCINPKYRDKKKNYKSSGTVVLAQCTVEKVHTFLDYIMGGCQISFTVAIDFTASNGDPRSSQSLHCLSPRQPNHYLQALRAVGGICQDYDSDKRFPAFGFGARIPPNFEVSHDFAINFDPENPECEEISGVIASYRRCLPQIQLYGPTNVAPIINRVAEPAQREQSTGQATKYSVLLVLTDGVVSDMAETRTAIVRASRLPMSIIIVGVGNADFSDMRLLDGDDGPLRCPRGVPAARDIVQFVPFRDFKDAAPSALAKCVLAEVPRQVVEYYASQGISPGAPRPCTLATTPSPSP

SEQ ID NO: 53511 - protein, 3501 aa, Homo sapiens
MGIKSGFTFWNLVFLLTVSCVKGFIYTCGGTLKGLNGTIESPGFPYGYPNGANCTWVIIAEERNRIQIVFQSFALEEEYDYLSLYDGHPHPTNFRTRLTGFHLPPPVTSTKSVFSLRLTSDFAVSAHGFKVYYEELQSSSCGNPGVPPKGVLYGTRFDVGDKIRYSCVTGYILDGHPQLTCIANSVNTASWDFPVPICRAEDACGGTMRGSSGIISSPSFPNEYHNNADCTWTIVAEPGDTISLIFTDFQMEEKYDYLEIEGSEPPTIWLSGMNIPPPIISNKNWLRLHFVTDSNHRYRGFSAPYQVKKAIDFKSRGFKLFPGKDNSNKFSILNEGGIKTASNLCPDPGEPENGKRIGSDFSLGSTVQFSCDEDYVLQGAKSITCQRIAEVFAAWSDHRPVCKVKTCGSNLQGPSGTFTSPNFPFQYDSNAQCVWVITAVNTNKVIQINFEEFDLEIGYDTLTIGDGGEVGDPRTVLQVLTGSFVPDLIVSMSSQMWLHLQTDESVGSVGFKVNYKEIEKESCGDPGTPLYGIREGDGFSNRDVLRFECQFGFELIGEKSIVCQENNQWSANIPICIFPCLSNFTAPMGTVLSPDYPEGYGNNLNCIWTIISDPGSRIHLSFNDFDLESQFDFLAVKDGDSPESPILGTFTGAEVPSHLTSNSHILRLEFQADHSMSGRGFNITYNTFGHNECPDPGIPINARRFGDNFQLGSSISVICEEGFIKTQGTETITCILMDGKVMWSGLIPKCGAPCGGHFSAPSGVILSPGWPGYYKDSLNCEWVIEAEPGHSIKITFERFQTELNYDVLEVHDGPNLLSPLLGSYNGTQVPQFLFSSSNFIYLLFTTDNSRSNNGFKIHYESVTVNTYSCLDPGIPVHGRRYGHDFSIGSTVSFSCDSGYRLSHEEPLLCEKNHWWSHPLPTCDALCGGDVRGPSGTILSPGYPEFYPNSLNCTWTVDVTHGKGVQFNFHTFHLEDHHDYLLITENGSFTQPLARLTGSDLPPTINAGLYGNFRAQLRFISDFSISYEGFNITFSEYNLEPCEDPGIPQYGSRIGFNFGIGDTLTFSCSSGYRLEGTSEIICLGGGRRVWSAPLPRCVAECGASATNNEGILLSPNYPLNYENNHECIYSIQVQAGKGINISARTFHLAQGDVLKIYDGKDKTTHLLGAFTGASMRGLTLSSTSNQLWLEFNSDTEGTDEGFQLVYTSFELSHCEDPGIPQFGYKISDQGHFAGSTIIYGCNPGYTLHGSSLLKCMTGERRAWDYPLPSCIAECGGRFKGESSGRILSPGYPFPYDNNLRCMWMIEVDPGNIVSLQFLAFDTEASHDILRVWDGPPENDMLLKEISGSLIPEGIHSTLNIVTIQFDTDFYISKSGFAIQFSSSVATACRDPGVPMNGTRNGDGREPGDTVVFQCDPGYELQGEERITCIQVENRYFWQPSPPVCIAPCGGNLTGSSGFILSPNFPHPYPHSRDCDWTITVNADYVISLAFISFSIEPNYDFLYIYDGPDSNSPLIGSFQDSKLPERIESSSNTMHLAFRSDGSVSYTGFHLEYKAKLRESCFDPGNIMNGTRLGMDYKLGSTVTYYCDAGYVLQGYSTLTCIMGDDGRPGWNRALPSCHAPCGSRSTGSEGTVLSPNYPKNYSVGHNCVYSIAVPKEFVVFGQFVFFQTSLHDVVEVYDGPTQQSSLLSSLSGSHSGESLPLSSGNQITIRFTSVGPITAKGFHFVYQAVPRTSSTQCSSVPEPRFGRRIGNEFAVGSSVLFDCNPGYILHGSIAIRCETVPNSLAQWNDSLPTCIVPCGGILTKRKGTILSPGYPEPYDNNLNCVWKITVPEGAGIQVQVVSFATEHNWDSLDFYDGGDNNAPRLGSYSGTTIPHLLNSTSNNLYLNFQSDISVSAAGFHLEYTAIGLDSCPEPQTPSSGIKIGDRYMVGDVVSFQCDQGYSLQGHSHITCMPGPVRRWNYPIPICLAQCGGAMSDFSGVILSPGFPGNYPSSLDCTWTINLPIGFGVHLQFVNFSTETIHDYLEVRSGSSETSTVIGRLSGPQIPSSLFSTTHETSLYFHSDYSQNKQGFHIVYQAYQLQSCPDPRPFRNGFVIGNDFTVGQTISFECFPGYTLIGNSALTCLHGVSRNWNHPLPRCEALCGGNITAMNGTIYSPGYPDEYPNFQDCFWLVRVPPGNGIYINFTVLQTEPIYDFITVWDGPDQNSPQIGQFSGNTALESVYSTSNQILIKFHSDFTTSGFFVLSYHAYQLRVCQPPPPVPNAEILTEDDEFEIGDIIRYQCLPGFTLVGNAILTCRLGERLQMDGAPPVCQVLCPANELRLDSTGVILSPGYPDSYPNLQMCAWSISVEKGYNITMFVEFFQTEKEFDVLQVYDGPNIQSPVLISLSGDYSSAFNITSNGHEVFLQWSADHGNNKKGFRIRYIAFYCSTPESPPHGYIISQTGGQLNSVVRWACDRGFRLVGKSSAVCRKSSYGYHAWDAPVPACQAISCGIPKAPTNGGILTTDYLVGTRVTYFCNDGYRLSSKELTTAVCQSDGTWSNHNKTPRCVVISCGELPTPPNGNKIGTQTSYGSTAIFTCDLGFMLVGSAVRECLSSGLWSESETRCLAGHCGIPELIVNGQVIGENYGYRDTVVYQCNPGFRLIGSSVRICQQDHNWSGQLPSCVPVSCGHPGSPIYGRTSGNGFNFNDVVTFSCNIGYLMQGPTKAQCQANRQWSHPPPMCKVVNCSDPGIPANSKRESKIEHGNFTYGTVVFYDCNPGYFLFGSSVLICQPNGQWDKPLPECIMIDCGHPGVPPNAVLSGEKYTFGSTVHYSCTGKRSLLGQSSRTCQLNGHWSGSQPHCSGDATGTCGDPGTPGHGSRQESNFRTKSTVRYACDTGYILHGSEERTCLANGSWTGRQPECKAVQCGNPGTTANGKVFRIDGTTFSSSVIYSCMEGYILSGPSVRQCTANGTWSGTLPNCTIISCGDPGIPANGLRYGDDYVVGQNVSYMCQPGYTMELNGSRIRTCTINGTWSGVMPTCRAVTCPTPPQISNGRLEGTNFDWGFSISYICSPGYELSFPAVLTCVGNGTWSGEVPQCLPKFCGDPGIPAQGKREGKSFIYQSEVSFSCNFPFILVGSSTRICQADGTWSGSSPHCIEPTQTSCENPGVPRHGSQNNTFGFQVGSVVQFHCKKGHLLQGSTTRTCLPDLTWSGIQPECIPHSCKQPETPAHANVVGMDLPSHGYTLIYTCQPGFFLAGGTEHRVCRSDNTWTGKVPICEAGSKILVKDPRPALGTPSPKLSVPDDVFAQNYIWKGSYNFKGRKQPMTLTVTSFNASTGRVNATLSNSNMELLLSGVYKSQEARLMLRIYLIKVPAHASVKKMKEENWAMDGFVSAEPDGATYVFQGFIQGKDYGQFGLQRLGLNMSEGSNSSNQPHGTNSSSVAIAILVPFFALIFAGFGFYLYKQRTAPKTQYTGCSVHENNNGQAAFENPMYDTNAKSVEGKAVRFDPNLNTVCTMV

SEQ ID NO: 53512 - protein, 3707 aa, Homo sapiens
MKGIRKGESRAKESKPWEPGKRRCAKCGRLDFILMKKMGIKSGFTFWNLVFLLTVSCVKGFIYTCGGTLKGLNGTIESPGFPYGYPNGANCTWVIIAEERNRIQIVFQSFALEEEYDYLSLYDGHPHPTNFRTRLTGFHLPPPVTSTKSVFSLRLTSDFAVSAHGFKVYYEELQSSSCGNPGVPPKGVLYGTRFDVGDKIRYSCVTGYILDGHPQLTCIANSVNTASWDFPVPICRAEDACGGTMRGSSGIISSPSFPNEYHNNADCTWTIVAEPGDTISLIFTDFQMEEKYDYLEIEGSEPPTIWLSGMNIPPPIISNKNWLRLHFVTDSNHRYRGFSAPYQGSSTLTHTTSTGELEEHNRTTTGAIAVASTPADVTVSSVTAVTIHRLSEEQRVQVTSLRNSGLDPNTSKDGLSPHPADTQSTRRRPRHAEQIERTKELAVVTHRVKKAIDFKSRGFKLFPGKDNSNKFSILNEGGIKTASNLCPDPGEPENGKRIGSDFSLGSTVQFSCDEDYVLQGAKSITCQRIAEVFAAWSDHRPVCKVKTCGSNLQGPSGTFTSPNFPFQYDSNAQCVWVITAVNTNKVIQINFEEFDLEIGYDTLTIGDGGEVGDPRTVLQVLTGSFVPDLIVSMSSQMWLHLQTDESVGSVGFKVNYKEIEKESCGDPGTPLYGIREGDGFSNRDVLRFECQFGFELIGEKSIVCQENNQWSANIPICIFPCLSNFTAPMGTVLSPDYPEGYGNNLNCIWTIISDPGSRIHLSFNDFDLESQFDFLAVKDGDSPESPILGTFTGAEVPSHLTSNSHILRLEFQADHSMSGRGFNITYNTFGHNECPDPGIPINARRFGDNFQLGSSISVICEEGFIKTQGTETITCILMDGKVMWSGLIPKCGAPCGGHFSAPSGVILSPGWPGYYKDSLNCEWVIEAEPGHSIKITFERFQTELNYDVLEVHDGPNLLSPLLGSYNGTQVPQFLFSSSNFIYLLFTTDNSRSNNGFKIHYESVTVNTYSCLDPGIPVHGRRYGHDFSIGSTVSFSCDSGYRLSHEEPLLCEKNHWWSHPLPTCDALCGGDVRGPSGTILSPGYPEFYPNSLNCTWTVDVTHGKGVQFNFHTFHLEDHHDYLLITENGSFTQPLARLTGSDLPPTINAGLYGNFRAQLRFISDFSISYEGFNITFSEYNLEPCEDPGIPQYGSRIGFNFGIGDTLTFSCSSGYRLEGTSEIICLGGGRRVWSAPLPRCVAECGASATNNEGILLSPNYPLNYENNHECIYSIQVQAGKGINISARTFHLAQGDVLKIYDGKDKTTHLLGAFTGASMRGLTLSSTSNQLWLEFNSDTEGTDEGFQLVYTSFELSHCEDPGIPQFGYKISDQGHFAGSTIIYGCNPGYTLHGSSLLKCMTGERRAWDYPLPSCIAECGGRFKGESSGRILSPGYPFPYDNNLRCMWMIEVDPGNIVSLQFLAFDTEASHDILRVWDGPPENDMLLKEISGSLIPEGIHSTLNIVTIQFDTDFYISKSGFAIQFSSSVATACRDPGVPMNGTRNGDGREPGDTVVFQCDPGYELQGEERITCIQVENRYFWQPSPPVCIAPCGGNLTGSSGFILSPNFPHPYPHSRDCDWTITVNADYVISLAFISFSIEPNYDFLYIYDGPDSNSPLIGSFQDSKLPERIESSSNTMHLAFRSDGSVSYTGFHLEYKAKLRESCFDPGNIMNGTRLGMDYKLGSTVTYYCDAGYVLQGYSTLTCIMGDDGRPGWNRALPSCHAPCGSRSTGSEGTVLSPNYPKNYSVGHNCVYSIAVPKEFVVFGQFVFFQTSLHDVVEVYDGPTQQSSLLSSLSGSHSGESLPLSSGNQITIRFTSVGPITAKGFHFVYQAVPRTSSTQCSSVPEPRFGRRIGNEFAVGSSVLFDCNPGYILHGSIAIRCETVPNSLAQWNDSLPTCIVPCGGILTKRKGTILSPGYPEPYDNNLNCVWKITVPEGAGIQVQVVSFATEHNWDSLDFYDGGDNNAPRLGSYSGTTIPHLLNSTSNNLYLNFQSDISVSAAGFHLEYTAIGLDSCPEPQTPSSGIKIGDRYMVGDVVSFQCDQGYSLQGHSHITCMPGPVRRWNYPIPICLAQCGGAMSDFSGVILSPGFPGNYPSSLDCTWTINLPIGFGVHLQFVNFSTETIHDYLEVRSGSSETSTVIGRLSGPQIPSSLFSTTHETSLYFHSDYSQNKQGFHIVYQAYQLQSCPDPRPFRNGFVIGNDFTVGQTISFECFPGYTLIGNSALTCLHGVSRNWNHPLPRCEALCGGNITAMNGTIYSPGYPDEYPNFQDCFWLVRVPPGNGIYINFTVLQTEPIYDFITVWDGPDQNSPQIGQFSGNTALESVYSTSNQILIKFHSDFTTSGFFVLSYHAYQLRVCQPPPPVPNAEILTEDDEFEIGDIIRYQCLPGFTLVGNAILTCRLGERLQMDGAPPVCQVLCPANELRLDSTGVILSPGYPDSYPNLQMCAWSISVEKGYNITMFVEFFQTEKEFDVLQVYDGPNIQSPVLISLSGDYSSAFNITSNGHEVFLQWSADHGNNKKGFRIRYIAFYCSTPESPPHGYIISQTGGQLNSVVRWACDRGFRLVGKSSAVCRKSSYGYHAWDAPVPACQAISCGIPKAPTNGGILTTDYLVGTRVTYFCNDGYRLSSKELTTAVCQSDGTWSNHNKTPRCVVVTCPSINSFILEHGRWRIVNGSHYEYKTKVVFSCDPGYHGLGPASIECLPNGTWSWRNERPYCQIISCGELPTPPNGNKIGTQTSYGSTAIFTCDLGFMLVGSAVRECLSSGLWSESETRCLAGHCGIPELIVNGQVIGENYGYRDTVVYQCNPGFRLIGSSVRICQQDHNWSGQLPSCVPVSCGHPGSPIYGRTSGNGFNFNDVVTFSCNIGYLMQGPTKAQCQANRQWSHPPPMCKVVNCSDPGIPANSKRESKIEHGNFTYGTVVFYDCNPGYFLFGSSVLICQPNGQWDKPLPECIMIDCGHPGVPPNAVLSGEKYTFGSTVHYSCTGKRSLLGQSSRTCQLNGHWSGSQPHCSGDATGTCGDPGTPGHGSRQESNFRTKSTVRYACDTGYILHGSEERTCLANGSWTGRQPECKAVQCGNPGTTANGKVFRIDGTTFSSSVIYSCMEGYILSGPSVRQCTANGTWSGTLPNCTIISCGDPGIPANGLRYGDDYVVGQNVSYMCQPGYTMELNGSRIRTCTINGTWSGVMPTCRAVTCPTPPQISNGRLEGTNFDWGFSISYICSPGYELSFPAVLTCVGNGTWSGEVPQCLPKFCGDPGIPAQGKREGKSFIYQSEVSFSCNFPFILVGSSTRICQADGTWSGSSPHCIEPTQTSCENPGVPRHGSQNNTFGFQVGSVVQFHCKKGHLLQGSTTRTCLPDLTWSGIQPECIPHSCKQPETPAHANVVGMDLPSHGYTLIYTCQPGFFLAGGTEHRVCRSDNTWTGKVPICEAGSKILVKDPRPALGTPSPKLSVPDDVFAQNYIWKGSYNFKGRKQPMTLTVTSFNASTGRVNATLSNSNMELLLSGVYKSQEARLMLRIYLIKVPAHASVKKMKEENWAMDGFVSAEPDGATYVFQGFIQGKDYGQFGLQRLGLNMSEGSNSSNQPHGTNSSSVAIAILVPFFALIFAGFGFYLYKQRTAPKTQYTGCSVHENNNGQAAFENPMYDTNAKSVEGKAVRFDPNLNTVCTMV

SEQ ID NO: 53513 - protein, 3667 aa, Homo sapiens
MWSWFLCWKPVQLDRQTASGFIYTCGGTLKGLNGTIESPGFPYGYPNGANCTWVIIAEERNRIQIVFQSFALEEEYDYLSLYDGHPHPTNFRTRLTGFHLPPPVTSTKSVFSLRLTSDFAVSAHGFKVYYEELQSSSCGNPGVPPKGVLYGTRFDVGDKIRYSCVTGYILDGHPQLTCIANSVNTASWDFPVPICRAEDACGGTMRGSSGIISSPSFPNEYHNNADCTWTIVAEPGDTISLIFTDFQMEEKYDYLEIEGSEPPTIWLSGMNIPPPIISNKNWLRLHFVTDSNHRYRGFSAPYQGSSTLTHTTSTGELEEHNRTTTGAIAVASTPADVTVSSVTAVTIHRLSEEQRVQVTSLRNSGLDPNTSKDGLSPHPADTQSTRRRPRHAEQIERTKELAVVTHRVKKAIDFKSRGFKLFPGKDNSNKFSILNEGGIKTASNLCPDPGEPENGKRIGSDFSLGSTVQFSCDEDYVLQGAKSITCQRIAEVFAAWSDHRPVCKVKTCGSNLQGPSGTFTSPNFPFQYDSNAQCVWVITAVNTNKVIQINFEEFDLEIGYDTLTIGDGGEVGDPRTVLQVLTGSFVPDLIVSMSSQMWLHLQTDESVGSVGFKVNYKEIEKESCGDPGTPLYGIREGDGFSNRDVLRFECQFGFELIGEKSIVCQENNQWSANIPICIFPCLSNFTAPMGTVLSPDYPEGYGNNLNCIWTIISDPGSRIHLSFNDFDLESQFDFLAVKDGDSPESPILGTFTGAEVPSHLTSNSHILRLEFQADHSMSGRGFNITYNTFGHNECPDPGIPINARRFGDNFQLGSSISVICEEGFIKTQGTETITCILMDGKVMWSGLIPKCGAPCGGHFSAPSGVILSPGWPGYYKDSLNCEWVIEAEPGHSIKITFERFQTELNYDVLEVHDGPNLLSPLLGSYNGTQVPQFLFSSSNFIYLLFTTDNSRSNNGFKIHYESVTVNTYSCLDPGIPVHGRRYGHDFSIGSTVSFSCDSGYRLSHEEPLLCEKNHWWSHPLPTCDALCGGDVRGPSGTILSPGYPEFYPNSLNCTWTVDVTHGKGVQFNFHTFHLEDHHDYLLITENGSFTQPLARLTGSDLPPTINAGLYGNFRAQLRFISDFSISYEGFNITFSEYNLEPCEDPGIPQYGSRIGFNFGIGDTLTFSCSSGYRLEGTSEIICLGGGRRVWSAPLPRCVAECGASATNNEGILLSPNYPLNYENNHECIYSIQVQAGKGINISARTFHLAQGDVLKIYDGKDKTTHLLGAFTGASMRGLTLSSTSNQLWLEFNSDTEGTDEGFQLVYTSFELSHCEDPGIPQFGYKISDQGHFAGSTIIYGCNPGYTLHGSSLLKCMTGERRAWDYPLPSCIAECGGRFKGESSGRILSPGYPFPYDNNLRCMWMIEVDPGNIVSLQFLAFDTEASHDILRVWDGPPENDMLLKEISGSLIPEGIHSTLNIVTIQFDTDFYISKSGFAIQFSSSVATACRDPGVPMNGTRNGDGREPGDTVVFQCDPGYELQGEERITCIQVENRYFWQPSPPVCIAPCGGNLTGSSGFILSPNFPHPYPHSRDCDWTITVNADYVISLAFISFSIEPNYDFLYIYDGPDSNSPLIGSFQDSKLPERIESSSNTMHLAFRSDGSVSYTGFHLEYKAKLRESCFDPGNIMNGTRLGMDYKLGSTVTYYCDAGYVLQGYSTLTCIMGDDGRPGWNRALPSCHAPCGSRSTGSEGTVLSPNYPKNYSVGHNCVYSIAVPKEFVVFGQFVFFQTSLHDVVEVYDGPTQQSSLLSSLSGSHSGESLPLSSGNQITIRFTSVGPITAKGFHFVYQAVPRTSSTQCSSVPEPRFGRRIGNEFAVGSSVLFDCNPGYILHGSIAIRCETVPNSLAQWNDSLPTCIVPCGGILTKRKGTILSPGYPEPYDNNLNCVWKITVPEGAGIQVQVVSFATEHNWDSLDFYDGGDNNAPRLGSYSGTTIPHLLNSTSNNLYLNFQSDISVSAAGFHLEYTAIGLDSCPEPQTPSSGIKIGDRYMVGDVVSFQCDQGYSLQGHSHITCMPGPVRRWNYPIPICLAQCGGAMSDFSGVILSPGFPGNYPSSLDCTWTINLPIGFGVHLQFVNFSTETIHDYLEVRSGSSETSTVIGRLSGPQIPSSLFSTTHETSLYFHSDYSQNKQGFHIVYQAYQLQSCPDPRPFRNGFVIGNDFTVGQTISFECFPGYTLIGNSALTCLHGVSRNWNHPLPRCEALCGGNITAMNGTIYSPGYPDEYPNFQDCFWLVRVPPGNGIYINFTVLQTEPIYDFITVWDGPDQNSPQIGQFSGNTALESVYSTSNQILIKFHSDFTTSGFFVLSYHAYQLRVCQPPPPVPNAEILTEDDEFEIGDIIRYQCLPGFTLVGNAILTCRLGERLQMDGAPPVCQVLCPANELRLDSTGVILSPGYPDSYPNLQMCAWSISVEKGYNITMFVEFFQTEKEFDVLQVYDGPNIQSPVLISLSGDYSSAFNITSNGHEVFLQWSADHGNNKKGFRIRYIAFYCSTPESPPHGYIISQTGGQLNSVVRWACDRGFRLVGKSSAVCRKSSYGYHAWDAPVPACQAISCGIPKAPTNGGILTTDYLVGTRVTYFCNDGYRLSSKELTTAVCQSDGTWSNHNKTPRCVVVTCPSINSFILEHGRWRIVNGSHYEYKTKVVFSCDPGYHGLGPASIECLPNGTWSWRNERPYCQIISCGELPTPPNGNKIGTQTSYGSTAIFTCDLGFMLVGSAVRECLSSGLWSESETRCLAGHCGIPELIVNGQVIGENYGYRDTVVYQCNPGFRLIGSSVRICQQDHNWSGQLPSCVPVSCGHPGSPIYGRTSGNGFNFNDVVTFSCNIGYLMQGPTKAQCQANRQWSHPPPMCKVVNCSDPGIPANSKRESKIEHGNFTYGTVVFYDCNPGYFLFGSSVLICQPNGQWDKPLPECIMIDCGHPGVPPNAVLSGEKYTFGSTVHYSCTGKRSLLGQSSRTCQLNGHWSGSQPHCSGDATGTCGDPGTPGHGSRQESNFRTKSTVRYACDTGYILHGSEERTCLANGSWTGRQPECKAVQCGNPGTTANGKVFRIDGTTFSSSVIYSCMEGYILSGPSVRQCTANGTWSGTLPNCTIISCGDPGIPANGLRYGDDYVVGQNVSYMCQPGYTMELNGSRIRTCTINGTWSGVMPTCRAVTCPTPPQISNGRLEGTNFDWGFSISYICSPGYELSFPAVLTCVGNGTWSGEVPQCLPKFCGDPGIPAQGKREGKSFIYQSEVSFSCNFPFILVGSSTRICQADGTWSGSSPHCIEPTQTSCENPGVPRHGSQNNTFGFQVGSVVQFHCKKGHLLQGSTTRTCLPDLTWSGIQPECIPHSCKQPETPAHANVVGMDLPSHGYTLIYTCQPGFFLAGGTEHRVCRSDNTWTGKVPICEAGSKILVKDPRPALGTPSPKLSVPDDVFAQNYIWKGSYNFKGRKQPMTLTVTSFNASTGRVNATLSNSNMELLLSGVYKSQEARLMLRIYLIKVPAHASVKKMKEENWAMDGFVSAEPDGATYVFQGFIQGKDYGQFGLQRLGLNMSEGSNSSNQPHGTNSSSVAIAILVPFFALIFAGFGFYLYKQRTAPKTQYTGCSVHENNNGQAAFENPMYDTNAKSVEGKAVRFDPNLNTVCTMV

SEQ ID NO: 53514 - protein, 539 aa, Homo sapiens
MGRAGGGGPGRGPPPLLLFLGAALVLASGAVPAREAGSAVEAEELVKGSPAWEPPANDTREEAGPPAAGEDEASWTAPGGELAGPEEVLQESAAVTGTAWLEADSPGLGGVTAEAGSGDAQALPATLQAPHEVLGQSIMPPAIPEATEASGPPSPTPGDKLSPASELPKESPLEVWLNLGGSTPDPQVPELTYPFQGTLEPQPASDIIDIDYFEGLDGEGRGADLGSFPGSPGTSENHPDTEGETPSWSLLDLYDDFTPFDESDFYPTTSFYDDLDEEEEEEEDDKDAVGGGDLEDENELLVPTGKPGLGPGTGQPTSRWHAVPPQHTLGSVPGSSIALRPRPGEPGRDLASSENGTECRSGFVRHNGSCRSVCDLFPSYCHNGGQCYLVENIGAFCRCNTQDYIWHKGMRCESIITDFQVMCVAVGSAALVLLLLFMMTVFFAKKLYLLKTENTKLRRTNKFRTPSELHNDNFSLSTIAEGSHPNDDPSAPHKIQEVLKSCLKEEESFNIQNSMSPKLEGGKGDQADLDVNCLQNNLT

SEQ ID NO: 53515 - protein, 82 aa, Homo sapiens
MSATWTLSPEPLPPSTGPPVGAGLDAEQRTVFAFVLCLLVVLVLLMVRCVRILLDPYSRMPASSWTDHKEALERGQFDYALV

SEQ ID NO: 53516 - protein, 500 aa, Homo sapiens
MSPGLLLLGSAVLLAFGLCCTFVHRARSRYEHIPGPPRPSFLLGHLPCFWKKDEVGGRVLQDVFLDWAKKYGPVVRVNVFHKTSVIVTSPESVKKFLMSTKYNKDSKMYRALQTVFGERLFGQGLVSECNYERWHKQRRVIDLAFSRSSLVSLMETFNEKAEQLVEILEAKADGQTPVSMQDMLTYTAMDILAKAAFGMETSMLLGAQKPLSQAVKLMLEGITASRNTLAKFLPGKRKQLREVRESIRFLRQVGRDWVQRRREALKRGEEVPADILTQILKAEEGAQDDEGLLDNFVTFFIAGHETSANHLAFTVMELSRQPEIVARLQAEVDEVIGSKRYLDFEDLGRLQYLSQVLKESLRLYPPAWGTFRLLEEETLIDGVRVPGNTPLLFSTYVMGRMDTYFEDPLTFNPDRFGPGAPKPRFTYFPFSLGHRSCIGQQFAQMEVKVVMAKLLQRLEFRLVPGQRFGLQEQATLKPLDPVLCTLRPRGWQPAPPPPPC

SEQ ID NO: 53517 - protein, 599 aa, Homo sapiens
MAVSASPVISATSSGAGVPGGLFRAEPLYSTPREPPRLTPNMINSFVVNNHSNSAGGGGRGNTNTNECRMVDMHGMKVASFLMDGQELICLPQVFDLFLKHLVGGLHTVYTKLKRLDISPVVCTVEQVRILRGLGAIQPGVNRCKLITRKDFETLFTDCTNARRKRQMTRKQAVNSSRPGRPPKRSLGVLQENARLLTHAVPGLLSPGLITPTGITAAAMAEAMKLQKMKLMAMNTLQGNGSQNGTESEPDDLNSNTGGSESSWDKDKMQSPFAAPGPQHGIAHAALAGQPGIGGAPTLNPLQQNHLLTNRLDLPFMMMPHPLLPVSLPPASVAMAMNQMNHLNTIANMAAAAQIHSPLSRAGTSVIKERIPESPSPAPSLEENHRPGSQTSSHTSSSVSSSPSQMDHHLERMEEVPVQIPIMKSPLDKIQLTPGQALPAGFPGPFIFADSLSSVETLLTNIQGLLKVALDNARIQEKQIQQEKKELRLELYREREIRENLERQLAVELQSRTTMQKRLKKEKKTKRKLQEALEFESKRREQVEQALKQATTSDSGLRMLKDTGIPDIEIENNGTPHDSAAMQGGNYYCLEMAQQLYSA

SEQ ID NO: 53518 - protein, 761 aa, Homo sapiens
MNWRFVELLYFLFIWGRISVQPSHQEPAGTDQHVSKEFDWLISDRGPFHHSRSYLSFVERHRQGFTTRYKIYREFARWKVRNTAIERRDLVRHPVPLMPEFQRSIRLLGRRPTTQQFIDTIIKKYGTHLLISATLGGEEALTMYMDKSRLDRKSGNATQSVEALHQLASSYFVDRDGTMRRLHEIQISTGAIKVTETRTGPLGCNSYDNLDSVSSVLLQSTESKLHLQGLQIIFPQYLQEKFVQSALSYIMCNGEGEYLCQNSQCRCQCAEEFPQCNCPITDIQIMEYTLANMAKSWAEAYKDLENSDEFKSFMKRLPSNHFLTIGSIHQHWGNDWDLQNRYKLLQSATEAQRQKIQRTARKLFGLSVRCRHNPNHQLPRERTIQQWLARVQSLLYCNENGFWGTFLESQRSCVCHGSTTLCQRPIPCVIGGNNSCTMCSLANISLCGSCNKGYKLYRGRCEPQNVDSERSEQFISFETDLDFQDLELKYLLQKMDSRLYVHTTFISNEIRLDTFFDPRWRKRMSLTLKSNKNRMDFIHMVIGMSMRICQMRNSSLDPMFFVYVNPFSGSHSEGWNMPFGEFGYPRWEKIRLQNSQCYNWTLLLGNRWKTFFETVHIYLRSRTRLPTLLRNETGQGPVDLSDPSKRQFYIKISDVQVFGYSLRFNADLLRSAVQQVNQSYTQGGQFYSSSSVMLLLLDIRDRINRLAPPVAPGKPQLDLFSCMLKHRLKLTNSEIIRVNHALDLYNTEILKQSDQMTAKLC

SEQ ID NO: 53519 - protein, 657 aa, Homo sapiens
MDFQASHWARGFQNRTCGPRPGSPQPPPRRPWASRVLQEATNWRAGPLAEVRAREQEKRKAASQEREAKETERKRRKAGGARRSPPGRPRPEPRNAPRVAQLAGLPAPLRPERLAPVGRAPRPSAQPQSDPGSAWAGPWGGRRPGPPSYEAHLLLRGSAGTAPRRRWDRPPPYVAPPSYEGPHRTLGTKRGPGNSQVPTSSAPAATPARTDGGRTKKRLDPRIYRDVLGAWGLRQGQGLLGGSPGCGAARARPEPGKGVVEKSLGLAAADLNSGSDSHPQAKATGSAGTEIAPAGSATAAPCAPHPAPRSRHHLKGSREGKEGEQIWFPKCWIPSPKKQPPRHSQTLPRPWAPGGTGWRESLGLGEGAGPETLEGWKATRRAHTLPRSSQGLSRGEGVFVIDATCVVIRSQYVPTPRTQQVQLLPSGVTRVVGDSPSQSKPGKEEGEGATVFPSPCQKRLSSSRLLHQPGGGRGGEAEGGRPGDSTLEERTFRILGLPAPEVNLRDAPTQPGSPEHQALGPAASGAQGRAEGSEVAVVQRRAGRGWARTPGPYAGALREAVSRIRRHTAPDSDTDEAEELSVHSGSSDGSDTEAPGASWRNERTLPEVGNSSPEEDGKTAELSDSVGEILDVISQTEEVLFGVRDIRGTQQGNRKRQ

SEQ ID NO: 53520 - protein, 804 aa, Homo sapiens [sequence omitted]

SEQ ID NO: 53521 - protein, 199 aa, Homo sapiens
MPEQSNDYRVAVFGAGGVGKSSLVLRFVKGTFRESYIPTVEDTYRQVISCDKSICTLQITDTTGSHQFPAMQRLSISKGHAFILVYSITSRQSLEELKPIYEQICEIKGDVESIPIMLVGNKCDESPSREVQSSEAEALARTWKCAFMETSAKLNHNVKELFQELLNLEKRRTVSLQIDGKKSKQQKRKEKLKGKCVIM

SEQ ID NO: 53522 - protein, 913 aa, Homo sapiens
MKDSENKGASSPDMEPSYGGGLFDMVKGGAGRLFSNLKDNLKDTLKDTSSRVIQSVTSYTKGDLDFTYVTSRIIVMSFPLDNVDIGFRNQVDDIRSFLDSRHLDHYTVYNLSPKSYRTAKFHSRVSECSWPIRQAPSLHNLFAVCRNMYNWLLQNPKNVCVVHCLDGRAASSILVGAMFIFCNLYSTPGPAIRLLYAKRPGIGLSPSHRRYLGYMCDLLADKPYRPHFKPLTIKSITVSPIPFFNKQRNGCRPYCDVLIGETKIYSTCTDFERMKEYRVQDGKIFIPLNITVQGDVVVSMYHLRSTIGSRLQAKVTNTQIFQLQFHTGFIPLDTTVLKFTKPELDACDVPEKYPQLFQVTLDVELQPHDKVIDLTPPWEHYCTKDVNPSILFSSHQEHQDTLALGGQAPIDIPPDNPRHYGQSGFFASLCWQDQKSEKSFCEEDHAALVNQESEQSDDELLTLSSPHGNANGDKPHGVKKPSKKQQEPAAPPPPEDVDLLGLEGSAMSNSFSPPAAPPTNSELLSDLFGGGGAAGPTQAGQSGVEDVFHPSGPASTQSTPRRSATSTSASPTLRVGEGATFDPFGAPSKPSGQDLLGSFLNTSSASSDPFLQPTRSPSPTVHASSTPAVNIQPDVSGGWDWHAKPGGFGMGSKSAATSPTGSSHGTPTHQSKPQTLDPFADLGTLGSSSFASKPTTPTGLGGGFPPLSSPQKASPQPMGGGWQQGGAYNWQQPQPKPQPSMPHSSPQNRPNYNVSFSAMPGGQNERGKGSSNLEGKQKAADFEDLLSGQGFNAHKDKKGPRTIAEMRKEEMAKEMDPEKLKILEWIEGKERNIRALLSTMHTVLWAGETKWKPVGMADLVTPEQVKKVYRKAVLVVHPDKATGQPYEQYAKMIFMELNDAWSEFENQGQKPLY

SEQ ID NO: 53523 - protein, 851 aa, Homo sapiens
MGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDMAFETIVKKQVKKIREPCLKCVDMVISELISTVRQCTKKLQQYPRLREEMERIVTTHIREREGRTKEQVMLLIDIELAYMNTNHEDFIGFANAQQRSNQMNKKKTSGNQDEILVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDINTTTVSTPMPPPVDDSWLQVQSVPAGRRSPTSSPTPQRRAPAVPPARPGSRGPAPGPPPAGSALGGAPPVPSRPGASPDPFGPPPQVPSRPNRAPPGVPRITISDP

SEQ ID NO: 53524 - protein, 864 aa, Homo sapiens
MGNRGMEDLIPLVNRLQDAFSAIGQNADLDLPQIAVVGGQSAGKSSVLENFVGRDFLPRGSGIVTRRPLVLQLVNATTEYAEFLHCKGKKFTDFEEVRLEIEAETDRVTGTNKGISPVPINLRVYSPHVLNLTLVDLPGMTKVPVGDQPPDIEFQIRDMLMQFVTKENCLILAVSPANSDLANSDALKVAKEVDPQGQRTIGVITKLDLMDEGTDARDVLENKLLPLRRGYIGVVNRSQKDIDGKKDITAALAAERKFFLSHPSYRHLADRMGTPYLQKVLNQQLTNHIRDTLPGLRNKLQSQLLSIEKEVEEYKNFRPDDPARKTKALLQMVQQFAVDFEKRIEGSGDQIDTYELSGGARINRIFHERFPFELVKMEFDEKELRREISYAIKNIHGIRTGLFTPDMAFETIVKKQVKKIREPCLKCVDMVISELISTVRQCTKKLQQYPRLREEMERIVTTHIREREGRTKEQVMLLIDIELAYMNTNHEDFIGFANAQQRSNQMNKKKTSGNQDEILVIRKGWLTINNIGIMKGGSKEYWFVLTAENLSWYKDDEEKEKKYMLSVDNLKLRDVEKGFMSSKHIFALFNTEQRNVYKDYRQLELACETQEEVDSWKASFLRAGVYPERVGDKEKASETEENGSDSFMHSMDPQLERQVETIRNLVDSYMAIVNKTVRDLMPKTIMHLMINNTKEFIFSELLANLYSCGDQNTLMEESAEQAQRRDEMLRMYHALKEALSIIGDINTTTVSTPMPPPVDDSWLQVQSVPAGRRSPTSSPTPQRRAPAVPPARPGSRGPAPGPPPAGSALGGAPPVPSRPGASPDPFGPPPQVPSRPNRAPPGVPSRSGQASPSRPESPRPPFDL

SEQ ID NO: 53525 - protein, 863 aa, Homo sapiens
MGNREMEELIPLVNRLQDAFSALGQSCLLELPQIAVVGGQSAGKSSVLENFVGRDFLPRGSGIVTRRPLVLQLVTSKAEYAEFLHCKGKKFTDFDEVRLEIEAETDRVTGMNKGISSIPINLRVYSPHVLNLTLIDLPGITKVPVGDQPPDIEYQIREMIMQFITRENCLILAVTPANTDLANSDALKLAKEVDPQGLRTIGVITKLDLMDEGTDARDVLENKLLPLRRGYVGVVNRSQKDIDGKKDIKAAMLAERKFFLSHPAYRHIADRMGTPHLQKVLNQQLTNHIRDTLPNFRNKLQGQLLSIEHEVEAYKNFKPEDPTRKTKALLQMVQQFAVDFEKRIEGSGDQVDTLELSGGAKINRIFHERFPFEIVKMEFNEKELRREISYAIKNIHGIRTGLFTPDMAFEAIVKKQIVKLKGPSLKSVDLVIQELINTVKKCTKKLANFPRLCEETERIVANHIREREGKTKDQVLLLIDIQVSYINTNHEDFIGFANAQQRSSQVHKKTTVGNQVIRKGWLTISNIGIMKGGSKGYWFVLTAESLSWYKDDEEKEKKYMLPLDNLKVRDVEKSFMSSKHIFALFNTEQRNVYKDYRFLELACDSQEDVDSWKASLLRAGVYPDKSVGNNKAENDENGQAENFSMDPQLERQVETIRNLVDSYMSIINKCIRDLIPKTIMHLMINNVKDFINSELLAQLYSSEDQNTLMEESAEQAQRRDEMLRMYQALKEALGIIGDISTATVSTPAPPPVDDSWIQHSRRSPPPSPTTQRRPTLSAPLARPTSGRGPAPAIPSPGPHSGAPPVPFRPGPLPPFPSSSDSFGAPPQVPSRPTRAPPSVPSRRPPPSPTRPTIIRPLESSLLD

SEQ ID NO: 53526 - protein, 2030 aa, Homo sapiens
MWTPTEEEKYGVVICSFRGSVPQGLVLEIGETVQILEKCEGWYRGVSTKKPNVKGIFPANYIHLKKAIVSNRGQYETVVPLEDSIVTEVTATLQEWASLWKQLYVKHKVDLFYKLRHVMNELIDLRRQLLSGHLTQDQVREVKRHITVRLDWGNEHLGLDLVPRKDFEVVDSDQISVSDLYKMHLSSRQSVQQSTSQVDTMRPRHGETCRMPVPHHFFLSLKSFTYNTIGEDTDVFFSLYDMREGKQISERFLVRLNKNGGPRNPEKIERMCALFTDLSSKDMKRDLYIVAHVIRIGRMLLNDSKKGPPHLHYRRPYGCAVLSILDVLQSLTEVKEEKDFVLKVYTCNNESEWSQIHENIIRKSSAKYSAPSASHGLIISLQLLRGDMEQIRRENPMIFNRGLAITRKLGFPDVIMPGDIRNDLYLTLEKGDFERGGKSVQKNIEVTMYVLYADGEILKDCISLGSGEPNRSSYHSFVLYHSNSPRWGEIIKLPIPIDRFRGSHLRFEFRHCSTKDKGEKKLFGFAFSTLMRDDGTTLSDDIHELYVYKCDENSTFNNHALYLGLPCCKEDYNGCPNIPSSLIFQRSTKESFFISTQLSSTKLTQNVDLLALLKWKAFPDRIMDVLGRLRHVSGEEIVKFLQDILDTLFVILDDNTEKYGLLVFQSLVFIINLLRDIKYFHFRPVMDTYIQKHFAGALAYKELIRCLKWYMDCSAELIRQDHIQEAMRALEYLFKFIVQSRILYSRATCGMEEEQFRSSIQELFQSIRFVLSLDSRNSETLLFTQAALLNSFPTIFDELLQMFTVQEVAEFVRGTLGSMPSTVHIGQSMDVVKLQSIARTVDSRLFSFSESRRILLPVVLHHIHLHLRQQKELLICSGILGSIFSIVKTSSLEADVMEEVEMMVESLLDVLLQTLLTIMSKSHAQEAVRGQRCPQCTAEITGEYVSCLLSLLRQMCDTHFQHLLDNFQSKDELKEFLLKIFCVFRNLMKMSVFPRDWMVMRLLTSNIIVTTVQYLSSALHKNFTETDFDFKVWNSYFSLAVLFINQPSLQLEIITSAKRKKILDKYGDMRVMMAYELFSMWQNLGEHKIHFIPGMIGPFLGVTLVPQPEVRNIMIPIFHDMMDWEQRKNGNFKQVEAELIDKLDSMVSEGKGDESYRELFSLLTQLFGPYPSLLEKVEQETWRETGISFVTSVTRLMERLLDYRDCMKGEETENKKIGCTVNLMNFYKSEINKEEMYIRYIHKLCDMHLQAENYTEAAFTLLLYCELLQWEDRPLREFLHYPSQTEWQRKEGLCRKIIHYFNKGKSWEFGIPLCRELACQYESLYDYQSLSWIRKMEASYYDNIMEQQRLEPEFFRVGFYGRKFPFFLRNKEYVCRGHDYERLEAFQQRMLSEFPQAVAMQHPNHPDDAILQCDAQYLQIYAVTPIPDYVDVLQMDRVPDRVKSFYRVNNVRKFRYDRPFHKGPKDKENEFKSLWIERTTLTLTHSLPGISRWFEVERRELVEVSPLENAIQVVENKNQELRSLISQYQHKQVHGNINLLSMCLNGVIDAAVNGGIARYQEAFFDKDYINKHPGDAEKITQLKELMQEQVHVLGVGLAVHEKFVHPEMRPLHKKLIDQFQMMRASLYHEFPGLDKLSPACSGTSTPRGNVLASHSPMSPESIKMTHRHSPMNLMGTGRHSSSSLSSHASSEAGNMVMLGDGSMGDAPEDLYHHMQLAYPNPRYQGSVTNVSVLSSSQASPSSSSLSSTHSAPSQMITSAPSSARGSPSLPDKYRHAREMMLLLPTYRDRPSSAMYPAAILENGQPPNFQRALFQQVVGACKPCSDPNLSVAEKGHYSLHFDAFHHPLGDTPPALPARTLRKSPLHPIPASPTSPQSGLDGSNSTLSGSASSGVSSLSESNFGHSSEAPPRTDTMDSMPSQAWNADEDLEPPYLPVHYSLSESAVLDSIKAQPCRSHSAPGCVIPQDPMDPPALPPKPYHPRLPALEHDEGVLLREETERPRGLHRKAPLPPGSAKEEQARMAWEHGRGEQ

SEQ ID NO: 53527 - protein, 353 aa, Homo sapiens
MATVIPSPLSLGEDFYREAIEHCRSYNARLCAERSLRLPFLDSQTGVAQNNCYIWMEKTHRGPGLAPGQIYTYPARCWRKKRRLNILEDPRLRPCEYKIDCEAPLKKEGGLPEGPVLEALLCAETGEKKIELKEEETIMDCQKQQLLEFPHDLEVEDLEDDIPRRKNRAKGKAYGIGGLRKRQDTASLEDRDKPYVCDKFYKELAWVPEAQRKHTAKKAPDGTVIPNGYCDFCLGGSKKTGCPEDLISCADCGRSGHPSCLQFTVNMTAAVRTYRWQCIECKSCSLCGTSENDGASWAGLTPQDQLLFCDDCDRGYHMYCLSPPMAEPPEGSWSCHLCLRHLKEKASAYITLT

SEQ ID NO: 53528 - protein, 789 aa, Homo sapiens
MRKVESRGEGGREELGSNSPPQRNWKGIAIALLVILVVCSLITMSVILLTPDELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVPTMVIPRFTGALYPKGKQYPYPKAGQVNPTIKLYVVNLYGPTHTLELMPPDSFKSREYYITMVKWVSNTKTVVRWLNRAQNISILTVCETTTGACSKKYEMTSDTWLSQQNEEPVFSRDGSKFFMTVPVKQGGRGEFHHIAMFLIQSKSEQITVRHLTSGNWEVIKILAYDETTQKIYFLSTESSPRGRQLYSASTEGLLNRQCISCNFMKEQCTYFDASFSPMNQHFLLFCEGPRVPVVSLHSTDNPAKYFILESNSMLKEAILKKKIGKPEIKILHIDDYELPLQLSLPKDFMDRNQYALLLIMDEEPGGQLVTDKFHIDWDSVLIDMDNVIVARFDGRGSGFQGLKILQEIHRRLGSVEVKDQITAVKFLLKLPYIDSKRLSIFGKGYGGYIASMILKSDEKLFKCGSVVAPITDLKLYASAFSERYLGMPSKEESTYQAASVLHNVHGLKEENILIIHGTADTKVHFQHSAELIKHLIKAGVNYTMQVYPDEGHNVSEKSKYHLYSTILKFFSDCLKEEISVLPQEPEEDE

SEQ ID NO: 53529 - protein, 796 aa, Homo sapiens
MNQTASVSHHIKCQPSKTIKELGSNSPPQRNWKGIAIALLVILVVCSLITMSVILLTPDELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVPTMVIPRFTGALYPKGKQYPYPKAGQVNPTIKLYVVNLYGPTHTLELMPPDSFKSREYYITMVKWVSNTKTVVRWLNRAQNISILTVCETTTGACSKKYEMTSDTWLSQQNEEPVFSRDGSKFFMTVPVKQGGRGEFHHIAMFLIQSKSEQITVRHLTSGNWEVIKILAYDETTQKIYFLSTESSPRGRQLYSASTEGLLNRQCISCNFMKEQCTYFDASFSPMNQHFLLFCEGPRVPVVSLHSTDNPAKYFILESNSMLKEAILKKKIGKPEIKILHIDDYELPLQLSLPKDFMDRNQYALLLIMDEEPGGQLVTDKFHIDWDSVLIDMDNVIVARFDGRGSGFQGLKILQEIHRRLGSVEVKDQITAVKFLLKLPYIDSKRLSIFGKGYGGYIASMILKSDEKLFKCGSVVAPITDLKLYASAFSERYLGMPSKEESTYQAASVLHNVHGLKEENILIIHGTADTKVHFQHSAELIKHLIKAGVNYTMQVYPDEGHNVSEKSKYHLYSTILKFFSDCLKEEISVLPQEPEEDE

SEQ ID NO: 53530 - protein, 217 aa, Homo sapiens
MVKLGCSFSGKPGKDPGDQDGAAMDSVPLISPLDISQLQPPLPDQVVIKTQTEYQLSSPDQQNFPDLEGQRLNCSHPEEGRRLPTARMIAFAMALLGCVLIMYKAIWYDQFTCPDGFLLRHKICTPLTLEMYYTEMDPERHRSILAAIGAYPLSRKHGTETPAAWGDGYRAAKEERKGPTQAGAAAAATEPPGKPSAKAEKEAARKAAGSAAPPPAQ

SEQ ID NO: 53531 - protein, 443 aa, Homo sapiens
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKGNCTHPEDMKLCTVIMKSNGSFPVNRRRVEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 53532 - protein, 414 aa, Homo sapiens
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 53533 - protein, 351 aa, Homo sapiens
MEDSQETSPSSNNSSEELSSALHLSKGMSIFLDILRRADKNDDGKLSFEEFKAYFADGVLSGEELHELFHTIDTHNTNNLDTEELCEYFSQHLGEYENVLAALEDLNLSILKAMGKTKKDYQEASNLEQFVTRFLLKETLNQLQSLQNSLECAMETTEEQTRQERQGPAKPEVLSIQWPGKRSSRRVQRHNSFSPNSPQFNVSGPGLLEEDNQWMTQINRLQKLIDRLEKKDLKLEPPEEEIIEGNTKSHIMLVQRQMSVIEEDLEEFQLALKHYVESASSQSGCLRISIQKLSNESRYMIYEFWENSSVWNSHLQTNYSKTFQRSNVDFLETPELTSTMLVPASWWILNN

SEQ ID NO: 53534 - protein, 386 aa, Homo sapiens
MCERAARLCRAGAHRLLREPPQQGRALGGLLRWVGARMGEPRESLAPAAPADPGPASPRGGTAVILDIFRRADKNDDGKLSLEEFQLFFADGVLNEKELEDLFHTIDSDNTNHVDTKELCDYFVDHMGDYEDVLASLETLNHSVLKAMGYTKKVYEGGSNVDQFVTRFLLKETANQIQSLLSSVESAVEAIEEQTSQLRQNHIKPSHSAAQTWCGSPTPASAPNHKLMAMEQGKTLPSATEDAKEEGLEAQISRLAELIGRLESKALWFDLQQRLSDEDGTNMHLQLVRQEMAVCPEQLSEFLDSLRQYLRGTTGVRNCFHITAVRLSDGFTFVIYEFWETEEAWKRHLQSPLCKAFRHVKVDTLSQPEALSRILVPAAWCTVGRD

SEQ ID NO: 53535 - protein, 367 aa, Homo sapiens
MVTQILGAMESQVGGGPAGPALPNGPLLGTNGATDDSKTNLIVNYLPQNMTQDEFKSLFGSIGDIESCKLVRDKITGQSLGYGFVNYSDPNDADKAINTLNGLKLQTKTIKVSYARPSSASIRDANLYVSGLPKTMSQKEMEQLFSQYGRIITSRILVDQVTGVSRGVGFIRFDKRIEAEEAIKGLNGQKPLGAAEPITVKFANNPSQKTGQALLTHLYQSSARRYAGPLHHQTQRFRLDNLLNMAYGVKSPLSLIARFSPIAIDGMSGLAGVGLSGGAAGAGWCIFVYNLSPEADESVLWQLFGPFGAVTNVKVIRDFTTNKCKGFGFVTMTNYDEAAMAIASLNGYRLGERVLQVSFKTSKQHKA

SEQ ID NO: 53536 - protein, 360 aa, Homo sapiens
MVTQILGAMESQVGGGPAGPALPNGPLLGTNGATDDSKTNLIVNYLPQNMTQDEFKSLFGSIGDIESCKLVRDKITGQSLGYGFVNYSDPNDADKAINTLNGLKLQTKTIKVSYARPSSASIRDANLYVSGLPKTMSQKEMEQLFSQYGRIITSRILVDQVTGVSRGVGFIRFDKRIEAEEAIKGLNGQKPLGAAEPITVKFANNPSQKTGQALLTHLYQSSARRYAGPLHHQTQRFRLDNLLNMAYGVKRFSPIAIDGMSGLAGVGLSGGAAGAGWCIFVYNLSPEADESVLWQLFGPFGAVTNVKVIRDFTTNKCKGFGFVTMTNYDEAAMAIASLNGYRLGERVLQVSFKTSKQHKA

SEQ ID NO: 53537 - protein, 589 aa, Homo sapiens
MSVSVHENRKSRASSGSINIYLFHKSSYADSVLTHLNLLRQQRLFTDVLLHAGNRTFPCHRAVLAACSRYFEAMFSGGLKESQDSEVNFDNSIHPEVLELLLDYAYSSRVIINEENAESLLEAGDMLEFQDIRDACAEFLEKNLHPTNCLGMLLLSDAHQCTKLYELSWRMCLSNFQTIRKNEDFLQLPQDMVVQLLSSEELETEDERLVYESAINWISYDLKKRYCYLPELLQTVRLALLPAIYLMENVAMEELITKQRKSKEIVEEAIRCKLKILQNDGVVTSLCARPRKTGHALFLLGGQTFMCDKLYLVDQKAKEIIPKADIPSPRKEFSACAIGCKVYITGGRGSENGVSKDVWVYDTLHEEWSKAAPMLVARFGHGSAELKHCLYVVGGHTAATGCLPASPSVSLKQVEHYDPTINKWTMVAPLREGVSNAAVVSAKLKLFAFGGTSVSHDKLPKVQCYDQCENRWTVPATCPQPWRYTAAAVLGNQIFIMGGDTEFSACSAYKFNSETYQWTKVGDVTAKRMSCHAVASGNKLYVVGGYFGIQRCKTLDCYDPTLDVWNSITTVPYSLIPTAFVSTWKHLPS

SEQ ID NO: 53538 - protein, 316 aa, Homo sapiens
MTQGKLSVANKAPGTEGQQQVHGEKKEAPAVPSAPPSYEEATSGEGMKAGAFPPAPTAVPLHPSWAYVDPSSSSSYDNGFPTGDHELFTTFSWDDQKVRRVFVRKVYTILLIQLLVTLAVVALFTFCDPVKDYVQANPGWYWASYAVFFATYLTLACCSGPRRHFPWNLILLTVFTLSMAYLTGMLSSYYNTTSVLLCLGITALVCLSVTVFSFQTKFDFTSCQGVLFVLLMTLFFSGLILAILLPFQYVPWLHAVYAALGAGVFTLFLALDTQLLMGNRRHSLSPEEYIFGALNIYLDIIYIFTFFLQLFGTNRE

SEQ ID NO: 53539 - protein, 144 aa, Homo sapiens
MYSEIQRERADIGGLMARPEYREWNPELIKPKKLLNPVKASRSHQELHRELLMNHRRGLGVDSKPELQRVLEHRRRNQLIKKKKEELEAKRLQCPFEQELLRRQQRLNQLEKPPEKEEDHAPEFIKVRENLRRIATLTSEEREL

SEQ ID NO: 53540 - protein, 487 aa, Homo sapiens
MFSCFCFSLQDNSFSSTTVTECDEDPVSLHEDQTDCSSLRDENNKENYPDAGALVEEHAPPSWEPQQQNVEATVLVDSVLRPSMGNFKSRKPKSIFKAESGRSHGESQETEHVVSSQSECQVRAGTPAHESPQNNAFKCQETVRLQPRIDQRTAISPKDAFETRQDLNEEEAAQVHGVKDPAPASTQSVLADGTDSADPSPVHKDGQNEADSAPEDLHSVGTSRLLYHITDGDNPLLSPRCSIFSQSQRFNLDPESAPSPPSTQQFMMPRSSSRCSCGDGKEPQTITQLTKHIQSLKRKIRKFEEKFEQEKKYRVTKQDKNLIKPLYDRYRIIKQILSTPSLIPTIQEEEDSDEDRPQGSQQPSLADPASHLPVGDHLTYSNETEPVRALLPDEKKEVKPPALSMSNLHEATMPVLLDHLRETRADKKRLRKALREFEEQFFKQTGRSPQKEDRIPMADEYYEYKHIKAKLRLLEVLISKQDVAKTI

SEQ ID NO: 53541 - protein, 585 aa, Homo sapiens
MFSCFCFSLQDNSFSSTTVTECDEDPVSLHEDQTDCSSLRDENNKENYPDAGALVEEHAPPSWEPQQQNVEATVLVDSVLRPSMGNFKSRKPKSIFKAESGRSHGESQETEHVVSSQSECQVRAGTPAHESPQNNAFKCQETVRLQPRIDQRTAISPKDAFETRQDLNEEEAAQVHGVKDPAPASTQSVLADGTDSADPSPVHKDGQNEADSAPEDLHSVGTSRLLYHITDGDNPLLSPRCSIFSQSQRFNLDPESAPSPPSTQQFMMPRSSSRCSCGDGKEPQTITQLTKHIQSLKRKIRKFEEKFEQEKKYRPSHGDKTSNPEVLKWMNDLAKGRKQLKELKLKLSEEQGSAPKGPPRNLLCEQPTVPRENGKPEAAGPEPSSSGEETPDAALTCLKERREQLPPQEDSKVTKQDKNLIKPLYDRYRIIKQILSTPSLIPTIQEEEDSDEDRPQGSQQPSLADPASHLPVGDHLTYSNETEPVRALLPDEKKEVKPPALSMSNLHEATMPVLLDHLRETRADKKRLRKALREFEEQFFKQTGRSPQKEDRIPMADEYYEYKHIKAKLRLLEVLISKQDVAKTI

SEQ ID NO: 53542 - protein, 439 aa, Homo sapiens
MSKTMAMNLLEDWCRGMEVDIHRSLLVTGIPEDCGQAEIEETLNGVLSPLGPYRVLNKIFVREENVKAALIEVGEGVNLSTIPREFPGRGGVWRVVCRDPTQDAEFLKNLNEFLDAEGRTWEDVVRLLQLNHPTLSQNQHQPPENWAEALGVLLGAVVQIIFCMDAEIRSREEARAQEAAEFEEMAAWALAAGRKVKKEPGLAAEVGSALKAETPNNWNATEDQHEPTKPLVRRAGAKSRSRRKKQKKNSRQEAVPWKKPKGINSNSTANLEDPEVGDAESMAISEPIKGSRKPCVNKEELALKKPMAKCAWKGPREPPQDARAEAESPGGASESDQDGGHESPPKKKAVAWVSAKNPAPMRKKKKVSLGPVSYVLVDSEDGRKKPVMPKKGPGSRREASDQKAPRGQQPAEATASTSRGPKAKPEGSPRRATNESRKV

SEQ ID NO: 53543 - protein, 395 aa, Homo sapiens
MDNKRDKAKAGAAARTPAARAPGLLTPRPPGSPRPPPPVTPAALRVLGAAGAVGRKPLAERAGGIGGATIPESAPRAGPTRSAGTSSRNPASRPPASGRGERAPPAKNTSPGPVSSPGRASGTTRPGPLGQKGLRISAEETVARGKATEAPKRSALSAGARRDTSGPTPGTPSPAMARRSRAAGTEVGLPRPAPSARPRPPTEGPRKSVSSASEHSTTEPSPAARRRPSAGGGLQRPASRSLSSSATPLSSPARSGPSARGTPRAPAHPSQPKPKGLQALRPPQVTPPRKDAAPALGPLSSSPLATPSPSGTKARPHAERPRPGRPQQQRHEHARGAAWLRQRARGRCRSLPAPRRRARRLPPGCLESRPRSAAGFPRSPRCAPAVASRYRTGLC

SEQ ID NO: 53544 - protein, 283 aa, Homo sapiens
MMLRQLLAVAAMTMENSDAPQVQSQTTSSSGSKQQQHPGGAGDASPGPGKGKGKRAAELAPRDKAPAAAAAAAAAAAGAGGPRERAAGARAGPGPAVAAAAGGSLVPAARQQHCTQVRSRRLMKELQDIARLSDRFISVELVDESLFDWNVKLHQVDKDSVLWQDMKETNTEFILLNLTFPDNFPFSPPFMRVLSPRLENGYVLDGGAICMELLTPRGWSSAYTVEAVMRQFAASLVKGQGRICRKAGKSKKSFSRKEAEATFKSLVKTHEKYGWVTPPVSDG

SEQ ID NO: 53545 - protein, 214 aa, Homo sapiens
MMLRQLLAVAAMTMERASGARAGPGPAVAAAAGGSLVPAARQQHCTQVRSRRLMKELQDIARLSDRFISVELVDESLFDWNVKLHQVDKDSVLWQDMKETNTEFILLNLTFPDNFPFSPPFMRVLSPRLENGYVLDGGAICMELLTPRGWSSAYTVEAVMRQFAASLVKGQGRICRKAGKSKKSFSRKEAEATFKSLVKTHEKYGWVTPPVSDG

SEQ ID NO: 53546 - protein, 416 aa, Homo sapiens
MKRERGALSRASRALRLAPFVYLLLIQTDPLEGVNITSPVRLIHGTVGKSALLSVQYSSTSSDRPVVKWQLKRDKPVTVVQSIGTEVIGTLRPDYRDRIRLFENGSLLLSDLQLADEGTYEVEISITDDTFTGEKTINLTVDVPISRPQVLVASTTVLELSEAFTLNCSHENGTKPSYTWLKDGKPLLNDSRMLLSPDQKVLTITRVLMEDDDLYSCVVENPISQGRSLPVKITVYRRSSLYIILSTGGIFLLVTLVTVCACWKPSKRKQKKLEKQNSLEYMDQNDDRLKPEADTLPRSGEQERKNPMALYILKDKDSPETEENPAPEPRSATEPGPPGYSVSPAVPGRSPGLPIRSARRYPRSPARSPATGRTHSSPPRAPSSPGRSRSASRTLRTAGVHIIREQDEAGPVEISA

SEQ ID NO: 53547 - protein, 403 aa, Homo sapiens
METYAEVGKEGKPSCASVDLQGDSSLQVEISDAVSERDKVKFTVQTKSCLPHFAQTEFSVVRQHEEFIWLHDAYVENEEYAGLIIPPAPPRPDFEASREKLQKLGEGDSSVTREEFAKMKQELEAEYLAIFKKTVAMHEVFLQRLAAHPTLRRDHNFFVFLEYGQDLSVRGKNRKELLGGFLRNIVKSADEALITGMSGLKEVDDFFEHERTFLLEYHTRIRDACLRADRVMRAHKCLADDYIPISAALSSLGTQEVNQLRTSFLKLAELFERLRKLEGRVASDEDLKLSDMLRYYMRDSQAAKDLLYRRLRALADYENANKALDKARTRNREVRPAESHQQLCCQRFERLSDSAKQELMDFKSRRVSSFRKNLIELAELELKHAKASTLILRNTLVALKGEP

SEQ ID NO: 53548 - protein, 572 aa, Homo sapiens
MDRAGADMWASTFTLAMAERKPQDVWVLLPEHSLVPGCLDGGGVQYLLVGLSRLQCGHCPGTWDSAHVHVLFHLWWDRASHRGLVKMRIWGQRCRLCPAPEDCQVRPPGEQPFLSRLVLHILQDCYGDGPGPARHPREAYEGCCEACELGVCFLQKAPDPAWSANATKGNFPATAWGGTGTVSRGKPLSTPGDDLGKGGVVIAIPFSLVGTSNDQVPIAEGPAPPAGASLPVTGSCEALVTGQGSIFLSGDSVAMPGGKGFPVAIGDPLFHGPGLLGSSIQTFELKGFLFKGRGSLCSPVGVAQGWGPISLNNGLVPVGKHTPTVFYCVGLSASGEGSLTFPSSLTSIFTNTLSEPTDGPVATKEASITFPFIFTDVKDAVAEVAEGNGKEGGGQGLVPVGHDALPETNAGGLPSQVKGSLALPFPADVQGKDAFTDITEGKEKEGGLVTAGHDAPLEANAEGPITVSEGCITIPFAVFDVIKRKGGGHVAYGPQGNGCFSQGYYQKRQLRSRFHKARCGCRREEDERPGRACRRPHAEPYEDFWIWVSMTVCVFWLMCMCRLNPGIYPQQV

SEQ ID NO: 53549 - protein, 129 aa, Homo sapiens [sequence omitted]

SEQ ID NO: 53550 - protein, 493 aa, Homo sapiens
MEPLRAPALRRLLPPLLLLLLSLPPRARAKYVRGNLSSKEDWVFLTRFCFLSDYGRLDFRFRYPEAKCCQNILLYFDDPSQWPAVYKAGDKDCLAKESVIRPENNQVINLTTQYAWSGCQVVSEEGTRYLSCSSGRSFRSGDGLQLEYEMVLTNGKSFWTRHFSADEFGILETDVTFLLIFILIFFLSCYFGYLLKGRQLLHTTYKMFMAAAGVEVLSLLFFCIYWGQYATDGIGNESVKILAKLLFSSSFLIFLLMLILLGKGFTVTRGRISHAGSVKLPVYMTLYTLTHVVLLIYEAEFFDPGQVLYTYESPAGYGLIGLQVAAYVWFCYAVLVSLRHFPEKQPFYVPFFAAYTLWFFAVPVMALIANFGIPKWAREKIVNGIQLGIHLYAHGVFLIMTRPSAANKNFPYHVRTSQIASAGVPGPGGSQSADKAFPQHVYGNVTFISDSVPNFTELFSIPPPATFPLPRAAPDSGLPLFRDLRPPGPLRDL

SEQ ID NO: 53551 - protein, 674 aa, Homo sapiens
MVVAHPTATATTTPTATVTATVVMTTATMDLRDWLFLCYGLIAFLTEVIDSTTCPSVCRCDNGFIYCNDRGLTSIPADIPDDATTLYLQNNQINNAGIPQDLKTKVNVQVIYLYENDLDEFPINLPRSLRELHLQDNNVRTIARDSLARIPLLEKLHLDDNSVSTVSIEEDAFADSKQLKLLFLSRNHLSSIPSGLPHTLEELRLDDNRISTIPLHAFKGLNSLRRLVLDGNLLANQRIADDTFSRLQNLTELSLVRNSLAAPPLNLPSAHLQKLYLQDNAISHIPYNTLAKMRELERLDLSNNNLTTLPRGLFDDLGNLAQLLLRNNPWFCGCNLMWLRDWVKARAAVVNVRGLMCQGPEKVRGMAIKDITSEMDECFETGPQGGVANAAAKTTASNHASATTPQGSLFTLKAKRPGLRLPDSNIDYPMATGDGAKTLAIHVKALTADSIRITWKATLPASSFRLSWLRLGHSPAVGSITETLVQGDKTEYLLTALEPKSTYIICMVTMETSNAYVADETPVCAKAETADSYGPTTTLNQEQNAGPMASLPLAGIIGGAVALVFLFLVLGAICWYVHQAGELLTRERAYNRGSRKKDDYMESGTKKDNSILEIRGPGLQMLPINPYRAKEEYVVHTIFPSNGSSLCKATHTIGYGTTRGYRDGGIPDIDYSYT

SEQ ID NO: 53552 - protein, 1322 aa, Homo sapiens
MDVFSFVKIAKLSSHRTKSSGWPPPSGTWGLSQVPPYGWEMTANRDGRDYFINHMTQAIPFDDPRLESCQIIPPAPRKVEMRRDPVLGFGFVAGSEKPVVVRSVTPGGPSEGKLIPGDQIVMINDEPVSTAPRERVIDLVRSCKESILLTVIQPYPSPKSAFISAAKKARLKSNPVKVRFSEEVIINGQVSETVKDNSLLFMPNVLKVYLENGQTKSFRFDCSTSIKDVILTLQEKLSIKGIEHFSLMLEQRTEGAGTKLLLLHEQETLTQVTQRPSSHKMRCLFRISFVPKDPIDLLRRDPVAFEYLYVQSCNDVVQERFGPELKYDIALRLAALQMYIATVTTKQTQKISLKYIEKEWGLETFLPSAVLQSMKEKNIKKALSHLVKANQNLVPPGKKLSALQAKVHYLKFLSDLRLYGGRVFKATLVQAEKRSEVTLLVGPRYGISHVINTKTNLVALLADFSHVNRIEMFSEEESLVRVELHVLDVKPITLLMESSDAMNLACLTAGYYRLLVDSRRSIFNMANKKNTATQETGPENKGKHNLLGPDWNCIPQMTTFIGEGEQEAQITYIDSKQKTVEITDSTMCPKEHRHLYIDNAYSSDGLNQQLSQPGEAPCEADYRSLAQRSLLTLSGPETLKKAQESPRGAKVSFIFGDFALDDGISPPTLGYETLLDEGPEMLEKQRNLYIGSANDMKGLDLTPEAEGIQFVENSVYANIGDVKSFQAAEGIEEPLLHDICYAENTDDAEDEDEVSCEEDLVVGEMNQPAILNLSGSSDDIIDLTSLPPPEGDDNEDDFLLRSLNMAIAAPPPGFRDSSDEEDSQSQAASFPEDKEKGSSLQNDEIPVSLIDAVPTSAEGKCEKGLDNAVVSTLGALEALSVSEEQQTSDNSGVAILRAYSPESSSDSGNETNSSEMTESSELATAQKQSENLSRMFLATHEGYHPLAEEQTEFPASKTPAGGLPPKSSHALAARPATDLPPKVVPSKQLLHSDHMEMEPETMETKSVTDYFSKLHMGSVAYSCTSKRKSKLADGEGKAPPNGNTTGKKQQGTKTAEMEEEASGKFGTVSSRDSQHLSTFNLERTAFRKDSQRWYVATEGGMAEKSGLEAATGKTFPRASGLGAREAEGKEEGAPDGETSDGSGLGQGDRFLTDVTCASSAKDLDNPEDADSSTCDHPSKLPEADESVARLCDYHLAKRMSSLQSEGHFSLQSSQGSSVDAGCGTGSSGSACATPVESPLCPSLGKHLIPDASGKGVNYIPSEERAPGLPNHGATFKELHPQTEGMCPRMTVPALHTAINTEPLFGTLRDGCHRLPKIKETTV

SEQ ID NO: 53553 - protein, 847 aa, Homo sapiens
MFKCWSVVLVLGFIFLESEGRPTKEGGYGLKSYQPLMRLRHKQEKNQESSRVKGFMIQDGPFGSCENKYCGLGRHCVTSRETGQAECACMDLCKRHYKPVCGSDGEFYENHCEVHRAACLKKQKITIVHNEDCFFKGDKCKTTEYSKMKNMLLDLQNQKYIMQENENPNGDDISRKKLLVDQMFKYFDADSNGLVDINELTQVIKQEELGKDLFDCTLYVLLKYDDFNADKHLALEEFYRAFQVIQLSLPEDQKLSITAATVGQSAVLSCAIQGTLRPPIIWKRNNIILNNLDLEDINDFGDDGSLYITKVTTTHVGNYTCYADGYEQVYQTHIFQVNVPPVIRVYPESQAREPGVTASLRCHAEGIPKPQLGWLKNGIDITPKLSKQLTLQANGSEVHISNVRYEDTGAYTCIAKNEAGVDEDISSLFVEDSARKTLANILWREEGLGIGNMFYVFYEDGIKVIQPIECEFQRHIKPSEKLLGFQDEVCPKAEGDEVQRCVWASAVNVKDKFIYVAQPTLDRVLIVDVQSQKVVQAVSTDPVPVKLHYDKSHDQVWVLSWGTLEKSSPTLQVITLASGNVPHHTIHTQPVGKQFDRVDDFFIPTTTLIITHMRFGFILHKDEAALQKIDIETMSYIKTINLKDYKCVPQSLAYTHLGGYYFIGCKPDSTGAVSPQVMVDGVTDSVIGFNSDVTGTPYVSPDGHYLVSINDVKGLVRVQYITIRGEIQEAFDIYTNLHISDLAFQPSFTEAHQYNIYGSSSTQTDVLFVELSSGKVKMIKSLKEPLKAEEWPWNRKNRQIQDSGLFGQYLMTPSKDSLFILDGRLNKLNCEITEVEKGNTVIWVGDA

SEQ ID NO: 53554 - protein, 80 aa, Homo sapiens
MATPTQTPTKAPEEPDPFYYDYNTVQTVGMTLATILFLLGILIVISKKVKCRKADSRSESPTCKSCKSELPSSAPGGGGV

SEQ ID NO: 53555 - protein, 941 aa, Homo sapiens
MASPRSSGQPGPPPPPPPPPARLLLLLLLPLLLPLAPGAWGWARGAPRPPPSSPPLSIMGLMPLTKEVAKGSIGRGVLPAVELAIEQIRNESLLRPYFLDLRLYDTECDNAKGLKAFYDAIKYGPNHLMVFGGVCPSVTSIIAESLQGWNLVQLSFAATTPVLADKKKYPYFFRTVPSDNAVNPAILKLLKHYQWKRVGTLTQDVQRFSEVRNDLTGVLYGEDIEISDTESFSNDPCTSVKKLKGNDVRIILGQFDQNMAAKVFCCAYEENMYGSKYQWIIPGWYEPSWWEQVHTEANSSRCLRKNLLAAMEGYIGVDFEPLSSKQIKTISGKTPQQYEREYNNKRSGVGPSKFHGYAYDGIWVIAKTLQRAMETLHASSRHQRIQDFNYTDHTLGRIILNAMNETNFFGVTGQVVFRNGERMGTIKFTQFQDSREVKVGEYNAVADTLEIINDTIRFQGSEPPKDKTIILEQLRKISLPLYSILSALTILGMIMASAFLFFNIKNRNQKLIKMSSPYMNNLIILGGMLSYASIFLFGLDGSFVSEKTFETLCTVRTWILTVGYTTAFGAMFAKTWRVHAIFKNVKMKKKIIKDQKLLVIVGGMLLIDLCILICWQAVDPLRRTVEKYSMEPDPAGRDISIRPLLEHCENTHMTIWLGIVYAYKGLLMLFGCFLAWETRNVSIPALNDSKYIGMSVYNVGIMCIIGAAVSFLTRDQPNVQFCIVALVIIFCSTITLCLVFVPKLITLRTNPDAATQNRRFQFTQNQKKEDSKTSTSVTSVNQASTSRLEGLQSENHRLRMKITELDKDLEEVTMQLQDTPEKTTYIKQNHYQELNDILNLGNFTESTDGGKAILKNHLDQNPQLQWNTTEPSRTCKDPIEDINSPEHIQRRLSLQLPILHHAYLPSIGGVDASCVSPCVSPTASPRHRHVPPSFRVMVSGL

SEQ ID NO: 53556 - protein, 456 aa, Homo sapiens
MRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIWTPDTFFHNGKKSVAHNMTMPNKLLRITEDGTLLYTMRLTVRAECPMHLEDFPMDAHACPLKFGSYAYTRAEVVYEWTREPARSVVVAEDGSRLNQYDLLGQTVDSGIVQSSTGEYVVMTTHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGYAWDGKSVVPEKPKKVKDPLIKKNNTYAPTATSYTPNLARGDPGLATIAKSATIEPKEVKPETKPPEPKKTFNSVSKIDRLSRIAFPLLFGIFNLVYWATYLNREPQLKAPTPHQ

SEQ ID NO: 53557 - protein, 554 aa, Homo sapiens [sequence omitted]

SEQ ID NO: 53558 - protein, 474 aa, Homo sapiens
MWTVQNRESLGLLSFPVMITMVCCAHSTNEPSNMPYVKETVDRLLKGYDIRLRPDFGGPPVDVGMRIDVASIDMVSEVNMDYTLTMYFQQSWKDKRLSYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWNGGEGAVTGVNKIELPQFSIVDYKMVSKKVEFTTGAYPRLSLSFRLKRNIGYFILQTYMPSTLITILSWVSFWINYDASAARVALGITTVLTMTTISTHLRETLPKIPYVKAIDIYLMGCFVFVFLALLEYAFVNYIFFGKGPQKKGASKQDQSANEKNKLEMNKVQVDAHGNILLSTLEIRNETSGSEVLTSVSDPKATMYSYDSASIQYRKPLSSREAYGRALDRHGVPSKGRIRRRASQLKVKIPDLTDVNSIDKWSRMFFPITFSLFNVVYWLYYVH

SEQ ID NO: 53559 - protein, 452 aa, Homo sapiens [sequence omitted]

SEQ ID NO: 53560 - protein, 465 aa, Homo sapiens
MGPLKAFLFSPFLLRSQSRGVRLVFLLLTLHLGNCVDKADDEDDEDLTVNKTWVLAPKIHEGDITQILNSLLQGYDNKLRPDIGVRPTVIETDVYVNSIGPVDPINMEYTIDIIFAQTWFDSRLKFNSTMKVLMLNSNMVGKIWIPDTFFRNSRKSDAHWITTPNRLLRIWNDGRVLYTLRLTINAECYLQLHNFPMDEHSCPLEFSSYGYPKNEIEYKWKKPSVEVADPKYWRLYQFAFVGLRNSTEITHTISGDYVIMTIFFDLSRRMGYFTIQTYIPCILTVVLSWVSFWINKDAVPARTSLGITTVLTMTTLSTIARKSLPKVSYVTAMDLFVSVCFIFVFAALMEYGTLHYFTSNQKGKTATKDRKLKNKASMTPGLHPGSTLIPMNNISVPQEDDYGYQCLEGKDCASFFCCFEDCRTGSWREGRIHIRIAKIDSYSRIFFPTAFALFNLVYWVGYLYL

SEQ ID NO: 53561 - protein, 237 aa, Homo sapiens
MEVLPCSRVAHIERTRKPYNNDIDYYAKRNALRAAEVWMDDFKSHVYMAWNIPMSNPGVDFGDVSERLALRQRLKCRSFKWYLENVYPEMRVYNNTLTYGEVRNSKASAYCLDQGAEDGDRAILYPCHGMSSQLVRYSADGLLQLGPLGSTAFLPDSKCLVDDGTGRMPTLKKCEDVARPTQRLWDFTQSGPIVSRATGRCLEVEMSKDANFGLRLVVQRCSGQKWMIRNWIKHARH

SEQ ID NO: 53562 - protein, 238 aa, Homo sapiens
MLCCMRRTKQVEKNDDDQKIEQDGIKPEDKAHKAATKIQASFRGHITRKKLKGEKKDDVQAAEAEANKKDEAPVADGVEKKGEGTTTAEAAPATGSKPDEPGKAGETPSEEKKGEGDAATEQAAPQAPASSEEKAGSAETESATKASTDNSPSSKAEDAPAKEEPKQADVPAAVTAAAATTPAAEDAAAKATAQPPTETGESSQAEENIEAVDETKPKESARQDEGKEEEPEADQEHA

SEQ ID NO: 53563 - protein, 75 aa, Homo sapiens
MKGETPVNSTMSIGQARKMVEQLKIEASLCRIKVSKAAADLMTYCDAHACEDPLITPVPTSENPFREKKFFCALL

SEQ ID NO: 53564 - protein, 68 aa, Homo sapiens
MSATNNIAQARKLVEQLRIEAGIERIKVSKAASDLMSYCEQHARNDPLLVGVPASENPFKDKKPCIIL

SEQ ID NO: 53565 - protein, 572 aa, Homo sapiens
MDAQTWPVGFRCLLLLALVGSARSEGVQTCEEVRKLFQWRLLGAVRGLPDSPRAGPDLQVCISKKPTCCTRKMEERYQIAARQDMQQFLQTSSSTLKFLISRNAAAFQETLETLIKQAENYTSILFCSTYRNMALEAAASVQEFFTDVGLYLFGADVNPEEFVNRFFDSLFPLVYNHLINPGVTDSSLEYSECIRMARRDVSPFGNIPQRVMGQMGRSLLPSRTFLQALNLGIEVINTTDYLHFSKECSRALLKMQYCPHCQGLALTKPCMGYCLNVMRGCLAHMAELNPHWHAYIRSLEELSDAMHGTYDIGHVLLNFHLLVNDAVLQAHLNGQKLLEQVNRICGRPVRTPTQSPRCSFDQSKEKHGMKTTTRNSEETLANRRKEFINSLRLYRSFYGGLADQLCANELAAADGLPCWNGEDIVKSYTQRVVGNGIKAQSGNPEVKVKGIDPVINQIIDKLKHVVQLLQGRSPKPDKWELLQLGSGGGMVEQVSGDCDDEDGCGGSGSGEVKRTLKITDWMPDDMNFSDVKQIHQTDTGSTLDTTGAGCAVATESMTFTLISVVMLLPGIW

SEQ ID NO: 53566 - protein, 278 aa, Homo sapiens
MEENMEEGQTQKGCFECCIKCLGGIPYASLIATILLYAGVALFCGCGHEALSGTVNILQTYFEMARTAGDTLDVFTMIDIFKYVIYGIAAAFFVYGILLMVEGFFTTGAIKDLYGDFKITTCGRCVSAWFIMLTYLFMLAWLGVTAFTSLPVYMYFNLWTICRNTTLVEGANLCLDLRQFGIVTIGEEKKICTVSENFLRMCESTELNMTFHLFIVALAGAGAAVIAMVHYLMVLSANWAYVKDACRMQKYEDIKSKEEQELHDIHSTRSKERLNAYT

SEQ ID NO: 53567 - protein, 278 aa, Homo sapiens; identical to SEQ ID NO: 53566

SEQ ID NO: 53568 - protein, 267 aa, Homo sapiens
MGCFECCIKCLGGIPYASLIATILLYAGVALFCGCGHEALSGTVNILQTYFEMARTAGDTLDVFTMIDIFKYVIYGIAAAFFVYGILLMVEGFFTTGAIKDLYGDFKITTCGRCVSAWFIMLTYLFMLAWLGVTAFTSLPVYMYFNLWTICRNTTLVEGANLCLDLRQFGIVTIGEEKKICTVSENFLRMCESTELNMTFHLFIVALAGAGAAVIAMVHYLMVLSANWAYVKDACRMQKYEDIKSKEEQELHDIHSTRSKERLNAYT

SEQ ID NO: 53569 - protein, 367 aa, Homo sapiens
MSKRSWWAGSRKPPREMLKLSGSDSSQSMNGLEVAPPGLITNFSLATAEQCGQETPLENMLFASFYLLDFILALVGNTLALWLFIRDHKSGTPANVFLMHLAVADLSCVLVLPTRLVYHFSGNHWPFGEIACRLTGFLFYLNMYASIYFLTCISADRFLAIVHPVKSLKLRRPLYAHLACAFLWVVVAVAMAPLLVSPQTVQTNHTVVCLQLYREKASHHALVSLAVAFTFPFITTVTCYLLIIRSLRQGLRVEKRLKTKAVRMIAIVLAIFLVCFVPYHVNRSVYVLHYRSHGASCATQRILALANRITSCLTSLNGALDPIMYFFVAEKFRHALCNLLCGKRLKGPPPSFEGKTNESSLSAKSEL

SEQ ID NO: 53570 - protein, 384 aa, Homo sapiens
MTNSSSTSTSSTTGGSLLLLCEEEESWAGRRIPVSLLYSGLAIGGTLANGMVIYLVSSFRKLQTTSNAFIVNGCAADLSVCALWMPQEAVLGLLPTGSAEPPADWDGAGGSYRLLRGGLLGLGLTVSLLSHCLVALNRYLLITRAPATYQALYQRRHTAGMLALSWALALGLVLLLPPWAPRPGAAPPRIHYPALLAAAALLAQTALLLHCYLGIVRRVRVSVKRVSVLNFHLLHQLPGCAAAAAAFPGAQHAPGPGGAAHPAQAQPLPPALHPRRAQRRLSGLSVLLLCCVFLLATQPLVWVSLASGFSLPVPWGVHAASWLLCCALSALNPLLYTWRNEEFRRSVRSVLPGVGDAAAAAVAATAVPAVSQAQLGTRAAGQHW

SEQ ID NO: 53571 - protein, 1464 aa, Homo sapiens [sequence omitted]

SEQ ID NO: 53572 - protein, 1233 aa, Homo sapiens
MGGALGPALLLTSLFGAWAGLGPGQGEQGMTVAVVFSSSGPPQAQFRARLTPQSFLDLPLEIQPLTVGVNTTNPSSLLTQICGLLGAAHVHGIVFEDNVDTEAVAQILDFISSQTHVPILSISGGSAVVLTPKEPGSAFLQLGVSLEQQLQVLFKVLEEYDWSAFAVITSLHPGHALFLEGVRAVADASHVSWRLLDVVTLELGPGGPRARTQRLLRQLDAPVFVAYCSREEAEVLFAEAAQAGLVGPGHVWLVPNLALGSTDAPPATFPVGLISVVTESWRLSLRQKVRDGVAILALGAHSYWRQHGTLPAPAGDCRVHPGPVSPAREAFYRHLLNVTWEGRDFSFSPGGYLVQPTMVVIALNRHRLWEMVGRWEHGVLYMKYPVWPRYSASLQPVVDSRHLTVATLEERPFVIVESPDPGTGGCVPNTVPCRRQSNHTFSSGDVAPYTKLCCKGFCIDILKKLARVVKFSYDLYLVTNGKHGKRVRGVWNGMIGEVYYKRADMAIGSLTINEERSEIVDFSVPFVETGISVMVARSNGTVSPSAFLEPYSPAVWVMMFVMCLTVVAITVFMFEYFSPVSYNQNLTRGKKSGGPAFTIGKSVWLLWALVFNNSVPIENPRGTTSKIMVLVWAFFAVIFLASYTANLAAFMIQEQYIDTVSGLSDKKFQRPQDQYPPFRFGTVPNGSTERNIRSNYRDMHTHMVKFNQRSVEDALTSLKMGKLDAFIYDAAVLNYMAGKDEGCKLVTIGSGKVFATTGYGIAMQKDSHWKRAIDLALLQFLGDGETQKLETVWLSGICQNEKNEVMSSKLDIDNMAGVFYMLLVAMGLALLVFAWEHLVYWKLRHSVPNSSQLDFLLAFSRGIYSCFSGVQSLASPPRQASPDLTASSAQASVLKMLQAARDMVTTAGVSSSLDRATRTIENWGGGRRAPPPSPCPTPRSGPSPCLPTPDPPPEPSPTGWGPPDGGRAALVRRAPQPPGRPPTPGPPLSDVSRVSRRPAWEARWPVRTGHCGRHLSASERPLSPARCHYSSFPRADRSGRPFLPLFPELEDLPLLGPEQLARREALLHAAWARGSRPRHASLPSSVAEAFARPSSLPAGCTGPACARPDGHSACRRLAQAQSMCLPIYREACQEGEQAGAPAWQHRQHVCLHAHAHLPFCWGAVCPHLPPCASHGSWLSGAWGPLGHRGRTLGLGTGYRDSGGLDEISRVARGTQGFPGPCTWRRISSLESEV

SEQ ID NO: 53573 - protein, 1115 aa, Homo sapiens
MRRLSLWWLLSRVCLLLPPPCALVLAGVPSSSSHPQPCQILKRIGHAVRVGAVHLQPWTTAPRAASRAPDDSRAGAQRDEPEPGTRRSPAPSPGARWLGSTLHGRGPPGSRKPGEGARAEALWPRDALLFAVDNLNRVEGLLPYNLSLEVVMAIEAGLGDLPLLPFSSPSSPWSSDPFSFLQSVCHTVVVQGVSALLAFPQSQGEMMELDLVSLVLHIPVISIVRHEFPRESQNPLHLQLSLENSLSSDADVTVSILTMNNWYNFSLLLCQEDWNITDFLLLTQNNSKFHLGSIINITANLPSTQDLLSFLQIQLESIKNSTPTVVMFGCDMESIRRIFEITTQFGVMPPELRWVLGDSQNVEELRTEGLPLGLIAHGKTTQSVFEHYVQDAMELVARAVATATMIQPELALIPSTMNCMEVETTNLTSGQYLSRFLANTTFRGLSGSIRVKGSTIVSSENNFFIWNLQHDPMGKPMWTRLGSWQGGKIVMDYGIWPEQAQRHKTHFQHPSKLHLRVVTLIEHPFVFTREVDDEGLCPAGQLCLDPMTNDSSTLDSLFSSLHSSNDTVPIKFKKCCYGYCIDLLEKIAEDMNFDFDLYIVGDGKYGAWKNGHWTGLVGDLLRGTAHMAVTSFSINTARSQVIDFTSPFFSTSLGILVRTRDTAAPIGAFMWPLHWTMWLGIFVALHITAVFLTLYEWKSPFGLTPKGRNRSKVFSFSSALNICYALLFGRTVAIKPPKCWTGRFLMNLWAIFCMFCLSTYTANLAAVMVGEKIYEELSGIHDPKLHHPSQGFRFGTVRESSAEDYVRQSFPEMHEYMRRYNVPATPDGVEYLKNDPEKLDAFIMDKALLDYEVSIDADCKLLTVGKPFAIEGYGIGLPPNSPLTANISELISQYKSHGFMDMLHDKWYRVVPCGKRSFAVTETLQMGIKHFSGLFVLLCIGFGLSILTTIGEHIVYRLLLPRIKNKSKLQYWLHTSQRLHRAINTSFIEEKQQHFKTKRVEKRSNVGPRQLTVWNTSNLSHDNRRKYIFSDEEGQNQLGIQIHQDIPLPPRRRELPALRTTNGKADSLNVSRNSVMQELSELEKQIQVIRQELQLAVSRKTELEEYQRTSRTCES

SEQ ID NO: 53574 - protein, 879 aa, Homo sapiens
MKMLTRLQVLTLALFSKGFLLSLGDHNFLRREIKIEGDLVLGGLFPINEKGTGTEECGRINEDRGIQRLEAMLFAIDEINKDDYLLPGVKLGVHILDTCSRDTYALEQSLEFVRASLTKVDEAEYMCPDGSYAIQENIPLLIAGVIGGSYSSVSIQVANLLRLFQIPQISYASTSAKLSDKSRYDYFARTVPPDFYQAKAMAEILRFFNWTYVSTVASEGDYGETGIEAFEQEARLRNICIATAEKVGRSNIRKSYDSVIRELLQKPNARVVVLFMRSDDSRELIAAASRANASFTWVASDGWGAQESIIKGSEHVAYGAITLELASQPVRQFDRYFQSLNPYNNHRNPWFRDFWEQKFQCSLQNKRNHRRVCDKHLAIDSSNYEQESKIMFVVNAVYAMAHALHKMQRTLCPNTTKLCDAMKILDGKKLYKDYLLKINFTAPFNPNKDADSIVKFDTFGDGMGRYNVFNFQNVGGKYSYLKVGHWAETLSLDVNSIHWSRNSVPTSQCSDPCAPNEMKNMQPGDVCCWICIPCEPYEYLADEFTCMDCGSGQWPTADLTGCYDLPEDYIRWEDAWAIGPVTIACLGFMCTCMVVTVFIKHNNTPLVKASGRELCYILLFGVGLSYCMTFFFIAKPSPVICALRRLGLGSSFAICYSALLTKTNCIARIFDGVKNGAQRPKFISPSSQVFICLGLILVQIVMVSVWLILEAPGTRRYTLAEKRETVILKCNVKDSSMLISLTYDVILVILCTVYAFKTRKCPENFNEAKFIGFTMYTTCIIWLAFLPIFYVTSSDYRVQTTTMCISVSLSGFVVLGCLFAPKVHIILFQPQKNVVTHRLHLNRFSVSGTGTTYSQSSASTYVPTVCNGREVLDSTTSSL

SEQ ID NO: 53575 - protein, 912 aa, Homo sapiens
MPGKRGLGWWWARLPLCLLLSLYGPWMPSSLGKPKGHPHMNSIRIDGDITLGGLFPVHGRGSEGKPCGELKKEKGIHRLEAMLFALDRINNDPDLLPNITLGARILDTCSRDTHALEQSLTFVQALIEKDGTEVRCGSGGPPIITKPERVVGVIGASGSSVSIMVANILRLFKIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 53576 - protein, 340 aa, Homo sapiens
MPGWLTLPTLCRFLLWAFTIFHKAQGDPASHPGPHYLLPPIHEVIHSHRGATATLPCVLGTTPPSYKVRWSKVEPGELRETLILITNGLHARGYGPLGGRARMRRGHRLDASLVIAGVRLEDEGRYRCELINGIEDESVALTLSLEGVVFPYQPSRGRYQFNYYEAKQACEEQDGRLATYSQLYQAWTEGLDWCNAGWLLEGSVRYPVLTARAPCGGRGRPGIRSYGPRDRMRDRYDAFCFTSALAGQVFFVPGRLTLSEAHAACRRRGAVVAKVGHLYAAWKFSGLDQCDGGWLADGSVRFPITTPRPRCGGLPDPGVRSFGFPRPQQAAYGTYCYAEN

SEQ ID NO: 53577 - protein, 889 aa, Homo sapiens
MDARGGGGRPGESPGATPAPGPPPPPPPAPPQQQPPPPPPPAPPPGPGPAPPQHPPRAEALPPEAADEGGPRGRLRSRDSSCGRPGTPGAASTAKGSPNGECGRGEPQCSPAGPEGPARGPKVSFSCRGAASGPAPGPGPAEEAGSEEAGPAGEPRGSQASFMQRQFGALLQPGVNKFSLRMFGSQKAVEREQERVKSAGAWIIHPYSDFRFYWDFTMLLFMVGNLIIIPVGITFFKDETTAPWIVFNVVSDTFFLMDLVLNFRTGIVIEDNTEIILDPEKIKKKYLRTWFVVDFVSSIPVDYIFLIVEKGIDSEVYKTARALRIVRFTKILSLLRLLRLSRLIRYIHQWEEIFHMTYDLASAVMRICNLISMMLLLCHWDGCLQFLVPMLQDFPRNCWVSINGMVNHSWSELYSFALFKAMSHMLCIGYGRQAPESMTDIWLTMLSMIVGATCYAMFIGHATALIQSLDSSRRQYQEKYKQVEQYMSFHKLPADFRQKIHDYYEHRYQGKMFDEDSILGELNGPLREEIVNFNCRKLVASMPLFANADPNFVTAMLTKLKFEVFQPGDYIIREGTIGKKMYFIQHGVVSVLTKGNKEMKLSDGSYFGEICLLTRGRRTASVRADTYCRLYSLSVDNFNEVLEEYPMMRRAFETVAIDRLDRIGKKNSILLHKVQHDLNSGVFNNQENAIIQEIVKYDREMVQQAELGQRVGLFPPPPPPPQVTSAIATLQQAAAMSFCPQVARPLVGPLALGSPRLVRRPPPGPAPAAASPGPPPPASPPGAPASPRAPRTSPYGGLPAAPLAGPALPARRLSRASRPLSASQPSLPHGAPGPAASTRPASSSTPRLRPTPAARAAAPSPDRRDSASPGAAGGLDPQDSARSRLSSNL

SEQ ID NO: 53578 - protein, 88 aa, Homo sapiens
MGNWGLGIAPWVDGESELEFRRLGMQGPLEALRRRERNTQRASFSFSFLIALSPHTVDYCHSYELFNRRWHGHVLATQRPSLFILMLV

SEQ ID NO: 53579 - protein, 171 aa, Homo sapiens
MVKLNSNPSEKGTKPPSVEDGFQTVPLITPLEVNHLQLPAPEKVIVKTRTEYQPEQKNKGKFRVPKIAEFTVTILVSLALAFLACIVFLVVYKAFTYDHSCPEGFVYKHKRCIPASLDAYYSSQDPNSRSRFYTVISHYSVAKQSTARAIGPWLSAAAVIHEPKPPKTQGH

SEQ ID NO: 53580 - protein, 193 aa, Homo sapiens
MGKQNSKLRPEMLQDLRENTEFSELELQEWYKGFLKDCPTGILNVDEFKKIYANFFPYGDASKFAEHVFRTFDTNSDGTIDFREFIIALSVTSRGRLEQKLMWAFSMYDLDGNGYISREEMLEIVQAIYKMVSSVMKMPEDESTPEKRTEKIFRQMDTNNDGKLSLEEFIRGAKSDPSIVRLLQCDPSSASQF

SEQ ID NO: 53581 - protein, 191 aa, Homo sapiens
MGKTNSKLAPEVLEDLVQNTEFSEQELKQWYKGFLKDCPSGILNLEEFQQLYIKFFPYGDASKFAQHAFRTFDKNGDGTIDFREFICALSVTSRGSFEQKLNWAFEMYDLDGDGRITRLEMLEIIEAIYKMVGTVIMMRMNQDGLTPQQRVDKIFKKMDQDKDDQITLEEFKEAAKSDPSIVLLLQCDMQK

SEQ ID NO: 53582 - protein, 445 aa, Homo sapiens
MERAPPDGPLNASGALAGDAAAAGGARGFSAAWTAVLAALMALLIVATVLGNALVMLAFVADSSLRTQNNFFLLNLAISDFLVGAFCIPLYVPYVLTGRWTFGRGLCKLWLVVDYLLCTSSAFNIVLISYDRFLSVTRAVSYRAQQGDTRRAVRKMLLVWVLAFLLYGPAILSWEYLSGGSSIPEGHCYAEFFYNWYFLITASTLEFFTPFLSVTFFNLSIYLNIQRRTRLRLDGAREAAGPEPPPEAQPSPPPPPGCWGCWQKGHGEAMPLHRYGVGEAAVGAEAGEATLGGGGGGGSVASPTSSSGSSSRGTERPRSLKRGSKPSASSASLEKRMKMVSQSFTQRFRLSRDRKVAKSLAVIVSIFGLCWAPYTLLMIIRAACHGHCVPDYWYETSFWLLWANSAVNPVLYPLCHHSFRRAFTKLLCPQKLKIQPHSSLEHCWK

SEQ ID NO: 53583 - protein, 924 aa, Homo sapiens
MPGPSPGLRRALLGLWAALGLGLFGLSAVSQEPFWADLQPRVAFVERGGSLWLNCSTNCPRPERGGLETSLRRNGTQRGLRWLARQLVDIREPETQPVCFFRCARRTLQARGLIRTFQRPDRVELMPLPPWQPVGENFTLSCRVPGAGPRASLTLTLLRGAQELIRRSFAGEPPRARGAVLTATVLARREDHGANFSCRAELDLRPHGLGLFENSSAPRELRTFSLSPDAPRLAAPRLLEVGSERPVSCTLDGLFPASEARVYLALGDQNLSPDVTLEGDAFVATATATASAEQEGARQLICNVTLGGENRETRENVTIYSFPAPLLTLSEPSVSEGQMVTVTCAAGTQALVTLEGVPAAVPGQPAQLQLNATENDDRRSFFCDATLDVDGETLIKNRSAELRVLYAPRLDDSDCPRSWTWPEGPEQTLRCEARGNPEPSVHCARSDGGAVLALGLLGPVTRALSGTYRCKAANDQGEAVKDVTLTVEYAPALDSVGCPERITWLEGTEASLSCVAHGVPPPDVICVRSGELGAVIEGLLRVAREHAGTYRCEATNPRGSAAKNVAVTVEYGPRFEEPSCPSNWTWVEGSGRLFSCEVDGKPQPSVKCVGSGGATEGVLLPLAPPDPSPRAPRIPRVLAPGIYVCNATNRHGSVAKTVVVSAESPPEMDESTCPSHQTWLEGAEASALACAARGRPSPGVRCSREGIPWPEQQRVSREDAGTYHCVATNAHGTDSRTVTVGVEYRPVVAELAASPPGGVRPGGNFTLTCRAEAWPPAQISWRAPPGALNIGLSSNNSTLSVAGAMGSHGGEYECARTNAHGRHARRITVRVAGPWLWVAVGGAAGGAALLAAGAGLAFYVQSTACKKGEYNVQEAESSGEAVCLNGAGGGAGGAAGAEGGPEAAGGAAESPAEGEVFAIQLTSA

SEQ ID NO: 53584 - protein, 366 aa, Homo sapiens
MAGPAWISKVSRLLGAFHNPKQVTRGFTGGVQTVTLIPGDGIGPEISAAVMKIFDAAKAPIQWEERNVTAIQGPGGKWMIPSEAKESMDKNKMGLKGPLKTPIAAGHPSMNLLLRKTFDLYANVRPCVSIEGYKTPYTDVNIVTIRENTEGEYSGIEHVIVDGVVQSIKLITEGASKRIAEFAFEYARNNHRSNVTAVHKANIMRMSDGLFLQKCREVAESCKDIKFNEMYLDTVCLNMVQDPSQFDVLVMPNLYGDILSDLCAGLIGGLGVTPSGNIGANGVAIFESVHGTAPDIAGKDMANPTALLLSAVMMLRHMGLFDHAARIEAACFATIKDGKSLTKDLGGNAKCSDFTEEICRRVKDLD

SEQ ID NO: 53585 - protein, 437 aa, Homo sapiens
MFVLFLCNLSLVPAAASKNKVKGSQGQFPLTQNVTVVEGGTAILTCRVDQNDNTSLQWSNPAQQTLYFDDKKALRDNRIELVRASWHELSISVSDVSLSDEGQYTCSLFTMPVKTSKAYLTVLGVPEKPQISGFSSPVMEGDLMQLTCKTSGSKPAADIRWFKNDKEIKDVKYLKEEDANRKTFTVSSTLDFRVDRSDDGVAVICRVDHESLNATPQVAMQVLEIHYTPSVKIIPSTPFPQEGQPLILTCESKGKPLPEPVLWTKDGGELPDPDRMVVSGRELNILFLNKTDNGTYRCEATNTIGQSSAEYVLIVHDVPNTLLPTTIIPSLTTATVTTTVAITTSPTTSATTSSIRDPNALAGQNGPDHALIGGIVAVVVFVTLCSIFLLGRYLARHKGTYLTNEAKGAEDAPDADTAIINAEGSQVNAEEKKEYFI

SEQ ID NO: 53586 - protein, 613 aa, Homo sapiens
MGALRPTLLPPSLPLLLLLMLGMGCWAREVLVPEGPLYRVAGTAVSISCNVTGYEGPAQQNFEWFLYRPEAPDTALGIVSTKDTQFSYAVFKSRVVAGEVQVQRLQGDAVVLKIARLQAQDAGIYECHTPSTDTRYLGSYSGKVELRVLPDVLQVSAAPPGPRGRQAPTSPPRMTVHEGQELALGCLARTSTQKHTHLAVSFGRSVPEAPVGRSTLQEVVGIRSDLAVEAGAPYAERLAAGELRLGKEGTDRYRMVVGGAQAGDAGTYHCTAAEWIQDPDGSWAQIAEKRAVLAHVDVQTLSSQLAVTVGPGERRIGPGEPLELLCNVSGALPPAGRHAAYSVGWEMAPAGAPGPGRLVAQLDTEGVGSLGPGYEGRHIAMEKVASRTYRLRLEAARPGDAGTYRCLAKAYVRGSGTRLREAASARSRPLPVHVREEGVVLEAVAWLAGGTVYRGETASLLCNISVRGGPPGLRLAASWWVERPEDGELSSVPAQLVGGVGQDGVAELGVRPGGGPVSVELVGPRSHRLRLHSLGPEDEGVYHCAPSAWVQHADYSWYQAGSARSGPVTVYPYMHALDTLFVPLLVGTGVALVTGATVLGTITCCFMKRLRKR

SEQ ID NO: 53587 - protein, 499 aa, Homo sapiens
MSFGSEHYLCSSSSYRKVFGDGSRLSARLSGAGGAGGFRSQSLSRSNVASSAACSSASSLGLGLAYRRPPASDGLDLSQAAARTNEYKIIRTNEKEQLQGLNDRFAVFIEKVHQLETQNRALEAELAALRQRHAEPSRVGELFQRELRDLRAQLEEASSARSQALLERDGLAEEVQRLRARCEEESRGREGAERALKAQQRDVDGATLARLDLEKKVESLLDELAFVRQVHDEEVAELLATLQASSQAAAEVDVTVAKPDLTSALREIRAQYESLAAKNLQSAEEWYKSKFANLNEQAARSTEAIRASREEIHEYRRQLQARTIEIEGLRGANESLERQILELEERHSAEVAGYQDSIGQLENDLRNTKSEMARHLREYQDLLNVKMALDIEIAAYRKLLEGEETRFSTSGLSISGLNPLPNPSYLLPPRILSATTSKVSSTGLSLKKEEEEEEASKVASKKTSQIGESFEEILEETVISTKKTEKSNIEETTISSQKI

SEQ ID NO: 53588 - protein, 626 aa, Homo sapiens
MSKKGRSKGEKPEMETDAVQMANEELRAKLTSIQIEFQQEKSKVGKLRERLQEAKLEREQEQRRHTAYISELKAKLHEEKTKELQALREGLIRQHEQEAARTAKIKEGELQRLQATLNVLRDGAADKVKTALLTEAREEARRAFDGERLRLQQEILELKAARKQAEEALSNCMQADKTKAADLRAAYQAHQDEVHRIKRECERDIRRLMDEIKGKDRVILALEKELGVQAGQTQKLLLQKEALDEQLVQVKEAERHHSSPKRELPPGIGDMVELMGVQDQHMDERDVRRFQLKIAELNSVIRKLEDRNTLLADERNELLKRSRETEVQLKPLVEKNKRMNKKNEDLLQSIQRMEEKIKNLTRENVEMKEKLSAQASLKRHTSLNDLSLTRDEQEIEFLRLQVLEQQHVIDDLSLERERLLRSKRHRGKSLKPPKKHVVETFFGFDEESVDSETLSETSYNTDRTDRTPATPEEDLDDATAREEADLRFCQLTREYQALQRAYALLQEQVGGTLDAEREARTREQLQADLLRCQAKIEDLEKLLVEKGQDSKWVEEKQLLIRTNQDLLEKIYRLEMEENQLKNEMQDAKDQNELLEFRVLELEVRDSICCKLSNGADILFEPKLKFM

SEQ ID NO: 53589 - protein, 494 aa, Homo sapiens
MDGSGERSLPEPGSQSSAASDDIEIVVNVGGVRQVLYGDLLSQYPETRLAELINCLAGGYDTIFSLCDDYDPGKREFYFDRDPDAFKCVIEVYYFGEVHMKKGICPICFKNEMDFWKVDLKFLDDCCKSHLSEKREELEEIARRVQLILDDLGVDAAEGRWRRCQKCVWKFLEKPESSCPARVVAVLSFLLILVSSVVMCMGTIPELQVLDAEGNRVEHPTLENVETACIGWFTLEYLLRLFSSPNKLHFALSFMNIVDVLAILPFYVSLTLTHLGARMMELTNVQQAVQALRIMRIARIFKLARHSSGLQTLTYALKRSFKELGLLLMYLAVGIFVFSALGYTMEQSHPETLFKSIPQSFWWAIITMTTVGYGDIYPKTTLGKLNAAISFLCGVIAIALPIHPIINNFVRYYNKQRVLETAAKHELELMELNSSSGGEGKTGGSRSDLDNLPPEPAGKEAPSCSSRLKLSHSDTFIPLLTEEKHHRTRLQSCK

SEQ ID NO: 53590 - protein, 1083 aa, Homo sapiens
MPAMRGLLAPQNTFLDTIATRFDGTHSNFVLGNAQVAGLFPVVYCSDGFCDLTGFSRAEVMQRGCACSFLYGPDTSELVRQQIRKALDEHKEFKAELILYRKSGLPFWCLLDVIPIKNEKGEVALFLVSHKDISETKNRGGPDRWKETGGGRRRYGRARSKGFNANRRRSRAVLYHLSGHLQKQPKGKHKLNKGVFGEKPNLPEYKVAAIRKSPFILLHCGALRATWDGFILLATLYVAVTVPYSVCVSTAREPSAARGPPSVCDLAVEVLFILDIVLNFRTTFVSKSGQVVFAPKSICLHYVTTWFLLDVIAALPFDLLHAFKVNVYFGAHLLKTVRLLRLLRLLPRLDRYSQYSAVVLTLLMAVFALLAHWVACVWFYIGQREIESSESELPEIGWLQELARRLETPYYLVGRRPAGGNSSGQSDNCSSSSEANGTGLELLGGPSLRSAYITSLYFALSSLTSVGFGNVSANTDTEKIFSICTMLIGALMHAVVFGNVTAIIQRMYARRFLYHSRTRDLRDYIRIHRIPKPLKQRMLEYFQATWAVNNGIDTTELLQSLPDELRADIAMHLHKEVLQLPLFEAASRGCLRALSLALRPAFCTPGEYLIHQGDALQALYFVCSGSMEVLKGGTVLAILGKGDLIGCELPRREQVVKANADVKGLTYCVLQCLQLAGLHDSLALYPEFAPRFSRGLRGELSYNLGAGGGSAEVDTSSLSGDNTLMSTLEEKETDGEQGPTVSPAPADEPSSPLLSPGCTSSSSAAKLLSPRRTAPRPRLGGRGRPGRAGALKAEAGPSAPPRALEGLRLPPMPWNVPPDLSPRVVDGIEDGCGSDQPKFSFRVGQSGPECSSSPSPGPESGLLTVPHGPSEARNTDTLDKLRQAVTELSEQVLQMREGLQSLRQAVQLVLAPHREGPCPRASGEGPCPASTSGLLQPLCVDTGASSYCLQPPAGSVLSGTWPHPRPGPPPLMAPWPWGPPASQSSPWPRATAFWTSTSDSEPPASGDLCSEPSTPASPPPSEEGARTGPAEPVSQAEATSTGEPPPGSGGLALPWDPHSLEMVLIGCHGSGTVQWTQEEGTGV

SEQ ID NO: 53591 - protein, 379 aa, Homo sapiens
MTSVAKVYYSQTTQTESRPLMGPGIRRRRVLTKDGRSNVRMEHIADKRFLYLKDLWTTFIDMQWRYKLLLFSATFAGTWFLFGVVWYLVAVAHGDLLELDPPANHTPCVVQVHTLTGAFLFSLESQTTIGYGFRYISEECPLAIVLLIAQLVLTTILEIFITGTFLAKIARPKKRAETIRFSQHAVVASHNGKPCLMIRVANMRKSLLIGCQVTGKLLQTHQTKEGENIRLNQVNVTFQVDTASDSPFLILPLTFYHVVDETSPLKDLPLRSGEGDFELVLILSGTVESTSATCQVRTSYLPEEILWGYEFTPAISLSASGKYIADFSLFDQVVKVASPSGLRDSTVRYGDPEKLKLEESLREQAEKEGSALSVRISNV

SEQ ID NO: 53592 - protein, 445 aa, Homo sapiens
MHGHSRNGQAHVPRRKRRNRFVKKNGQCNVYFANLSNKSQRYMADIFTTCVDTRWRYMLMIFSAAFLVSWLFFGLLFWCIAFFHGDLEASPGVPAAGGPAAGGGGAAPVAPKPCIMHVNGFLGAFLFSVETQTTIGYGFRCVTEECPLAVIAVVVQSIVGCVIDSFMIGTIMAKMARPKKRAQTLLFSHHAVISVRDGKLCLMWRVGNLRKSHIVEAHVRAQLIKPYMTQEGEYLPLDQRDLNVGYDIGLDRIFLVSPIIIVHEIDEDSPLYGMGKEELESEDFEIVVILEGMVEATAMTTQARSSYLASEILWGHRFEPVVFEEKSHYKVDYSRFHKTYEVAGTPCCSARELQESKITVLPAPPPPPSAFCYENELALMSQEEEEMEEEAAAAAAVAAGLGLEAGSKEEAGIIRMLEFGSHLDLERMQASLPLDNISYRRESAI

SEQ ID NO: 53593 - protein, 445 aa, Homo sapiens; identical to SEQ ID NO: 53592

SEQ ID NO: 53594 - protein, 393 aa, Homo sapiens
MAQENAAFSPGQEEPPRRRGRQRYVEKDGRCNVQQGNVRETYRYLTDLFTTLVDLQWRLSLLFFVLAYALTWLFFGAIWWLIAYGRGDLEHLEDTAWTPCVNNLNGFVAAFLFSIETETTIGYGHRVITDQCPEGIVLLLLQAILGSMVNAFMVGCMFVKISQPNKRAATLVFSSHAVVSLRDGRLCLMFRVGDLRSSHIVEASIRAKLIRSRQTLEGEFIPLHQTDLSVGFDTGDDRLFLVSPLVISHEIDAASPFWEASRRALERDDFEIVVILEGMVEATGMTCQARSSYLVDEVLWGHRFTSVLTLEDGFYEVDYASFHETFEVPTPSCSARELAEAAARLDAHLYWSIPSRLDEKVEEEGAGEGAGGEAGADKEQNGCLPPPESESKV

SEQ ID NO: 53595 - protein, 543 aa, Homo sapiens
MNSHSYNGSVGRPLGSGPGALGRDPPDPEAGHPPQPPHSPGLQVVVAKSEPARPSPGSPRGQPQDQDDDEDDEEDEAGRQRASGKPSNVGHRLGHRRALFEKRKRLSDYALIFGMFGIVVMVTETELSWGVYTKESLYSFALKCLISLSTAILLGLVVLYHAREIQLFMVDNGADDWRIAMTCERVFLISLELAVCAIHPVPGHYRFTWTARLAFTYAPSVAEADVDVLLSIPMFLRLYLLGRVMLLHSKIFTDASSRSIGALNKITFNTRFVMKTLMTICPGTVLLVFSISSWIIAAWTVRVCERYHDKQEVTSNFLGAMWLISITFLSIGYGDMVPHTYCGKGVCLLTGIMGAGCTALVVAVVARKLELTKAEKHVHNFMMDTQLTKRVKNAAANVLRETWLIYKHTRLVKKPDQARVRKHQRKFLQAIHQAQKLRSVKIEQGKLNDQANTLTDLAKTQTVMYDLVSELHAQHEELEARLATLESRLDALGASLQALPGLIAQAIRPPPPPLPPRPGPGPQDQAARSSPCRWTPVAPSDCG

SEQ ID NO: 53596 - protein, 844 aa, Homo sapiens
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYRLIPPLNQLELLRNLKSKSGLAFRKDPPPEPSPSQKVSLKDRVFSSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLVRIPPPPAHERSLSAYGGGNRASMEFLRQEDTPGCRPPEGNLRDSDTSISIPSVDHEELERSFSGFSISQSKENLDALNSCYAAVAPCAKVRPYIAEGESDTDSDLCTPCGPPPRSATGEGPFGDVGWAGPRK

SEQ ID NO: 53597 - protein, 854 aa, Homo sapiens
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYSSQTQTYGASRLIPPLNQLELLRNLKSKSGLAFRKDPPPEPSPSQKVSLKDRVFSSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLVRIPPPPAHERSLSAYGGGNRASMEFLRQEDTPGCRPPEGNLRDSDTSISIPSVDHEELERSFSGFSISQSKENLDALNSCYAAVAPCAKVRPYIAEGESDTDSDLCTPCGPPPRSATGEGPFGDVGWAGPRK

SEQ ID NO: 53598 - protein, 872 aa, Homo sapiens [sequence omitted]

SEQ ID NO: 53599 - protein, 841 aa, Homo sapiens
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYSSQTQTYGASRLIPPLNQLELLRNLKSKSGLAFRKDPPPEPSPSPRGVAAKGKGSPQAQTVRRSPSADQSLEDSPSKVPKSWSFGDRSRARQAFRIKGAASRQNSEASLPGEDIVDDKSCPCEFVTEDLTPGLKVSIRAVCVMRFLVSKRKFKESLRPYDVMDVIEQYSAGHLDMLSRIKSLQSRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLVRIPPPPAHERSLSAYGGGNRASMEFLRQEDTPGCRPPEGNLRDSDTSISIPSVDHEELERSFSGFSISQSKENLDALNSCYAAVAPCAKVRPYIAEGESDTDSDLCTPCGPPPRSATGEGPFGDVGWAGPRK

SEQ ID NO: 53600 - protein, 259 aa, Homo sapiens
MERKINRREKEKEYEGKHNSLEDTDQGKNCKSTLMTLNVGGYLYITQKQTLTKYPDTFLEGIVNGKILCPFDADGHYFIDRDGLLFRHVLNFLRNGELLLPEGFRENQLLAQEAEFFQLKGLAEEVKSRWEKEQLTPRETTFLEITDNHDRSQGLRIFCNAPDFISKIKSRIVLVSKSRLDGFPEEFSISSNIIRFKYFIKSENGTRLVLKEDNTFVCTLETLKFEAIMMALKCGFRLLTSLDCSKGSIVHSDALHFIK

SEQ ID NO: 53601 - protein, 1072 aa, Homo sapiens
MAPPTGVLSSLLLLVTIAGCARKQCSEGRTYSNAVISPNLETTRIMRVSHTFPVVDCTAACCDLSSCDLAWWFEGRCYLVSCPHKENCEPKKMGPIRSYLTFVLRPVQRPAQLLDYGDMMLNRGSPSGIWGDSPEDIRKDLPFLGKDWGLEEMSEYADDYRELEKDLLQPSGKQEPRGSAEYTDWGLLPGSEGAFNSSVGDSPAVPAETQQDPELHYLNESASTPAPKLPERSVLLPLPTTPSSGEVLEKEKASQLQEQSSNSSGKEVLMPSHSLPPASLELSSVTVEKSPVLTVTPGSTEHSIPTPPTSAAPSESTPSELPISPTTAPRTVKELTVSAGDNLIITLPDNEVELKAFVAPAPPVETTYNYEWNLISHPTDYQGEIKQGHKQTLNLSQLSVGLYVFKVTVSSENAFGEGFVNVTVKPARRVNLPPVAVVSPQLQELTLPLTSALIDGSQSTDDTEIVSYHWEEINGPFIEEKTSVDSPVLRLSNLDPGNYSFRLTVTDSDGATNSTTAALIVNNAVDYPPVANAGPNHTITLPQNSITLNGNQSSDDHQIVLYEWSLGPGSEGKHVVMQGVQTPYLHLSAMQEGDYTFQLKVTDSSRQQSTAVVTVIVQPENNRPPVAVAGPDKELIFPVESATLDGSSSSDDHGIVFYHWEHVRGPSAVEMENIDKAIATVTGLQVGTYHFRLTVKDQQGLSSTSTLTVAVKKENNSPPRARAGGRHVLVLPNNSITLDGSRSTDDQRIVSYLWIRDGQSPAAGDVIDGSDHSVALQLTNLVEGVYTFHLRVTDSQGASDTDTATVEVQPDPRKSGLVELTLQVGVGQLTEQRKDTLVRQLAVLLNVLDSDIKVQKIRAHSDLSTVIVFYVQSRPPFKVLKAAEVARNLHMRLSKEKADFLLFKVLRVDTAGCLLKCSGHGHCDPLTKRCICSHLWMENLIQRYIWDGESNCEWSIFYVTVLAFTLIVLTGGFTWLCICCCKRQKRTKIRKKTKYTILDNMDEQERMELRPKYGIKHRSTEHNSSLMVSESEFDSDQDTIFSREKMERGNPKVSMNGSIRNGASFSYCSKDR

SEQ ID NO: 53602 - protein, 1031 aa, Homo sapiens [sequence omitted]

SEQ ID NO: 53603 - protein, 1031 aa, Homo sapiens [sequence omitted]

SEQ ID NO: 53604 - protein, 297 aa, Homo sapiens
MKTLSPDRIQPHIMTDVPATFTQAECNGDKPPENGQQTITKISEELTDVDSPLPHYRVEPSLEGALTKGSQEERRKLQGNMLLNSSMEDKMLKENPEEKLFIVHKAITDLSLQETSADEMTFREGHQWEKIPLSGSNQEIRRQKERITEQPLKEEEDEDRKNKGHQAAEIEWLGFRKPSQADMLHSKHDEEQKVWDEEIDDDDDDNCNNDEDEVRVIEFKKKHEEVSQFKEEGDASEDSPLSSASSQAVTPDEQPTLGKKSDISRNAYSRYNTISYRKIRKGNTKQRIDEFESMMHL

SEQ ID NO: 53605 - protein, 284 aa, Homo sapiens
MTDVPATFTQAECNGDKPPENGQQTITKISEELTDVDSPLPHYRVEPSLEGALTKGSQEERRKLQGNMLLNSSMEDKMLKENPEEKLFIVHKAITDLSLQETSADEMTFREGHQWEKIPLSGSNQEIRRQKERITEQPLKEEEDEDRKNKGHQAAEIEWLGFRKPSQADMLHSKHDEEQKVWDEEIDDDDDDNCNNDEDEVRVIEFKKKHEEVSQFKEEGDASEDSPLSSASSQAVTPDEQPTLGKKSDISRNAYSRYNTISYRKIRKGNTKQRIDEFESMMHL

SEQ ID NO: 53606 - protein, 419 aa, Homo sapiens
MAKEGVEKAEETEQMIEKEAGKEPAEGGGGDGSHRLGDAQEMRAVVLAGFGGLNKLRLFRKAMPEPQDGELKIRVKACGLNFIDLMVRQGNIDNPPKTPLVPGFECSGIVEALGDSVKGYEIGDRVMAFVNYNAWAEVVCTPVEFVYKIPDDMSFSEAAAFPMNFVTAYVMLFEVANLREGMSVLVHSAGGGVGQAVAQLCSTVPNVTVFGTASTFKHEAIKDSVTHLFDRNADYVQEVKRISAEGVDIVLDCLCGDNTGKGLSLLKPLGTYILYGSSNMVTGETKSFFSFAKSWWQVEKVNPIKLYEENKVIAGFSLLNLLFKQGRAGLIRGVVEKLIGLYNQKKIKPVVDSLWALEEVKEAMQRIHDRGNIGKLILDVEKTPTPLMANDSTETSEAGEEEEDHEGDSENKERMPFIQ

SEQ ID NO: 53607 - protein, 611 aa, Homo sapiens
MASVQQGEKQLFEKFWRGTFKAVATPRPESIIVASITARKPLPRTEPQNNPVVPAQDGPSEKLGQHLATEPLGTNSWERDKTCRELGATRGHSASHDKDLTPPPSSRGKKKKKKSTRKKRRRSSSYSPSPVKKKKKKSSKKHKRRRSFSKKRRHSSSSPKSKRRDEKRHKKQSRSRPRKSHRHRHHRCPSRSQSSESRPSSCESRHRGRSPEEGQKSRRRHSRRCSKTLCKDSPEAQSSRPPSQPLQMLGYLSARGVITGSGSAADLFTKTASPLTTSRGRSQEYDSGNDTSSPPSTQTSSARSRGQEKGSPSGGLSKSRELNSGNTSDSGNSFTTSSPQNKGAMLENLSPTSRGRESRGFQSPCLECAEVKKSSLVPSTARSSPMKGCSRSSSYASTRSSSHSSRSPNPRASPRYTQSRSTSSEKRSYSRSPSYSSKSGKRSPPSRSSRSRRSPSYSRYSPSRERDPKYSEKDSQQRERERARRRRRSYSPMRKRRRDSPSHLEARRITSARKRPIPYYRPSPSSSGSLSSTSSWYSSSSSRSASRSYSRSRSRSRSRRRSRTRTSSSSSSRSPSPGSRSRSRSRSRSRSRSRSQSRSYSSADSYSSTRR

SEQ ID NO: 53608 - protein, 828 aa, Homo sapiens
MARLCRRVPCTLLLGLAVVLLKARLVPAAARAELSRSDLSLIQQQQQQQQQQQQQQQQKQLEEAEEERTEVPGATSTLTVPVSVFMLKVQVNDIISRQYLSQAVVEVFVNYTKTNSTVTKSNGAVLIKVPYKLGLSLTIIAYKDGYVLTPLPWKTRRMPIYSSVTLSLFPQSQANIWLFEDTVLITGKLADAKSQPSVQFSKALIKLPDNHHISNVTGYLTVLQQFLKVDNFLHTTGITLNKPGFENIELTPLAAICVKIYSGGKELKVNGSIQVSLPLLRLNDISAGDRIPAWTFDMNTGAWINHGRGMVKEHNNHLIWTYDAPHLGYWIAAPLPGTRGSGINEDSKDITAYHTVFLTAILGGTIVIVIGFFAVLLCYCRDKCGTPQKRERNITKLEVLKRDQTTSTTHINHISTVKVALKAEDKSQLFNAKNSSYSPQKKEPSKAETEERVSMVKTRDDFKIYNEDVSFLSVNQNNYSRNPTQSLEPNVGSKQPKHINNNLSSSLGDAQDEKRYLTGNEEAYGRSHIPEQLMHIYSQPIAILQTSDLFSTPEQLHTAKSATLPRKGQLVYGQLMEPVNRENFTQTLPKMPIHSHAQPPDAREEDIILEGQQSLPSQASDWSRYSSSLLESVSVPGTLNEAVVMTPFSSELQGISEQTLLELSKGKPSPHPRAWFVSLDGKPVAQVRHSFIDLKKGKRTQSNDTSLDSGVDMNELHSSRKLEREKTFIKSMHQPKILYLEDLDLSSSESGTTVCSPEDPALRHILDGGSGVIMEHPGEESPGRKSTVEDFEANTSPTKRRGRPPLAKRDSKTNIWKKREERPLIPIN

SEQ ID NO: 53609 - protein, 1690 aa, Homo sapiens
MAGASVKVAVRVRPFNSREMSRDSKCIIQMSGSTTTIVNPKQPKETPKSFSFDYSYWSHTSPEDINYASQKQVYRDIGEEMLQHAFEGYNVCIFAYGQTGAGKSYTMMGKQEKDQQGIIPQLCEDLFSRINDTTNDNMSYSVEVSYMEIYCERVRDLLNPKNKGNLRVREHPLLGPYVEDLSKLAVTSYNDIQDLMDSGNKARTVAATNMNETSSRSHAVFNIIFTQKRHDAETNITTEKVSKISLVDLAGSERADSTGAKGTRLKEGANINKSLTTLGKVISALAEMDSGPNKNKKKKKTDFIPYRDSVLTWLLRENLGGNSRTAMVAALSPADINYDETLSTLRYADRAKQIRCNAVINEDPNNKLIRELKDEVTRLRDLLYAQGLGDITDMTNALVGMSPSSSLSALSSRAASVSSLHERILFAPGSEEAIERLKETEKIIAELNETWEEKLRRTEAIRMEREALLAEMGVAMREDGGTLGVFSPKKTPHLVNLNEDPLMSECLLYYIKDGITRVGREDGERRQDIVLSGHFIKEEHCVFRSDSRGGSEAVVTLEPCEGADTYVNGKKVTEPSILRSGNRIIMGKSHVFRFNHPEQARQERERTPCAETPAEPVDWAFAQRELLEKQGIDMKQEMEQRLQELEDQYRREREEATYLLEQQRLDYESKLEALQKQMDSRYYPEVNEEEEEPEDEVQWTERECELALWAFRKWKWYQFTSLRDLLWGNAIFLKEANAISVELKKKVQFQFVLLTDTLYSPLPPDLLPPEAAKDRETRPFPRTIVAVEVQDQKNGATHYWTLEKLRQRLDLMREMYDRAAEVPSSVIEDCDNVVTGGDPFYDRFPWFRLVGRAFVYLSNLLYPVPLVHRVAIVSEKGEVKGFLRVAVQAISADEEAPDYGSGVRQSGTAKISFDDQHFEKFQSESCPVVGMSRSGTSQEELRIVEGQGQGADVGPSADEVNNNTCSAVPPEGLLLDSSEKAALDGPLDAALDHLRLGNTFTFRVTVLQASSISAEYADIFCQFNFIHRHDEAFSTEPLKNTGRGPPLGFYHVQNIAVEVTKSFIEYIKSQPIVFEVFGHYQQHPFPPLCKDVLSPLRPSRRHFPRVMPLSKPVPATKLSTLTRPCPGPCHCKYDLLVYFEICELEANGDYIPAVVDHRGGMPCMGTFLLHQGIQRRITVTLLHETGSHIRWKEVRELVVGRIRNTPETDESLIDPNILSLNILSSGYIHPAQDDRTFYQFEAAWDSSMHNSLLLNRVTPYREKIYMTLSAYIEMENCTQPAVVTKDFCMVFYSRDAKLPASRSIRNLFGSGSLRASESNRVTGVYELSLCHVADAGSPGMQRRRRRVLDTSVAYVRGEENLAGWRPRSDSLILDHQWELEKLSLLQEVEKTRHYLLLREKLETAQRPVPEALSPAFSEDSESHGSSSASSPLSAEGRPSPLEAPNERQRELAVKCLRLLTHTFNREYTHSHVCVSASESKLSEMSVTLLRDPSMSPLGVATLTPSSTCPSLVEGRYGATDLRTPQPCSRPASPEPELLPEADSKKLPSPARATETDKEPQRLLVPDIQEIRVSPIVSKKGYLHFLEPHTSGWARRFVVVRRPYAYMYNSDKDTVERFVLNLATAQVEYSEDQQAMLKTPNTFAVCTEHRGILLQAASDKDMHDWLYAFNPLLAGTIRSKLSRRRSAQMRV

SEQ ID NO: 53610 - protein, 793 aa, Homo sapiens
MASKTKASEALKVVARCRPLSRKEEAAGHEQILTMDVKLGQVTLRNPRAAPGELPKTFTFDAVYDASSKQADLYDETVRPLIDSVLQGFNGTVFAYGQTGTGKTYTMQGTWVEPELRGVIPNAFEHIFTHISRSQNQQYLVRASYLEIYQEEIRDLLSKEPGKRLELKENPETGVYIKDLSSFVTKNVKEIEHVMNLGNQTRAVGSTHMNEVSSRSHAIFIITVECSERGSDGQDHIRVGKLNLVDLAGSERQNKAGPNTAGGAATPSSGGGGGGGGSGGGAGGERPKEASKINLSLSALGNVIAALAGNRSTHIPYRDSKLTRLLQDSLGGNAKTIMVATLGPASHSYDESLSTLRFANRAKNIKNKPRVNEDPKDTLLREFQEEIARLKAQLEKRGMLGKRPRRKSSRRKKAVSAPPGYPEGPVIEAWVAEEEDDNNNNHRPPQPILESALEKNMENYLQEQKERLEEEKAAIQDDRSLVSEEKQKLLEEKEKMLEDLRREQQATELLAAKYKAMESKLLIGGRNIMDHTNEQQKMLELKRQEIAEQKRREREMQQEMMLRDEETMELRGTYTSLQQEVEVKTKKLKKLYAKLQAVKAEIQDQHDEYIRVRQDLEEAQNEQTRELKLKYLIIENFIPPEEKNKIMNRLFLDCEEEQWKFQPLVPAGVSSSQMKKRPTSAVGYKRPISQYARVAMAMGSHPRYRAENIMFLELDVSPPAVFEMEFSHDQEQDPRALHMERLMRLDSFLERPSTSKVRKSRSWCQSPQRPPPSTTHASLASASLRPATVADHE

SEQ ID NO: 53611 - protein, 1032 aa, Homo sapiens
MAETNNECSIKVLCRFRPLNQAEILRGDKFIPIFQGDDSVVIGGKPYVFDRVFPPNTTQEQVYHACAMQIVKDVLAGYNGTIFAYGQTSSGKTHTMEGKLHDPQLMGIIPRIARDIFNHIYSMDENLEFHIKVSYFEIYLDKIRDLLDVTKTNLSVHEDKNRVPFVKGCTERFVSSPEEILDVIDEGKSNRHVAVTNMNEHSSRSHSIFLINIKQENMETEQKLSGKLYLVDLAGSEKVSKTGAEGAVLDEAKNINKSLSALGNVISALAEGTKSYVPYRDSKMTRILQDSLGGNCRTTMFICCSPSSYNDAETKSTLMFGQRAKTIKNTASVNLELTAEQWKKKYEKEKEKTKAQKETIAKLEAELSRWRNGENVPETERLAGEEAALGAELCEETPVNDNSSIVVRIAPEERQKYEEEIRRLYKQLDDKDDEINQQSQLIEKLKQQMLDQEELLVSTRGDNEKVQRELSHLQSENDAAKDEVKEVLQALEELAVNYDQKSQEVEEKSQQNQLLVDELSQKVATMLSLESELQRLQEVSGHQRKRIAEVLNGLMKDLSEFSVIVGNGEIKLPVEISGAIEEEFTVARLYISKIKSEVKSVVKRCRQLENLQVECHRKMEVTGRELSSCQLLISQHEAKIRSLTEYMQSVELKKRHLEESYDSLSDELAKLQAQETVHEVALKDKEPDTQDADEVKKALELQMESHREAHHRQLARLRDEINEKQKTIDELKDLNQKLQLELEKLQADYEKLKSEEHEKSTKLQELTFLYERHEQSKQDLKGLEETVARELQTLHNLRKLFVQDVTTRVKKSAEMEPEDSGGIHSQKQKISFLENNLEQLTKVHKQLVRDNADLRCELPKLEKRLRATAERVKALEGALKEAKEGAMKDKRRYQQEVDRIKEAVRYKSSGKRGHSAQIAKPVRPGHYPASSPTNPYGTRSPECISYTNSLFQNYQNLYLQATPSSTSDMYFANSCTSSGATSSGGPLASYQKANMDNGNATDINDNRSDLPCGYEAEDQAKLFPLHQETAAS

SEQ ID NO: 53612 - protein, 406 aa, Homo sapiens
MLFHSLSGPEVHGVIDEMDRRAKSEAPAISSAIDRGDTETTMPSISSDRAALCAGCGGKISDRYYLLAVDKQWHMRCLKCCECKLNLESELTCFSKDGSIYCKEDYYRRFSVQRCARCHLGISASEMVMRARDLVYHLNCFTCTTCNKMLTTGDHFGMKDSLVYCRLHFEALLQGEYPAHFNHADVAAAAAAAAAAKSAGLGAAGANPLGLPYYNGVGTVQKGRPRKRKSPGPGADLAAYNAALSCNENDAEHLDRDQPYPSSQKTKRMRTSFKHHQLRTMKSYFAINHNPDAKDLKQLAQKTGLTKRVLQVWFQNARAKFRRNLLRQENTGVDKSTDAALQTGTPSGPASELSNASLSPSSTPTTLTDLTSPTLPTVTSVLTSVPGNLEGHEPHSPSQTTLTNLF

SEQ ID NO: 53613 - protein, 282 aa, Homo sapiens
MDITLESLRHIIAQVLPHRDPALVFKDLNVVSMLQEFWESKQQQKAAFPSEGVVVYESLPAPGPPFVSYVTLPGGSCFGNFQCCLSRAEARRDAAKVALINSLFNELPSRRITKEFIMESVQEAVASTSGTLDDADDPSTSVGAYHYMLESNMGKTMLEFQELMTIFQLLHWNGSLKALRETKCSRQEVISYYSQYSLDEKMRSHMALDWIMKERDSPGIVSQELRMALRQLEEARKAGQELRFYKEKKEILSLALTQICSDPDTSSPSDDQLSLTALCGYH

SEQ ID NO: 53614 - protein, 640 aa, Homo sapiens [sequence omitted]

SEQ ID NO: 53615 - protein, 233 aa, Homo sapiens
MSSQGQSLVPMRSSQRKRPAREVSAGGHVHVLWCPQRLPSCGIITETTPCSMTFLPVVSLQRQSHLDDVISNSKASFGIIAMGKIFSPCVFAAEKMPLSYDVIITDKAIFLGHVAGENASPIVSSLDIRSPFHNIITGTLPPSCDAITREGALPYDVIRGTVPLPVMSSPEMTTHSGTSPGGGPFCDVAQMLCALRWHKEMPPLLPPCCRRQGRPRVQDHPREDAREQRGALS

SEQ ID NO: 53616 - protein, 68 aa, Homo sapiens
MPHFLDWFVPVYLVISVLILVGFGACIYYFEPGLQEAHKWRMQRPLVDRDLRKTLMVRDNLAFGGPEV

SEQ ID NO: 53617 - protein, 68 aa, Homo sapiens; identical to SEQ ID NO: 53616

SEQ ID NO: 53618 - protein, 68 aa, Homo sapiens; identical to SEQ ID NO: 53616

SEQ ID NO: 53619 - protein, 68 aa, Homo sapiens; identical to SEQ ID NO: 53616

SEQ ID NO: 53620 - protein, 285 aa, Homo sapiens
MEQRNRLGALGYLPPLLLHALLLFVADAAFTEVPKDVTVREGDDIEMPCAFRASGATSYSLEIQWWYLKEPPRELLHELALSVPGARSKVTNKDATKISTVRVQGNDISHRLRLSAVRLQDEGVYECRVSDYSDDDTQEHKAQAMLRVLSRFAPPNMQAAEAVSHIQSSGPRRHGPASAANANNAGAASRTTSEPGRGDKSPPPGSPPAAIDPAVPEAAAASAAHTPTTTVAAAAAASSASPPSGQAVLLRQRHGSGTGRSYTTDPLLSLLLLALHKFLRLLLGH

SEQ ID NO: 53621 - protein, 285 aa, Homo sapiens; identical to SEQ ID NO: 53620

SEQ ID NO: 53622 - protein, 107 aa, Homo sapiens
MAPCSCASGGRRLCAGLQVLPRIGVIAEPDALEGWAWGPQSTPEAFPLGRVASRVPPGCSEDLEPLPQAVRRLDQSCLNAPRSRRKHSHVKDELPIKATLLSSRTES

SEQ ID NO: 53623 - protein, 107 aa, Homo sapiens; identical to SEQ ID NO: 53622

SEQ ID NO: 53624 - protein, 193 aa, Homo sapiens
MERRLIKKEMKKLLGDYIGIRLRENEFDPKGRRQLTFLDDMAHYDLAISVALQWLDPSEDLTWLEWEELKIPLHGRPIYPNRREREAMILSSYAGILMNSIPIEEVFKIYGADSSADSGTIKVPRVSSLCLSLHPFAMLTAPKAAAYARKQSVKSRKVTTNKNATSISAKEANATEWKSSQRFSDTQPKHKVT

SEQ ID NO: 53625 - protein, 176 aa, Homo sapiens
MERRLIKKEMKKLLGDYIGIRLRENEFDPKGRRQLTFLDDMAHYDLAISVALQWLDPSEDLTWLEWEELKIPLHGRPIYPNRREREAMILSSYAGILMNSIPIEEVFKIYGADSSADSGTIKVPRVSSLCLSLHPFAMLTAPKAAAYARKQSHLENWNCTMELHNRFSGSRREASS

SEQ ID NO: 53626 - protein, 176 aa, Homo sapiens; identical to SEQ ID NO: 53625

SEQ ID NO: 53627 - protein, 193 aa, Homo sapiens
MERRLIKKEMKKLLGDYIGIRLRENEFDPKGRRQLTFLDDMAHYDLAISVALQWLDPSEDLTWLEWEELKIPLHGRPIYPNRREREAMILSSYAGILMNSIPIEEVFKIYGADSSADSGTIKVPRVSSLRLSLHPFAMLTAPKAAAYARKQGVKSRKVTTNKNATSISAKEANATEWKSSQRFSDTQPKHKVT

SEQ ID NO: 53628 - protein, 176 aa, Homo sapiens
MERRLIKKEMKKLLGDYIGIRLRENEFDPKGRRQLTFLDDMAHYDLAISVALQWLDPSEDLTWLEWEELKIPLHGRPIYPNRREREAMILSSYAGILMNSIPIEEVFKIYGADSSADSGTIKVPRVSSLRLSLHPFAMLTAPKAAAYARKQGHLENWNCTMELHNRFSGSRREASS

SEQ ID NO: 53629 - protein, 176 aa, Homo sapiens; identical to SEQ ID NO: 53628

SEQ ID NO: 53630 - protein, 197 aa, Homo sapiens
MSARAPKELRLALPPCLLNRTFASPNASGSGNTGARGPGAVGSGTCITQVGQQLFQSFSSTLVLIVLVTVIFCLIVLSLSTFHIHKRRMKKRKMQRAQEEYERDHCSGSRGGGGLPRPGRQAPTHAKETRLERQPRDSPFCAPSNASSLSSSSPGLPCQGPCAPPPPPPASSPQGAHAASSCLDTAGEGLLQTVVLS

SEQ ID NO: 53631 - protein, 344 aa, Homo sapiens
MRNEKFTIRSLTWIVSAPARQAALHFRGFALDSALWIFRFGTPNPCRRGLGSPGPPAPAAPKAEELLQGGEFFSDPQPLAPEPRLRSSPESAIPPGPPFSSDTGGLRPLRPSEPRKAARLPEAAGAGAAGLAGSPGLARAAPGPRTENRRRAAHPALRGGPAWPCSPPRSSFRREIWCWHGHPAATGVASRMSLASALTLWPWGLPGWCQVAEDAWRVTRSFPHPPPPLLVPGRAVCSCSSGTGAGWRSFPWMASGSLSAQPTWSEGLLLLDTSPDPDPWRWAIHRMRLIGCWRSRPPDFAAWAAGPGIRAAGDAGLVCGVQPLAAGAPRLGWWLQPQLRACGG

SEQ ID NO: 53632 - protein, 150 aa, Homo sapiens
MADTSPPTKLEHPRSTSDCCAGSKNFNPVDLSFLGSMGVGSTDQDHLAPWFQPPFQGSEWFCLSGIPDNSGVRKKLLQLAQCLPKWPLSFVLEIQGPCGVGTQGISLSVDCEDHGKSVVSGPECTPTHGMVPHGFPWLGEGVPQPLALPR

SEQ ID NO: 53633 - protein, 426 aa, Homo sapiens
MKAAFHKTRSPVRHDDDEERAARRPGAGPPKAESGQEPASRGQGQSQGQSQGPGSGDTYRPKRPTTLNLFPQVQLSQDTLNNNSLGKKSRHLHQQPTLLVDEHAQLEPVSLRPCFGDYSDESDSAIVYDNCASVSSPYESAIGEEYEEASRPQPPACLSKDSTPDEPDVHFSKKFLNIFMSGRSRSSSAESFGLFSCIINREEQEQTHRTIFRFVPRHEDEPELEVDDPLLVELQAEDYWYEAYNMRTGARGFFTAYYAIEVTKEPEHMAALAKNSDWVDQFRVKFLGSVQVPYHKGDVVLSAAMQKIATTRRLTVHFNPPSSCVLEISVRGVKIGVKADDSQEAKGNKCSHFFQLKNISFRGYHPKNNKYFGFITKHLADHRFACHVFVSEDSTKALAESVGRAFQQFHKQFVEYTCPTEDIYLE

SEQ ID NO: 53634 - protein, 40 aa, Homo sapiens [sequence omitted]

SEQ ID NO: 53635 - protein, 40 aa, Homo sapiens [sequence omitted]

SEQ ID NO: 53636 - protein, 423 aa, Homo sapiens
MLQMDLIDATGDTPGAEEDDDEERAARRPGAGPPKAESGQEPASRGQGQSQGQSQGPGSGDTYRPKRPTTLNLFPQVQLSQDTLNNNSLGKKSRHLHQQPTLLELVSLRPCFRDYSDESDSAIVYDNCASVSSPYESAIGEEYEEASRPQPPACLSKDSTPDEPDVHFSKKFLNIFMSGRSRSSSAESFGLFSCIINREEQEQTHRTIFRFVPRHEDEPELEVDDPLLVELQAEDYWYEAYNMRTGARGIFTAYYAIEVTKEPEHMAALAKNSDWVDQFRVKFLGSVQVPYHKGDVVLSAAMQKIATTRRLTVHFNPPSSCVLEISVRGVKIGIKADDSQEAKGNKCSHFFQLKNISFRGYHPKNNKYFGFITKHLADHRFACHVFVSEDSTKALAESVGRAFQQFHKQFVEYTCPTENIYLE

SEQ ID NO: 53637 - protein, 370 aa, Homo sapiens
MLAPGSSPGQRGRLALQWRQVSWITCWIALYAVEALPTCPFSCKCDSRSLEVDCSGLGLTTVPPDVPAATRTLLLLNNKLSALPSWAFANLSSLQRLDLSNNFLDRLPRSIFGDLTNLTELQLRNNSIRTLDRDLLRHSPLLRHLDLSINGLAQLPPGLFDGLLALRSLSLRSNRLQNLDRLTFEPLANLQLLQVGDNPWECDCNLREFKHWMEWFSYRGGRLDQLACTLPKELRGKDMRMVPMEMFNYCSQLEDENSSAGLDIPGPPCTKASPEPAKPKPGAEPEPEPSTACPQKQRHRPASVRRAMGTVIIAGVVCGVVCIMMVVAAAYGCIYASLMAKYHRELKKRQPLMGDPEGEHEDQKQISSVA

SEQ ID NO: 53638 - protein, 196 aa, Homo sapiens [sequence omitted]

SEQ ID NO: 53639 - protein, 132 aa, Homo sapiens [sequence omitted]

SEQ ID NO: 53640 - protein, 370 aa, Homo sapiens; identical to SEQ ID NO: 53637

SEQ ID NO: 53641 - protein, 153 aa, Homo sapiens
MAGPPAGTGCDLWGCPVYVNGEWVTNISEGGSFGELALIYGTPRAATVKAKTDLKLWGIDRDSYRRILMGTASVLQRRSPNEEYVEVGRLGPSDYFGEIALLLNRPRAATVVARGPLKCVKLDRPRFERVLGPCSEILKRNIQRYNSFISLTV

SEQ ID NO: 53642 - protein, 177 aa, Homo sapiens; identical to SEQ ID NO: 6269

SEQ ID NO: 53643 - protein, 124 aa, Homo sapiens
MHSPRTQIIWFCFTKSKCSTCISLFQTEMAIKHVFQKVFAGEKMRKVKESFPDPDLRRKGEDTFCFVAYLLWAKSYYCLREVRLTLAHPWGISCACGGETNQVGNNSFSPYLSSFHVLLWNKSD

SEQ ID NO: 53644 - protein, 68 aa, Homo sapiens
MSELNTKTSPATNQAAGQEEKGKAGNVKKAEEEEEIDIDLTAPETEKAALAIQGKFRRFQKRKKDPSS

SEQ ID NO: 53645 - protein, 141 aa, Homo sapiens
MTLLTIRIEKIGLKDAGQCIDPYITVRVKDLNGIDLTPVQDTPVASRKEDTYVHFNVDIELQKHVEKLIKGAAIFFEFKHYKPKKRFTSTKCFAFMEMDEIKPGPIVIELYKKPTDFKRKKLQLLTKKTLYLRLHQTLHKE

SEQ ID NO: 53646 - protein, 107 aa, Homo sapiens
MSMAACPEAPEPSFLREVPSSPASTQWHRPCNFRQVEANPRKEPKNLVWRDVSLGQTSRTPRGSGLELVRVCGGGMQRDKTVVEERVGEERERERERVWGERASMGR

SEQ ID NO: 53647 - protein, 168 aa, Homo sapiens [sequence omitted]

SEQ ID NO: 53648 - protein, 370 aa, Homo sapiens; identical to SEQ ID NO: 53637

SEQ ID NO: 53649 - protein, 196 aa, Homo sapiens [sequence omitted]

SEQ ID NO: 53650 - protein, 132 aa, Homo sapiens [sequence omitted]

SEQ ID NO: 53651 - protein, 370 aa, Homo sapiens; identical to SEQ ID NO: 53637

SEQ ID NO: 53652 - protein, 150 aa, Homo sapiens; identical to SEQ ID NO: 53632

SEQ ID NO: 53653 - protein, 124 aa, Homo sapiens; identical to SEQ ID NO: 53643

SEQ ID NO: 53654 - protein, 740 aa, Homo sapiens [sequence omitted]

SEQ ID NO: 53655 - protein, 40 aa, Homo sapiens [sequence omitted]

SEQ ID NO: 53656 - protein, 40 aa, Homo sapiens [sequence omitted]

SEQ ID NO: 53657 - protein, 68 aa, Homo sapiens; identical to SEQ ID NO: 53644

SEQ ID NO: 53658 - protein, 141 aa, Homo sapiens; identical to SEQ ID NO: 53645

SEQ ID NO: 53659 - protein, 107 aa, Homo sapiens; identical to SEQ ID NO: 53646

SEQ ID NO: 53660 - protein, 153 aa, Homo sapiens [sequence omitted]

SEQ ID NO: 53661 - protein, 48 aa, Homo sapiens
MKAMLFYSPEEVAQEAAEEPLIEPLMEPEGESYEDPPQEEYQEYEPEA

SEQ ID NO: 53662 - protein, 348 aa, Homo sapiens
MPRSFLVKKVKLDAFSSADLESAYGRARSDLGAPLHDKGYLSDYVGPSSVYDGDAEAALLKGPSPEPMYAAAVRGELGPAAAGSAPPPTPRPELATAAGGYINGDAAVSEGYAADAFFITDGRSRRKASNAGAAAAPSTASAAAPDGDAGGGGGAGGRSLGSGPGGRGGTRAGAGTEARAGPGAAGAGGRHACGECGKTYATSSNLSRHKQTHRSLDSQLARRCPTCGKVYVSMPAMAMHLLTHDLRHKCGVCGKAFSRPWLLQGHMRSHTGEKPFGCAHCGKAFADRSNLRAHMQTHSAFKHFQCKRCKKSFALKSYLNKHYESACFKGGAGGPAAPAPPQLSPVQA

SEQ ID NO: 53663 - protein, 73 aa, Homo sapiens
MGCWKGPEMHLWPGAIKIKEPGGLGDAAGWGGLQTLPGGLRTLPGFPLRNRSDSGCQDTFMVFMTSGIIIFNH

SEQ ID NO: 53664 - protein, 73 aa, Homo sapiens; identical to SEQ ID NO: 53663

SEQ ID NO: 53665 - protein, 4599 aa, Homo sapiens
  VARIANT 4343: Xaa = Any Amino Acid
MSEFLLALLTLSGLLPIARVLTVGADRDQQLCDPGEFLCHDHVTCVSQSWLCDGDPDCPDDSDESLDTCPEEVEIKCPLNHIACLGTNKCVHLSQLCNGVLDCPDGYDEGVHCQELLSNCQQLNCQYKCTMVRNSTRCYCEDGFEITEDGRSCKDQDECAVYGTCSQTCRNTHGSYTCSCVEGYLMQPDNRSCKAKIEPTDRPPILLIANFETIEVFYLNGSKMATLSSVNGNEIHTLDFIYNEDMICWIESRESSNQLKCIQITKAGGLTDEWTINILQSFHNVQQMAIDWLTRNLYFVDHVGDRIFVCNSNGSVCVTLIDLELHNPKAIAVDPIAGKLFFTDYGNVAKVERCDMDGMNRTRIIDSKTEQPAALALDLVNKLVYWVDLYLDYVGVVDYQGKNRHTVIQGRQVRHLYGITVFEDYLYATNSDNYNIVRINRFNGTDIHSLIKIENAWGIRIYQKRTQPTVRSHACEVDPYGMPGGCSHICLLSSSYKTRTCRCRTGFNLGSDGRSCKRPKNELFLFYGKGRPGIVRGMDLNTKIADEYMIPIENLVNPRALDFHAETNYIYFADTTSFLIGRQKIDGTERETILKDDLDNVEGIAVDWIGNNLYWTNDGHRKTINVARLEKASQSRKTLLEGEMSHPRGIVVDPVNGWMYWTDWEEDEIDDSVGRIEKAWMDGFNRQIFVTSKMLWPNGLTLDFHTNTLYWCDAYYDHIEKVFLNGTHRKIVYSGRELNHPFGLSHHGNYVFWTDYMNGSIFQLDLITSEVTLLRHERPPLFGLQIYDPRKQQGDNMCRVNNGGCSTLCLAIPGGRVCACADNQLLDENGTTCTFNPGEALPHICKAGEFRCKNRHCIQARWKCDGDDDCLDGSDEDSVNCFNHSCPDDQFKCQNNRCIPKRWLCDGANDCGSNEDESNQTCTARTCQVDQFSCGNGRCIPRAWLCDREDDCGDQTDEMASCEFPTCEPLTQFVCKSGRCISSKWHCDSDDDCGDGSDEVGCVHSCFDNQFRCSSGRCIPGHWACDGDNDCGDFSDEAQINCTKEEIHSPAGCNGNEFQCHPDGNCVPDLWRCDGEKDCEDGSDEKGCNGTIRLCDHKTKFSCWSTGRCINKAWVCDGDIDCEDQSDEDDCDSFLCGPPKHPCANDTSVCLQPEKLCNGKKDCPDGSDEGYLCDECSLNNGGCSNHCSVVPGRGIVCSCPEGLQLNKDNKTCEIVDYCSNHLKCSQVCEQHKHTVKCSCYEGWKLDVDGESCTSVDPFEAFIIFSIRHEIRRIDLHKRDYSLLVPGLRNTIALDFHFNQSLLYWTDVVEDRIYRGKLSESGGVSAIEVVVEHGLATPEGLTVDWIAGNIYWIDSNLDQIEVAKLDGSLRTTLIAGAMEHPRAIALDPRYGILFWTDWDANFPRIESASMSGAGRKTIYKDMKTGAWPNGLTVDHFEKRIVWTDARSDAIYSALYDGTNMIEIIRGHEYLSHPFAVSLYGSEVYWTDWRTNTLSKANKWTGQNVSVIQKTSAQPFDLQIYHPSRQPQAPNPCAANDGKGPCSHMCLINHNRSAACACPHLMKLSSDKKTCYEMKKFLLYARRSEIRGVDIDNPYFNFITAFTVPDIDDVTVIDFDASEERLYWTDIKTQTIKRAFINGTGLETVISRDIQSIRGLAVDWVSRNLYWISSEFDETQINVARLDGSLKTSIIHGIDKPQCLAAHPVRGKLYWTDGNTINMANMDGSNSKILFQNQKEPVGLSIDYVENKLYWISSGNGTINRCNLDGGNLEVIESMKEELTKATALTIMDKKLWWADQNLAQLGTCSKRDGRNPTILRNKTSGVVHMKVYDKEAQQGSNSCQLNNGGCSQLCLPTSETTRTCMCTVGYYLQKNRMSCQGIESFLMYSVHEGIRGIPLEPSDKMDALMPISGTSFAVGIDFHAENDTIYWTDMGFNKISRAKRDQTWKEDIITNGLGRVEGIAVDWIAGNIYWTDHGFNLIEVARLNGSFRYVIISQGLDQPRSIAVHPEKGLLFWTEWGQMPCIGKARLDGSEKVVLVSMGIAWPNGISIDYEENKLYWCDARTDKIERIDLETGGNREMVLSGSNVDMFSVAVFGAYIYWSDRAHANGSVRRGHKNDATETITMRTGLGVNLKEVKIFNRVREKGTNVCARDNGGCKQLCLYRGNSRRTCACAHGYLAEDGVTCLRHEGYLLYSGRTILKSIHLSDETNLNSPIRPYENPRYFKNVIALAFDYNQRRKGTNRIFYSDAHFGNIQLIKDNWEDRQVIVENVGSVEGLAYHRAWDTLYWTSSTTSSITRHTVDQTRPGAFDREAVITMSEDDHPHVLALDECQNLMFWTNWNEQHPSIMRSTLTGKNAQVVVSTDILTPNGLTIDYRAEKLYFSDGSLGKIERCEYDGSQRHVIVKSGPGTFLSLAVYDNYIFWSDWGRRAILRSNKYTGGDTKILRSDIPHQPMGIIAVANDTNSCELSPCALLNGGCHDLCLLTPNGRVNCSCRGDRILLEDNRCVTKNSSCNAYSEFECGNGECIDYQLTCDGIPHCKDKSDEKLLYCENRSCRRGFKPCYNRRCIPHGKLCDGENDCGDNSDELDCKVSTCATVEFRCADGTCIPRSARCNQNIDCADASDEKNCNNTDCTHFYKLGVKTTGFIRCNSTSLCVLPTWICDGSNDCGDYSDELKCPVQNKHKCEENYFSCPSGRCILNTWICDGQKDCEDGRDEFHCDSSCSWNQFACSAQKCISKHWICDGEDDCGDGLDESDSICGAITCAADMFSCQGSRACVPRHWLCDGERDCPDGSDELSTAGCAPNNTCDENAFMCHNKVCIPKQFVCDHDDDCGDGSDESPQCGYRQCGTEEFSCADGRCLLNTQWQCDGDFDCPDHSDEAPLNPKCKSAEQSCNSSFFMCKNGRCIPSGGLCDNKDDCGDGSDERNCHINECLSKKVSGCSQDCQDLPVSYKCKCWPGFQLKDDGKTCVDIDECSSGFPCSQQCINTYGTYKCLCTDGYEIQPDNPNGCKSLSDEEPFLILADHHEIRKISTDGSNYTLLKQGLNNVIAIDFDYREEFIYWIDSSRPNGSRINRMCLNGSDIKVVHNTAVPNALAVDWIGKNLYWSDTEKRIIEVSKLNGLYPTILVSKRLKFPRDLSLDPQAGYLYWIDCCEYPHIGRVGMDGTNQSVVIETKISRPMALTIDYVNRRLYWADENHIEFSNMDGSHRHKVPNQDIPGVIALTLFEDYIYWTDGKTKSLSRAHKTSGADRLSLIYSWHAITDIQVYHSYRQPDVSKHLCMINNGGCSHLCLLAPGKTHTCACPTNFYLAADNRTCLSNCTASQFRCKTDKCIPFWWKCDTVDDCGDGSDEPDDCPEFRCQPGRFQCGTGLCALPAFICDGENDCGDNSDELNCDTHVCLSGQFKCTKNQKCIPVNLRCNGQDDCGDEEDERDCPENSCSPDYFQCKTTKHCISKLWVCDEDPDCADASDEANCDKKTCGPHEFQCKNNNCIPDHWRCDSQNDCSDNSDEENCKPQTCTLKDFLCANGDCVSSRFWCDGDFDCADGSDERNCETSCSKDQFRCSNGQCIPAKWKCDGHEDCKYGEDEKSCEPASPTCSSREYICASDGCISASLKCNGEYDCADGSDEMDCVTECKEDQFRCKNKAHCIPIRWLCDGIHDCVDGSDEENCERGGNICRADEFLCNNSLCKLHFWVCDGEDDCGDNSDEAPDMCVKFLCPSTRPHRCRNNRICLQSEQMCNGIDECGDNSDEDHCGGKLTYKARPCKKDEFACSNKKCIPMDLQCDRLDDCGDGSDEQGCRIAPTEYTCEDNVNPCGDDAYCNQIKTSVFCRCKPGFQRNMKNRQCEDLNECLVFGTCSHQCINVEGSYKCVCDQNFQERNNTCIAEGSEDQVLYIANDTDILGFIYPFNYSGDHQQISHIEHNSRITGMDVYYQRDMIIWSTQFNPGGIFYKRIHGREKRQANSGLICPEFKRPRDIAVDWVAGNIYWTDHSRMHWFSYYTTHWTSLRYSINVGQLNGPNCTRLLTNMAGEPYAIAVNPKRGMMYWTVVGDHSHIEEAAMDGTLRRILVQKNLQRPTGLAVDYFSERIYWADFELSIIGSVLYDGSNSVVSVSSKQGLLHPHRIDIFEDYIYGAGPKNGVFRVQKFGHGSVEYLALNIDKTKGVLISHRYKQLDLPNPCLDLACEFLCLLNPSGATCVCPEGKYLINGTCNDDSLLDDSCKLTCENGGRCILNEKGDLRCHCWPSYSGERCEVNHCSNYCQNGGTCVPSVLGRPTCSCALGFTGPNCGKTVCEDFCQNGGTCIVTAGNQPYCHCQPEYTGDRCQYYVCHHYCVNSESCTIGDDGSXECVCPTRYEGPKCEVDKCVRCHGGHCIINKDSEDIFCNCTNGKIASSCQLCDGYCYNGGTCQLDPETNVPVCLCSTNWSGTQCERPAPKSSKSDHISTRSIAIIVPLVLLVTLITTLVIGLVLCKRKRRTKTIRRQPIINGGINVEIGNPSYNMYEVDHDHNDGGLLDPGFMIDPTKARYIGGGPSAFKLPHTAPPIYLNSDLKGPLTAGPTNYSNPVYAKLYMDGQNCRNSLGSVDERKELLPKKIEIGIRETVA

SEQ ID NO: 53666 - protein, 713 aa, Homo sapiens
MARARGSPCPPLPPGRMSWPHGALLFLWLFSPPLGAGGGGVAVTSAAGGGSPPATSCPVACSCSNQASRVICTRRDLAEVPASIPVNTRYLNLQENGIQVIRTDTFKHLRHLEILQLSKNLVRKIEVGAFNGLPSLNTLELFDNRLTTVPTQAFEYLSKLRELWLRNNPIESIPSYAFNRVPSLRRLDLGELKRLEYISEAAFEGLVNLRYLNLGMCNLKDIPNLTALVRLEELELSGNRLDLIRPGSFQGLTSLRKLWLMHAQVATIERNAFDDLKSLEELNLSHNNLMSLPHDLFTPLHRLERVHLNHNPWHCNCDVLWLSWWLKETVPSNTTCCARCHAPAGLKGRYIGELDQSHFTCYAPVIVEPPTDLNVTEGMAAELKCRTGTSMTSVNWLTPNGTLMTHGSYRVRISVLHDGTLNFTNVTVQDTGQYTCMVTNSAGNTTASATLNVSAVDPVAAGGTGSGGGGPGGSGGVGGGSGGYTYFTTVTVETLETQPGEEALQPRGTEKEPPGPTTDGVWGGGRPGDAAGPASSSTTAPAPRSSRPTEKAFTVPITDVTENALKDLDDVMKTTKIIIGCFVAITFMAAVMLVAFYKLRKQHQLHKHHGPTRTVEIINVEDELPAASAVSVAAAAAVASGGGVGGDSHLALPALERDHLNHHHYVAAAFKAHYSSNPSGGGCGGKGPPGLNSIHEPLLFKSGSKENVQETQI

SEQ ID NO: 53667 - protein, 713 aa, Homo sapiens; identical to SEQ ID NO: 53666

SEQ ID NO: 53668 - protein, 522 aa, Homo sapiens
MDFLLLGLCLYWLLRRPSGVVLCLLGACFQMLPAAPSGCPQLCRCEGRLLYCEALNLTEAPHNLSGLLGLSLRYNSLSELRAGQFTGLMQLTWLYLDHNHICSVQGDAFQKLRRVKELTLSSNQITQLPNTTFRPMPNLRSVDLSYNKLQALAPDLFHGLRKLTTLHMRANAIQFVPVRIFQDCRSLKFLDIGYNQLKSLARNSFAGLFKLTELHLEHNDLVKVNFAHFPRLISLHSLCLRRNKVAIVVSSLDWVWNLEKMDLSGNEIEYMEPHVFETVPHLQSLQLDSNRLTYIEPRILNSWKSLTSITLAGNLWDCGRNVCALASWLNNFQGRYDGNLQCASPEYAQGEDVLDAVYAFHLCEDGAEPTSGHLLSAVTNRSDLGPPASSATTLADGGEGQHDGTFEPATVALPGGEHAENAVQIHKVVTGTMALIFSFLIVVLVLYVSWKCFPASLRQLRQCFVTQRRKQKQKQTMHQMAAMSAQEYYVDYKPNHIEGALVIINEYGSCTCHQQPARECEV

SEQ ID NO: 53669 - protein, 516 aa, Homo sapiens
MGLHFKWPLGAPMLAAIYAMSMVLKMLPALGMACPPKCRCEKLLFYCDSQGFHSVPNATDKGSLGLSLRHNHITELERDQFASFSQLTWLHLDHNQISTVKEDAFQGLYKLKELILSSNKIFYLPNTTFTQLINLQNLDLSFNQLSSLHPELFYGLRKLQTLHLRSNSLRTIPVRLFWDCRSLEFLDLSTNRLRSLARNGFAGLIKLRELHLEHNQLTKINFAHFLRLSSLHTLFLQWNKISNLTCGMEWTWGTLEKLDLTGNEIKAIDLTVFETMPNLKILLMDNNKLNSLDSKILNSLRSLTTVGLSGNLWECSARICALASWLGSFQGRWEHSILCHSPDHTQGEDILDAVHGFQLCWNLSTTVTVMATTYRDPTTEYTKRISSSSYHVGDKEIPTTAGIAVTTEEHFPEPDNAIFTQRVITGTMALLFSFFFIIFIVFISRKCCPPTLRRIRQCSMVQNHRQLRSQTRLHMSNMSDQGPYNEYEPTHEGPFIIINGYGQCKCQQLPYKECEV

SEQ ID NO: 53670 - protein, 581 aa, Homo sapiens
MGFNVIRLLSGSAVALVIAPTVLLTMLSSAERGCPKGCRCEGKMVYCESQKLQEIPSSISAGCLGLSLRYNSLQKLKYNQFKGLNQLTWLYLDHNHISNIDENAFNGIRRLKELILSSNRISYFLNNTFRPVTNLRNLDLSYNQLHSLGSEQFRGLRKLLSLHLRSNSLRTIPVRIFQDCRNLELLDLGYNRIRSLARNVFAGMIRLKELHLEHNQFSKLNLALFPRLVSLQNLYLQWNKISVIGQTMSWTWSSLQRLDLSGNEIGAFSGPSVFQCVPNLQRLNLDSNKLTFIGQEILDSWISLNDISLAGNIWECSRNICSLVNWLKSFKGLRENTIICASPKELQGVNVIDAVKNYSICGKSTTERFDLARALPKPTFKPKLPRPKHESKPPLPPTVGATEPGPETDADAEHISFHKIIAGSVALFLSVLVILLVIYVSWKRYPASMKQLQQRSLMRRHRKKKRQSLKQMTPSTQEFYVDYKPTNTETSEMLLNGTGPCTYNKSGSRECEIPLSMNVSTFLAYDQPTISYCGVHHELLSHKSFETNAQEDTMETHLETELDLSTITTAGRISDHKQQLA

SEQ ID NO: 53671 - protein, 518 aa, Homo sapiens
MGFHLITQLKGMSVVLVLLPTLLLVMLTGAQRACPKNCRCDGKIVYCESHAFAGIPENISGGSQGLSLRFNSIQKLKSNQFAGLNQLIWLYLDHNYISSVDEDAFQGIRRLKELILSSNKITYLHNKTFHPVPNLRNLDLSYNKLQTLQSEQFKGLRKLIILHLRSNSLKTVPIRVFQDCRNLDFLDLGYNRLRSLSRNAFAGLLKLKELHLEHNQFSKINFAHFPRLFNLRSIYLQWNRIRSISQGLTWTWSSLHNLDLSGNDIQGIEPGTFKCLPNLQKLNLDSNKLTNISQETVNAWISLISITLSGNMWECSRSICPLFYWLKNFKGNKESTMICAGPKHIQGEKVSDAVETYNICSEVQVVNTERSHLVPQTPQKPLIIPRPTIFKPDVTQSTFETPSPSPGFQIPGAEQEYEHVSFHKIIAGSVALFLSVAMILLVIYVSWKRYPASMKQLQQHSLMKRRRKKARESERQMNSPLQEYYVDYKPTNSETMDISVNGSGPCTYTISGSRECEV

SEQ ID NO: 53672 - protein, 370 aa, Homo sapiens; identical to SEQ ID NO: 53637

SEQ ID NO: 53673 - protein, 140 aa, Homo sapiens
MLPAAMKGLGLALLAVLLCSAPAHGLWCQDCTLTTNSSHCTPKQCQPSDTVCASVRITDPSSSRKDHSVNKMCASSCDFVKRHFFSDYLMGFINSGILKVDVDCCEKDLCNGAAGAGHSPWALAGGLLLSLGPALLWAGP

SEQ ID NO: 53674 - protein, 626 aa, Homo sapiens
MIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESERRLGSERRLLGLRGEPPELDLSYSHSDLGKRPTKDSYTLTEELAEYAEIRVK

SEQ ID NO: 53675 - protein, 582 aa, Homo sapiens
MIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESKEVSTLESH

SEQ ID NO: 53676 - protein, 559 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEAAGGESALAPSVFKQAKDKVSNSTLSKIPALQGSTKSPRYSSACPSTTKRATFSDSLLIQPTSAGSTDRLPYSKSGNKDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVRILNKKIDFSKVQSRCGSKDNIKHSAGGGNVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 53677 - protein, 1827 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEDLLTASKMEFHDQQELTPSTAEPSDQKEKESEKQSKPGEDLKHAALVSQPETTKTYPDKKDMQGTEEEKAPLALFGHTLVASLEDMKQKTEPSLVVPGIDLPKEPPTPKEQKDWFIEMPTEAKKDEWGLVAPISPGPLTPMREKDVFDDIPKWEGKQFDSPMPSPFQGGSFTLPLDVMKNEIVTETSPFAPAFLQPDDKKSLQQTSGPATAKDSFKIEEPHEAKPDKMAEAPPSEAMTLPKDAHIPVVEEHVMGKVLEEEKEAINQETVQQRDTFTPSGQEPILTEKETELKLEEKTTISDKEAVPKESKPPKPADEEIGIIQTSTEHTFSEQKDQEPTTDMLKQDSFPVSLEQAVTDSAMTSKTLEKAMTEPSALIEKSSIQELFEMRVDDKDKIEGVGAATSAELDMPFYEDKSGMSKYFETSALKEEATKSIEPGSDYYELSDTRESVHESIDTMSPMHKNGDKEFQTGKESQPSPPAQEAGYSTLAQSYPSDLPEEPSSPQERMFTIDPKVYGEKRDLHSKNKDDLTLSRSLGLGGRSAIEQRSMSINLPMSCLDSIALGFNFGRGHDLSPLASDILTNTSGSMDEGDDYLPATTPALEKAPCFPVESKEEEQIEKVKATGEESTQAEISCESPFLAKDFYKNGTVMAPDLPEMLDLAGTRSRLASVSADAEVARRKSVPSETVVEDSRTGLPPVTDENHVIVKTDSQLEDLGYCVFNKYTVPLPSPVQDSENLSGESGTFYEGTDDKVRRDLATDLSLIEVKLAAAGRVKDEFSVDKEASAHISGDKSGLSKEFDQEKKANDRLDTVLEKSEEHADSKEHAKKTEEAGDEIETFGLGVTYEQALAKDLSIPTDASSEKAEKGLSSVPEIAEVEPSKKVEQGLDFAVQGQLDVKISDFGQMASGLNIDDRRATELKLEATQDMTPSSKAPQEADAFMGVESGHMKEGTKVSETEVKEKVAKPDLVHQEAVDKEESYESSGEHESLTMESLKADEGKKETSPESSLIQDEIAVKLSVEIPCPPAVSEADLATDERADVQMEFIQGPKEESKETPDISITPSDVAEPLHETIVSEPAEIQSEEEEIEAQGEYDKLLFRSDTLQITDLGVSGAREEFVETCPSEHKGVIESVVTIEDDFITVVQTTTDEGESGSHSVRFAALEQPEVERRPSPHDEEEFEVEEAAEAQAEPKDGSPEAPASPEREEVALSEYKTETYDDYKDETTIDDSIMDADSLWVDTQDDDRSIMTEQLETIPKEEKAEKEARRSSLEKHRKEKPFKTGRGRISTPERKVAKKEPSTVSRDEVRRKKAVYKKAELAKKTEVQAHSPSRKFILKPAIKYTRPTHLSCVKRKTTAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 53678 - protein, 471 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 53679 - protein, 1858 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEDLLTASKMEFHDQQELTPSTAEPSDQKEKESEKQSKPGEDLKHAALVSQPETTKTYPDKKDMQGTEEEKAPLALFGHTLVASLEDMKQKTEPSLVVPGIDLPKEPPTPKEQKDWFIEMPTEAKKDEWGLVAPISPGPLTPMREKDVFDDIPKWEGKQFDSPMPSPFQGGSFTLPLDVMKNEIVTETSPFAPAFLQPDDKKSLQQTSGPATAKDSFKIEEPHEAKPDKMAEAPPSEAMTLPKDAHIPVVEEHVMGKVLEEEKEAINQETVQQRDTFTPSGQEPILTEKETELKLEEKTTISDKEAVPKESKPPKPADEEIGIIQTSTEHTFSEQKDQEPTTDMLKQDSFPVSLEQAVTDSAMTSKTLEKAMTEPSALIEKSSIQELFEMRVDDKDKIEGVGAATSAELDMPFYEDKSGMSKYFETSALKEEATKSIEPGSDYYELSDTRESVHESIDTMSPMHKNGDKEFQTGKESQPSPPAQEAGYSTLAQSYPSDLPEEPSSPQERMFTIDPKVYGEKRDLHSKNKDDLTLSRSLGLGGRSAIEQRSMSINLPMSCLDSIALGFNFGRGHDLSPLASDILTNTSGSMDEGDDYLPATTPALEKAPCFPVESKEEEQIEKVKATGEESTQAEISCESPFLAKDFYKNGTVMAPDLPEMLDLAGTRSRLASVSADAEVARRKSVPSETVVEDSRTGLPPVTDENHVIVKTDSQLEDLGYCVFNKYTVPLPSPVQDSENLSGESGTFYEGTDDKVRRDLATDLSLIEVKLAAAGRVKDEFSVDKEASAHISGDKSGLSKEFDQEKKANDRLDTVLEKSEEHADSKEHAKKTEEAGDEIETFGLGVTYEQALAKDLSIPTDASSEKAEKGLSSVPEIAEVEPSKKVEQGLDFAVQGQLDVKISDFGQMASGLNIDDRRATELKLEATQDMTPSSKAPQEADAFMGVESGHMKEGTKVSETEVKEKVAKPDLVHQEAVDKEESYESSGEHESLTMESLKADEGKKETSPESSLIQDEIAVKLSVEIPCPPAVSEADLATDERADVQMEFIQGPKEESKETPDISITPSDVAEPLHETIVSEPAEIQSEEEEIEAQGEYDKLLFRSDTLQITDLGVSGAREEFVETCPSEHKGVIESVVTIEDDFITVVQTTTDEGESGSHSVRFAALEQPEVERRPSPHDEEEFEVEEAAEAQAEPKDGSPEAPASPEREEVALSEYKTETYDDYKDETTIDDSIMDADSLWVDTQDDDRSIMTEQLETIPKEEKAEKEARRSSLEKHRKEKPFKTGRGRISTPERKVAKKEPSTVSRDEVRRKKAVYKKAELAKKTEVQAHSPSRKFILKPAIKYTRPTHLSCVKRKTTAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVRILNKKIDFSKVQSRCGSKDNIKHSAGGGNVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 53680 - protein, 502 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVRILNKKIDFSKVQSRCGSKDNIKHSAGGGNVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 53681 - protein, 557 aa, Homo sapiens
MAEKGDCIASVYGYDLGGRFVDFQPLGFGVNGLVLSAVDSRACRKVAVKKIALSDARSMKHALREIKIIRRLDHDNIVKVYEVLGPKGTDLQGELFKFSVAYIVQEYMETDLARLLEQGTLAEEHAKLFMYQLLRGLKYIHSANVLHRDLKPANIFISTEDLVLKIGDFGLARIVDQHYSHKGYLSEGLVTKWYRSPRLLLSPNNYTKAIDMWAAGCILAEMLTGRMLFAGAHELEQMQLILETIPVIREEDKDELLRVMPSFVSSTWEVKRPLRKLLPEVNSEAIDFLEKILTFNPMDRLTAEMGLQHPYMSPYSCPEDEPTSQHPFRIEDEIDDIVLMAANQSQLSNWDTCSSRYPVSLSSDLEWRPDRCQDASEVQRDPRGFGALAEDVQVDPRKDSHSSSERFLEQSHSSMERAFEADYGRSCDYKVGSPSYLDKLLWRDNKPHHYSEPKLILDLSHWKQAAGAPPTATGLADTGAREDEPASLFLEIAQWVKSTQGAQSTPARPPTTPSAACLPRPPPPGPGGRRRQPPVRPGRVHLPRPEALHQARGPAGQ

SEQ ID NO: 53682 - protein, 824 aa, Homo sapiens
MADRAEMFSLSTFHSLSPPGCRPPQDISLEEFDDEDLSEITDDCGLGLSYDSDHCEKDSLSLGRSEQPHPICSFQDDFQEFEMIDDNEEEDDEDEEEEEEEEEGDGEGQEGGDPGSEAPAPGPLIPSPSVEEPHKHRPTTLRLTTLGAQDSLNNNGGFDLVRPASWQETALCSPAPEALRELPGPLPATDTGPGGAQSPVRPGCDCEGNRPAEPPAPGGTSPSSDPGIEADLRSRSSGGRGGRRSSQELSSPGSDSEDAGGARLGRMISSISETELELSSDGGSSSSGRSSHLTNSIEEASSPASEPEPPREPPRRPAFLPVGPDDTNSEYESGSESEPDLSEDADSPWLLSNLVSRMISEGSSPIRCPGQCLSPAPRPPGEPVSPAGGAAQDSQDPEAAAGPGGVELVDMETLCAPPPPAPAAPRPGPAQPGPCLFLSNPTRDTITPLWAAPGRAARPGRACSAACSEEEDEEDDEEEEDAEDSAGSPGGRGTGPSAPRDASLVYDAVKYTLVVDEHTQLELVSLRRCAGLGHDSEEDSGGEASEEEAGAALLGGGQVSGDTSPDSPDLTFSKKFLNVFVNSTSRSSSTESFGLFSCLVNGEEREQTHRAVFRFIPRHPDELELDVDDPVLVEAEEDDFWFRGFNMRTGERGVFPAFYAHAVPGPAKDLLGSKRSPCWVERFDVQFLGSVEVPCHQGNGILCAAMQKIATARKLTVHLRPPASCDLEISLRGVKLSLSGGGPEFQRCSHFFQMKNISFCGCHPRNSCYFGFITKHPLLSRFACHVFVSQESMRPVAQSVGRAFLEYYQEHLAYACPTEDIYLE

SEQ ID NO: 53683 - protein, 797 aa, Homo sapiens
MLPDFPSPSTWAPGLLLPSGPALLSPSVLQDSLSLGRSEQPHPICSFQDDFQEFEMIDDNEEEDDEDEEEEEEEEEGDGEGQEGGDPGSEAPAPGPLIPSPSVEEPHKHRPTTLRLTTLGAQDSLNNNGGFDLVRPASWQETALCSPAPEALRELPGPLPATDTGPGGAQSPVRPGCDCEGNRPAEPPAPGGTSPSSDPGIEADLRSRSSGGRGGRRSSQELSSPGSDSEDAGGARLGRMISSISETELELSSDGGSSSSGRSSHLTNSIEEASSPASEPEPPREPPRRPAFLPVGPDDTNSEYESGSESEPDLSEDADSPWLLSNLVSRMISEGSSPIRCPGQCLSPAPRPPGEPVSPAGGAAQDSQDPEAAAGPGGVELVDMETLCAPPPPAPAAPRPGPAQPGPCLFLSNPTRDTITPLWAAPGRAARPGRACSAACSEEEDEEDDEEEEDAEDSAGSPGGRGTGPSAPRDASLVYDAVKYTLVVDEHTQLELVSLRRCAGLGHDSEEDSGGEASEEEAGAALLGGGQVSGDTSPDSPDLTFSKKFLNVFVNSTSRSSSTESFGLFSCLVNGEEREQTHRAVFRFIPRHPDELELDVDDPVLVEAEEDDFWFRGFNMRTGERGVFPAFYAHAVPGPAKDLLGSKRSPCWVERFDVQFLGSVEVPCHQGNGILCAAMQKIATARKLTVHLRPPASCDLEISLRGVKLSLSGGGPEFQRCSHFFQMKNISFCGCHPRNSCYFGFITKHPLLSRFACHVFVSQESMRPVAQSVGRAFLEYYQEHLAYACPTEDIYLE

SEQ ID NO: 53684 - protein, 443 aa, Homo sapiens
MADRAEMFSLSTFHSLSPPGCRPPQDISLEEFDDEDLSEITDDCGLGLSYDSDHCEKDSLSLGRSEQPHPICSFQDDFQEFEMIDDNEEEDEEDDEEEEDAEDSAGSPGGRGTGPSAPRDASLVYDAVKYTLVVDEHTQLELVSLRRCAGLGHDSEEDSGGEASEEEAGAALLGGGQVSGDTSPDSPDLTFSKKFLNVFVNSTSRSSSTESFGLFSCLVNGEEREQTHRAVFRFIPRHPDELELDVDDPVLVEAEEDDFWFRGFNMRTGERGVFPAFYAHAVPGPAKDLLGSKRSPCWVERFDVQFLGSVEVPCHQGNGILCAAMQKIATARKLTVHLRPPASCDLEISLRGVKLSLSGGGPEFQRCSHFFQMKNISFCGCHPRNSCYFGFITKHPLLSRFACHVFVSQESMRPVAQSVGRAFLEYYQEHLAYACPTEDIYLE

SEQ ID NO: 53685 - protein, 1570 aa, Homo sapiens
MSDSLWTALSNFSMPSFPGGSMFRRTKSCRTSNRKSLILTSTSPTLPRPHSPLPGHLGSSPLDSPRNFSPNTPAHFSFASSRRADGRRWSLASLPSSGYGTNTPSSTVSSSCSSQERLHQLPYQPTVDELHFLSKHFGSTESITDEDGGRRSPAVRPRSRSLSPGRSPSSYDNEIVMMNHVYKERFPKATAQMEEKLRDFTRAYEPDSVLPLADGVLSFIHHQIIELARDCLTKSRDGLITTVYFYELQENLEKLLQDAYERSESLEVAFVTQLVKKLLIIISRPARLLECLEFNPEEFYHLLEAAEGHAKEGHLVKTDIPRYIIRQLGLTRDPFPDVVHLEEQDSGGSNTPEQDDLSEGRSSKAKKPPGENDFDTIKLISNGAYGAVYLVRHRDTRQRFAMKKINKQNLILRNQIQQAFVERDILTFAENPFVVGMFCSFETRRHLCMVMEYVEGGDCATLLKNIGALPVEMARMYFAETVLALEYLHNYGIVHRDLKPDNLLITSMGHIKLTDFGLSKMGLMSLTTNLYEGHIEKDAREFLDKQVCGTPEYIAPEVILRQGYGKPVDWWAMGIILYEFLVGCVPFFGDTPEELFGQVISDDILWPEGDEALPTEAQLLISSLLQTNPLVRLGAGGAFEVKQHSFFRDLDWTGLLRQKAEFIPHLESEDDTSYFDTRSDRYHHVNSYDEDDTTEEEPVEIRQFSSCSPRFSKVYSSMEQLSQHEPKTPVAAAGSSKREPSTKGPEEKVAGKREGLGGLTLREKTWRGGSPEIKRFSASEASFLEGEASPPLGARRRFSALLEPSRFSAPQEDEDEARLRRPPRPSSDPAGSLDARAPKEETQGEGTSSAGDSEATDRPRPGDLCPPSKDGDASGPRATNDLVLRRARHQQMSGDVAVEKRPSRTGGKVIKSASATALSVMIPAVDPHGSSPLASPMSPRSLSSNPSSRDSSPSRDYSPAVSGLRSPITIQRSGKKYGFTLRAIRVYMGDTDVYSVHHIVWHVEEGGPAQEAGLCAGDLITHVNGEPVHGMVHPEVVELILKSGNKVAVTTTPFENTSIRIGPARRSSYKAKMARRNKRPSAKEGQESKKRSSLFRKITKQSNLLHTSRSLSSLNRSLSSSDSLPGSPTHGLPARSPTHSYRSTPDSAYLGASSQSSSPASSTPNSPASSASHHIRPSTLHGLSPKLHRQYRSARCKSAGNIPLSPLAHTPSPTQASPPPLPGHTVGSSHTTQSFPAKLHSSPPVVRPRPKSAEPPRSPLLKRVQSAEKLGASLSADKKGALRKHSLEVGHPDFRKDFHGELALHSLAESDGETPPVEGLGAPRQVAVRRLGRQESPLSLGADPLLPEGASRPPVSSKEKESPGGAEACTPPRATTPGGRTLERDVGCTRHQSVQTEDGTGGMARAVAKAALSPVQEHETGRRSSSGEAGTPLVPIVVEPARPGAKAVVPQPLGADSKGLQEPAPLAPSVPEAPRGRERWVLEVVEERTTLSGPRSKPASPKLSPEPQTPSLAPAKCSAPSSAVTPVPPASLLGSGTKPQVGLTSRCPAEAVPPAGLTKKGVSSPAPPGP

SEQ ID NO: 53686 - protein, 197 aa, Homo sapiens
MASQKRPSQRHGSKYLATASTMDHARHGFLPRHRDTGILDSIGRFFGGDRGAPKRGSGKVPWLKPGRSPLPSHARSQPGLCNMYKDSHHPARTAHYGSLPQKSHGRTQDENPVVHFFKNIVTPRTPPPSQGKGRGLSLSRFSWGAEGQRPGFGYGGRASDYKSAHKGFKGVDAQGTLSKIFKLGGRDSRSGSPMARR

SEQ ID NO: 53687 - protein, 171 aa, Homo sapiens
MASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGRGLSLSRFSWGAEGQRPGFGYGGRASDYKSAHKGFKGVDAQGTLSKIFKLGGRDSRSGSPMARR

SEQ ID NO: 53688 - protein, 160 aa, Homo sapiens
MASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGAEGQRPGFGYGGRASDYKSAHKGFKGVDAQGTLSKIFKLGGRDSRSGSPMARR

SEQ ID NO: 53689 - protein, 137 aa, Homo sapiens
MASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGRGLSLSRFSWREGGRRPETRIWLRRQSVRL

SEQ ID NO: 53690 - protein, 126 aa, Homo sapiens
MASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKREGGRRPETRIWLRRQSVRL

SEQ ID NO: 53691 - protein, 197 aa, Homo sapiens
MGNHAGKRELNAEKASTNSETNRGESEKKRNLGELSRTTSEDNEVFGEADANQNNGTSSQDTAVTDSKRTADPKNAWQDAHPADPGSRPHLIRLFSRDAPGREDNTFKDRPSESDELQTIQEDSAATSESLDVMASQKRPSQRHGSKYLATASTMDHARHGFLPRHRDTGILDSIGRFFGGDRGAPKRGSGKVSSEE

SEQ ID NO: 53692 - protein, 304 aa, Homo sapiens
MGNHAGKRELNAEKASTNSETNRGESEKKRNLGELSRTTSEDNEVFGEADANQNNGTSSQDTAVTDSKRTADPKNAWQDAHPADPGSRPHLIRLFSRDAPGREDNTFKDRPSESDELQTIQEDSAATSESLDVMASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGRGLSLSRFSWGAEGQRPGFGYGGRASDYKSAHKGFKGVDAQGTLSKIFKLGGRDSRSGSPMARR

SEQ ID NO: 53693 - protein, 186 aa, Homo sapiens
MASQKRPSQRHGSKYLATASTMDHARHGFLPRHRDTGILDSIGRFFGGDRGAPKRGSGKVPWLKPGRSPLPSHARSQPGLCNMYKDSHHPARTAHYGSLPQKSHGRTQDENPVVHFFKNIVTPRTPPPSQGKGAEGQRPGFGYGGRASDYKSAHKGFKGVDAQGTLSKIFKLGGRDSRSGSPMARR

SEQ ID NO: 53694 - protein, 332 aa, Homo sapiens
MVNSTHRGMHTSLHLWNRSSYRLHSNASESLGKGYSDGGCYEQLFVSPEVFVTLGVISLLENILVIVAIAKNKNLHSPMYFFICSLAVADMLVSVSNGSETIIITLLNSTDTDAQSFTVNIDNVIDSVICSSLLASICSLLSIAVDRYFTIFYALQYHNIMTVKRVGIIISCIWAACTVSGILFIIYSDSSAVIICLITMFFTMLALMASLYVHMFLMARLHIKRIAVLPGTGAIRQGANMKGAITLTILIGVFVVCWAPFFLHLIFYISCPQNPYCVCFMSHFNLYLILIMCNSIIDPLIYALRSQELRKTFKEIICCYPLGGLCDLSSRY

SEQ ID NO: 53695 - protein, 1140 aa, Homo sapiens
MVISLNSCLSFICLLLCHWIGTASPLNLEDPNVCSHWESYSVTVQESYPHPFDQIYYTSCTDILNWFKCTRHRVSYRTAYRHGEKTMYRRKSQCCPGFYESGEMCVPHCADKCVHGRCIAPNTCQCEPGWGGTNCSSACDGDHWGPHCTSRCQCKNGALCNPITGACHCAAGFRGWRCEDRCEQGTYGNDCHQRCQCQNGATCDHVTGECRCPPGYTGAFCEDLCPPGKHGPQCEQRCPCQNGGVCHHVTGECSCPSGWMGTVCGQPCPEGRFGKNCSQECQCHNGGTCDAATGQCHCSPGYTGERCQDECPVGTYGVLCAETCQCVNGGKCYHVSGACLCEAGFAGERCEARLCPEGLYGIKCDKRCPCHLENTHSCHPMSGECACKPGWSGLYCNETCSPGFYGEACQQICSCQNGADCDSVTGKCTCAPGFKGIDCSTPCPLGTYGINCSSRCGCKNDAVCSPVDGSCTCKAGWHGVDCSIRCPSGTWGFGCNLTCQCLNGGACNTLDGTCTCAPGWRGEKCELPCQDGTYGLNCAERCDCSHADGCHPTTGHCRCLPGWSGVHCDSVCAEGRWGPNCSLPCYCKNGASCSPDDGICECAPGFRGTTCQRICSPGFYGHRCSQTCPQCVHSSGPCHHITGLCDCLPGFTGALCNEVCPSGRFGKNCAGICTCTNNGTCNPIDRSCQCYPGWIGSDCSQPCPPAHWGPNCIHTCNCHNGAFCSAYDGECKCTPGWTGLYCTQRCPLGFYGKDCALICQCQNGADCDHISGQCTCRTGFMGRHCEQKCPSGTYGYGCRQICDCLNNSTCDHITGTCYCSPGWKGARCDQAGVIIVGNLNSLSRTSTALPADSYQIGAIAGIIILVLVVLFLLALFIIYRHKQKGKESSMPAVTYTPAMRVVNADYTISGTLPHSNGGNANSHYFTNPSYHTLTQCATSPHVNNRDRMTVTKSKNNQLFVNLKNVNPGKRGPVGDCTGTLPADWKHGGYLNELGAFGLDRSYMGKSLKDLGKNSEYNSSNCSLSSSENPYATIKDPPVLIPKSSECGYVEMKSPARRDSPYAEINNSTSANRNVYEVEPTVSVVQGVFSNNGRLSQDPYDLPKNSHIPCHYDLLPVRDSSSSPKQEDSGGSSSNSSSSSE

SEQ ID NO: 53696 - protein, 790 aa, Homo sapiens
MITVNPDGKIMVRRCLVTLRPFRLFVLGIGFFTLCFLMTSLGGQFSARRLGDSPFTIRTEVMGGPESRGVLRKMSDLLELMVKRMDALARLENSSELHRAGGDLHFPADRMPPGAGLMERIQAIAQNVSDIAVKVDQILRHSLLLHSKVSEGRRDQCEAPSDPKFPDCSGKVEWMRARWTSDPCYAFFGVDGTECSFLIYLSEVEWFCPPLPWRNQTAAQRAPKPLPKVQAVFRSNLSHLLDLMGSGKESLIFMKKRTKRLTAQWALAAQRLAQKLGATQRDQKQILVHIGFLTEESGDVFSPRVLKGGPLGEMVQWADILTALYVLGHGLRVTVSLKELQSNLGVPPGRGSCPLTMPLPFDLIYTDYHGLQQMKRHMGLSFKKYRCRIRVIDTFGTEPAYNHEEYATLHGYRTNWGYWNLNPKQFMTMFPHTPDNSFMGFVSEELNETEKRLIKGGKASNMAVVYGKEASIWKGKEKFLGILNKYMEIHGTVYYESQRPPEVPAFVKNHGLLPQPEFQQLLRKAKLFIGFGFPYEGPAPLEAIANGCIFLQSRFSPPHSSLNHEFFRGKPTSREVFSQHPYAENFIGKPHVWTVDYNNSEEFEAAIKAIMRTQVDPYLPYEYTCEGMLERIHAYIQHQDFCRAPDPALPEAHAPQSPFVLAPNATHLEWARNTSLAPGAWPPAHALRAWLAVPGRACTDTCLDHGLICEPSFFPFLNSQDAFLKLQVPCDSTESEMNHLYPAFAQPGQECYLQKEPLLFSCAGSNTKYRRLCPCRDFRKGQVALCQGCL

SEQ ID NO: 53697 - protein, 801 aa, Homo sapiens
MHSFVKHLCSRYVVERQGTMALPALLTRLLPLRRLFVLGIGFFTLCFLMTSLGGQFSARRLGDSPFTIRTEVMGGPESRGVLRKMSDLLELMVKRMDALARLENSSELHRAGGDLHFPADRMPPGAGLMERIQAIAQNVSDIAVKVDQILRHSLLLHSKVSEGRRDQCEAPSDPKFPDCSGKVEWMRARWTSDPCYAFFGVDGTECSFLIYLSEVEWFCPPLPWRNQTAAQRAPKPLPKVQAVFRSNLSHLLDLMGSGKESLIFMKKRTKRLTAQWALAAQRLAQKLGATQRDQKQILVHIGFLTEESGDVFSPRVLKGGPLGEMVQWADILTALYVLGHGLRVTVSLKELQSNLGVPPGRGSCPLTMPLPFDLIYTDYHGLQQMKRHMGLSFKKYRCRIRVIDTFGTEPAYNHEEYATLHGYRTNWGYWNLNPKQFMTMFPHTPDNSFMGFVSEELNETEKRLIKGGKASNMAVVYGKEASIWKGKEKFLGILNKYMEIHGTVYYESQRPPEVPAFVKNHGLLPQPEFQQLLRKAKLFIGFGFPYEGPAPLEAIANGCIFLQSRFSPPHSSLNHEFFRGKPTSREVFSQHPYAENFIGKPHVWTVDYNNSEEFEAAIKAIMRTQVDPYLPYEYTCEGMLERIHAYIQHQDFCRAPDPALPEAHAPQSPFVLAPNATHLEWARNTSLAPGAWPPAHALRAWLAVPGRACTDTCLDHGLICEPSFFPFLNSQDAFLKLQVPCDSTESEMNHLYPAFAQPGQECYLQKEPLLFSCAGSNTKYRRLCPCRDFRKGQVALCQGCL

SEQ ID NO: 53698 - protein, 104 aa, Homo sapiens
MPRSSQHSESSPLDTTTQRKGASSLAHQVRVHTLETLLDWPELPQPLLTPPPVIDTAAGSRKRFLNKAQLAQCLAQQTINTCKLNCMILAQVLLMWLTATHLHG

SEQ ID NO: 53699 - protein, 295 aa, Homo sapiens
MPFPPMPPPPAPAPGAQAARQLPRRPCAAGDKKKRPPQRPEGLLSSSWPSATLKRPPARRGPGLDRTQPPAPPGVSPQALPSRARAPATCAPPRPAGSGHSPARTTYAATSAGTGTTAAGTSSGAGPCPDSAARFCLNLTPEAVLVIQKRHLEKQLLARPRRPFPSPSAEPRRLLAPCLPARAAGPRRGGPASDPDAPPTAGQGRRAPPPGAQLLHGGLQVPQLSPRPGALRPMLKVSLLNERHRYDDVEYEEEPEAVDEGLVRKCTEWLRGVESAAAARGRAGALDSRRHLSTL

SEQ ID NO: 53700 - protein, 1124 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQERRVSGIGKPVLCSSSGPPVHSCCPKPEEATPSPSPPLKRQFPSVVVTGHVLRELKQVSAGSECLSRPWRARAKSDLQLGGTENFATLPSTRPRAQALSGVLWRLQQVEEKILQKRAQNLANREFHTKNIKEKAAHLASMFGHGDFPQNKLLSKGLSHTHPPSPPSRLPSPDPAASSSPSTVDSASPARKEKKSPSGFHFHPSHLRTVHPQLTVGKVSSGIGAAAEVLVNLYMNDHRPKAQATSPDLESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPVHFSLPVLHPLLG

SEQ ID NO: 53701 - protein, 377 aa, Homo sapiens
MTQEPFREELAYDRMPTLERGRQDPASYAPDAKPSDLQLSKRLPPCFSHKTWVFSVLMGSCLLVTSGFSLYLGNVFPAEMDYLRCAAGSCIPSAIVSFTVSRRNANVIPNFQILFVSTFAVTTTCLIWFGCKLVLNPSAININFNLILLLLLELLMAATVIIAARSSEEDCKKKKGSMSDSANILDEVPFPARVLKSYSVVEVIAGISAVLGGIIALNVDDSVSGPHLSVTFFWILVACFPSAIASHVAAECPSKCLVEVLIAISSLTSPLLFTASGYLSFSIMRIVEMFKDYPPAIKPSYDVLLLLLLLVLLLQAGLNTGTAIQCVRFKVSARLQGASWDTQNGPQERLAGEVARSPLKEFDKEKAWRAVVVQMAQ

SEQ ID NO: 53702 - protein, 377 aa, Homo sapiens; identical to SEQ ID NO: 53701

SEQ ID NO: 53703 - protein, 252 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFDPHFLRVPCWKITLFVIVPVLGPLVALIICYNWLHRRLAGQFLEELLFHLEALSG

SEQ ID NO: 53704 - protein, 247 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFDPHFLRVPCWKITLFVIVPVLGPLVALIICYNWLHRRLAGQFLEELRNPF

SEQ ID NO: 53705 - protein, 171 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEVSHSVTQDWLQWHDHGSLQPPPPRLK

SEQ ID NO: 53706 - protein, 171 aa, Homo sapiens; identical to SEQ ID NO: 53705

SEQ ID NO: 53707 - protein, 460 aa, Homo sapiens
MAESENRKELSESSQEEAGNQIMVEGLGEHLERGEDAAAGLGDDGKCGEEAAAGLGEEGENGEDTAAGSGEDGKKGGDTDEDSEADRPKGLIGYVLDTDFVESLPVKVKYRVLALKKLQTRAANLESKFLREFHDIERKFAEMYQPLLEKRRQIINAIYEPTEEECEYKSDSEDCDDEEMCHEEMYGNEEGMVHEYVDEDDGYEDYYYDYAVEEEEEEEEEDDIEATGEENKEEEDPKGIPDFWLTVLKNVDTLTPLIKKYDEPILKLLTDIKVKLSDPGEPLSFTLEFHFKPNEYFKNELLTKTYVLKSKLAYYDPHPYRGTAIEYSTGCEIDWNEGKNVTLKTIKKKQKHRIWGTIRTVTEDFPKDSFFNFFSPHGITSNGRDGNDDFLLGHNLRTYIIPRSVLFFSGDALESQQEGVVREVNDAIYDKIIYDNWMAAIEEVKACCKNLEALVEDIDR

SEQ ID NO: 53708 - protein, 729 aa, Homo sapiens
MSCCDLAAAGQLGKASIMASDCEPALNQAEGRNPTLERYLGALREAKNDSEQFAALLLVTKAVKAGDIDAKTRRRIFDAVGFTFPNRLLTTKEAPDGCPDHVLRALGVALLACFCSDPELAAHPQVLNKIPILSTFLTARGDPDDAARRSMIDDTYQCLTAVAGTPRGPRHLIAGGTVSALCQAYLGHGYGFDQALALLVGLLAAAETQCWKEAEPDLLAVLRGLSEDFQKAEDASKFELCQLLPLFLPPTTVPPECYRDLQAGLARILGSKLSSWQRNPALKLAARLAHACGSDWIPAGSSGSKFLALLVNLACVEVRLALEETGTEVKEDVVTACYALMELGIQECTRCEQSLLKEPQKVQLVSVMKEAIGAVIHYLLQVGSEKQKEPFVFASVRILGAWLAEETSSLRKEVCQLLPFLVRYAKTLYEEAEEANDLSQQVANLAISPTTPGPTWPGDALRLLLPGWCHLTVEDGPREILIKEGAPSLLCKYFLQQWELTSPGHDTSVLPDSVEIGLQTCCHIFLNLVVTAPGLIKRDACFTSLMNTLMTSLPALVQQQGRLLLAANVATLGLLMARLLSTSPALQGTPASRGFFAAAILFLSQSHVARATPGSDQAVLALSPEYEGIWADLQELWFLGMQAFTGCVPLLPWLAPAALRSRWPQELLQLLGSVSPNSVKPEMVAAYQGVLVELARANRLCREAMRLQAGEETASHYRMAALEQCLSEP

SEQ ID NO: 53709 - protein, 712 aa, Homo sapiens
MASDCEPALNQAEGRNPTLERYLGALREAKNDSEQFAALLLVTKAVKAGDIDAKTRRRIFDAVGFTFPNRLLTTKEAPDGCPDHVLRALGVALLACFCSDPELAAHPQVLNKIPILSTFLTARGDPDDAARRSMIDDTYQCLTAVAGTPRGPRHLIAGGTVSALCQAYLGHGYGFDQALALLVGLLAAAETQCWKEAEPDLLAVLRGLSEDFQKAEDASKFELCQLLPLFLPPTTVPPECYRDLQAGLARILGSKLSSWQRNPALKLAARLAHACGSDWIPAGSSGSKFLALLVNLACVEVRLALEETGTEVKEDVVTACYALMELGIQECTRCEQSLLKEPQKVQLVSVMKEAIGAVIHYLLQVGSEKQKEPFVFASVRILGAWLAEETSSLRKEVCQLLPFLVRYAKTLYEEAEEANDLSQQVANLAISPTTPGPTWPGDALRLLLPGWCHLTVEDGPREILIKEGAPSLLCKYFLQQWELTSPGHDTSVLPDSVEIGLQTCCHIFLNLVVTAPGLIKRDACFTSLMNTLMTSLPALVQQQGRLLLAANVATLGLLMARLLSTSPALQGTPASRGFFAAAILFLSQSHVARATPGSDQAVLALSPEYEGIWADLQELWFLGMQAFTGCVPLLPWLAPAALRSRWPQELLQLLGSVSPNSVKPEMVAAYQGVLVELARANRLCREAMRLQAGEETASHYRMAALEQCLSEP

SEQ ID NO: 53710 - protein, 729 aa, Homo sapiens; identical to SEQ ID NO: 53708

SEQ ID NO: 53711 - protein, 133 aa, Homo sapiens
MRKHVLAASFSMLSLLVIMGDTDSKTDSSFIMDSDPRRCMRHHYVDSISHPLYKCSSKMVLLARCEGHCSQASRSEPLVSFSTVLKQPFRSSCHCCRPQTSKLKALRLRCSGGMRLTATYRYILSCHCEECNS

SEQ ID NO: 53712 - protein, 916 aa, Homo sapiens
MSYTLDSLGNPSAYRRVTETRSSFSRVSGSPSSGFRSQSWSRGSPSTVSSSYKRSMLAPRLAYSSAMLSSAESSLDFSQSSSLLNGGSGPGGDYKLSRSNEKEQLQGLNDRFAGYIEKVHYLEQQNKEIEAEIQALRQKQASHAQLGDAYDQEIRELRATLEMVNHEKAQVQLDSDHLEEDIHRLKERFEEEARLRDDTEAAIRALRKDIEEASLVKVELDKKVQSLQDEVAFLRSNHEEEVADLLAQIQASHITVERKDYLKTDISTALKEIRSQLESHSDQNMHQAEEWFKCRYAKLTEAAEQNKEAIRSAKEEIAEYRRQLQSKSIELESVRGTKESLERQLSDIEERHNHDLSSYQDTIQQLENELRGTKWEMARHLREYQDLLNVKMALDIEIAAYRKLLEGEETRFSTFAGSITGPLYTHRPPITISSKIQKTKVEAPKLKVQHKFVEEIIEETKVEDEKSEMEEALTAITEELAASMKEEKKEAAEEKEEEPEAEEEEVAAKKSPVKATAPEVKEEEGEKEEEEGQEEEEEEDEGAKSDQAEEGGSEKEGSSEKEEGEQEEGETEAEAEGEEAEAKEEKKVEEKSEEVATKEELVADAKVEKPEKAKSPVPKSPVEEKGKSPVPKSPVEEKGKSPVPKSPVEEKGKSPVPKSPVEEKGKSPVSKSPVEEKAKSPVPKSPVEEAKSKAEVGKGEQKEEEEKEVKEAPKEEKVEKKEEKPKDVPEKKKAESPVKEEAVAEVVTITKSVKVHLEKETKEEGKPLQQEKEKEKAGGEGGSEEEGSDKGAKGSRKEDIAVNGEVEGKEEVEQETKEKGSGREEEKGVVTNGLDLSPADEKKGGDKSEEKVVVTKTVEKITSEGGDGATKYITKSVTVTQKVEEHEETFEEKLVSTKKVEKVTSHAIVKEVTQSD

SEQ ID NO: 53713 - protein, 382 aa, Homo sapiens
MLTRLFSEPGLLSDVPKFASWGDGEDDEPRSDKGDAPPPPPPAPGPGAPGPARAAKPVPLRGEEGTEATLAEVKEEGELGGEEEEEEEEEEGLDEAEGERPKKGGPKKRKMTKARLERSKLRRQKANARERNRMHDLNAALDNLRKVVPCYSKTQKLSKIETLRLAKNYIWALSEILRSGKRPDLVSYVQTLCKGLSQPTTNLVAGCLQLNSRNFLTEQGADGAGRFHGSGGPFAMHPYPYPCSRLAGAQCQAAGGLGGGAAHALRTHGYCAAYETLYAAAGGGGASPDYNSSEYEGPLSPPLCLNGNFSLKQDSSPDHEKSYHYSMHYSALPGSRPTGHGLVFGSSAVRGGVHSENLLSYDMHLHHDRGPMYEELNAFFHN

SEQ ID NO: 53714 - protein, 337 aa, Homo sapiens
MLTLPFDESVVMPESQMCRKFSRECEDQKQIKKPESFSKQIVLRGKSIKRAPGEETEKEEEEEDREEEDENGLPRRRGLRKKKTTKLRLERVKFRRQEANARERNRMHGLNDALDNLRKVVPCYSKTQKLSKIETLRLAKNYIWALSEILRIGKRPDLLTFVQNLCKGLSQPTTNLVAGCLQLNARSFLMGQGGEAAHHTRSPYSTFYPPYHSPELTTPPGHGTLDNSKSMKPYNYCSAYESFYESTSPECASPQFEGPLSPPPINYNGIFSLKQEETLDYGKNYNYGMHYCAVPPRGPLGQGAMFRLPTDSHFPYDLHLRSQSLTMQDELNAVFHN

SEQ ID NO: 53715 - protein, 710 aa, Homo sapiens
METRESEDLEKTRRKSASDQWNTDNEPAKVKPELLPEKEETSQADQDIQDKEPHCHIPIKRNSIFNRSIRRKSKAKARDNPERNASCLADSQDNGKSVNEPLTLNIPWSRTPPCRTAMQTDPGAQEMSESSSTPGNGATPEEWPALADSPTTLTEALRMIHPIPADSWRNLIEQIGLLYQEYRDKSTLQEIETRRQQDAEIEDNTNGSPASEDTPEEEEEEEEEEEPASPPERKTLPQICLLSNPHSRFNLWQDLPEIRSSGVLEILQPEEIKLQEAMFELVTSEASYYKSLNLLVSHFMENERIRKILHPSEAHILFSNVLDVLAVSERFLLELEHRMEENIVISDVCDIVYRYAADHFSVYITYVSNQTYQERTYKQLLQEKAAFRELIAQLELDPKCRGLPFSSFLILPFQRITRLKLLVQNILKRVEERSERECTALDAHKELEMVVKACNEGVRKMSRTEQMISIQKKMEFKIKSVPIISHSRWLLKQGELQQMSGPKTSRTLRTKKLFHEIYLFLFNDLLVICRQIPGDKYQVFDSAPRGLLRVEELEDQGQTLANVFILRLLENADDREATYMLKASSQSEMKRWMTSLAPNRRTKFVSFTSRLLDCPQVQCVHPYVAQQPDELTLELADILNILDKTDDGWIFGERLHDQERGWFPSSMTEEILNPKIRSQNLKECFRVHKMDDPQRSQNKDRRKLGSRNRQ

SEQ ID NO: 53716 - protein, 277 aa, Homo sapiens
MDTNRPGAFVLSSAPLAALHNMAEMKTSLFPYALQGPAGFKAPALGGLGAQLPLGTPHGISDILGRPVGAAGGGLLGGLPRLNGLASSAGVYFGPAAAVARGYPKPLAELPGRPPIFWPGVVQGAPWRDPRLAGPAPAGGVLDKDGKKKHSRPTFSGQQIFALEKTFEQTKYLAGPERARLAYSLGMTESQVKVWFQNRRTKWRKRHAAEMASAKKKQDSDAEKLKVGGSDAEDDDEYNRPLDPNSDDEKITRLLKKHKPSNLALVSPCGGGAGDAL

SEQ ID NO: 53717 - protein, 506 aa, Homo sapiens
MPSKTKYNLVDDGHDLRIPLHNEDAFQHGICFEAKYVGSLDVPRPNSRVEIVAAMRRIRYEFKAKNIKKKKVSIMVSVDGVKVILKKKKKLLLLQKKEWTWDESKMLVMQDPIYRIFYVSHDSQDLKIFSYIARDGASNIFRCNVFKSKKKSQAMRIVRTVGQAFEVCHKLSLQHTQQNADGQEDGESERNSNSSGDPGRQLTGAERASTATAEETDIDAVEVPLPGNDVLEFSRGVTDLDAVGKEGGSHTGSKVSHPQEPMLTASPRMLLPSSSSKPPGLGTETPLSTHHQMQLLQQLLQQQQQQTQVAVAQVHLLKDQLAAEAAARLEAQARVHQLLLQNKDMLQHISLLVKQVQELELKLSGQNAMGSQDSLLEITFRSGALPVLCDPTTPKPEDLHSPPLGAGLADFAHPAGSPLGRRDCLVKLECFRFLPPEDTPPPAQGEALLGGLELIKFRESGIASEYESNTDESEERDSWSQEELPRLLNVLQRQELGDGLDDEIAV

SEQ ID NO: 53718 - protein, 500 aa, Homo sapiens
MKFLAVLLAAGMLAFLGAVICIIASVPLAASPARALPGGADNASVASGAAASPGPQRSLSALHGAGGSAGPPALPGAPAASAHPLPPGPLFSRFLCTPLAAACPSGAQQGDAAGAAPGEREELLLLQSTAEQLRQTALQQEARIRADQDTIRELTGKLGRCESGLPRGLQGAGPRRDTMADGPWDSPALILELEDAVRALRDRIDRLEQELPARVNLSAAPAPVSAVPTGLHSKMDQLEGQLLAQVLALEKERVALSHSSRRQRQEVEKELDVLQGRVAELEHGSSAYSPPDAFKISIPIRNNYMYARVRKALPELYAFTACMWLRSRSSGTGQGTPFSYSVPGQANEIVLLEAGHEPMELLINDKVAQLPLSLKDNGWHHICIAWTTRDGLWSAYQDGELQGSGENLAAWHPIKPHGILILGQEQDTLGGRFDATQAFVGDIAQFNLWDHALTPAQVLGIANCTAPLLGNVLPWEDKLVEAFGGATKAAFDVCKGRAKA

SEQ ID NO: 53719 - protein, 499 aa, Homo sapiens
MKFLAVLLAAGMLAFLGAVICIIASVPLAASPARALPGGADNASVASGAAASPGPQRSLSALHGAGGSAGPPALPGAPAASAHPLPPGPLFSRFLCTPLAAACPSGAQQGDAAGAAPGEREELLLLQSTAEQLRQTALQQEARIRADQDTIRELTGKLGRCESGLPRGLQGAGPRRDTMADGPWDSPALILELEDAVRALRDRIDRLEELPARVNLSAAPAPVSAVPTGLHSKMDQLEGQLLAQVLALEKERVALSHSSRRQRQEVEKELDVLQGRVAELEHGSSAYSPPDAFKISIPIRNNYMYARVRKALPELYAFTACMWLRSRSSGTGQGTPFSYSVPGQANEIVLLEAGHEPMELLINDKVAQLPLSLKDNGWHHICIAWTTRDGLWSAYQDGELQGSGENLAAWHPIKPHGILILGQEQDTLGGRFDATQAFVGDIAQFNLWDHALTPAQVLGIANCTAPLLGNVLPWEDKLVEAFGGATKAAFDVCKGRAKA

SEQ ID NO: 53720 - protein, 381 aa, Homo sapiens
MGPIGAEADENQTVEEMKVEQYGPQTTPRGELVPDPEPELIDSTKLIEVQVVLILAYCSIILLGVIGNSLVIHVVIKFKSMRTVTNFFIANLAVADLLVNTLCLPFTLTYTLMGEWKMGPVLCHLVPYAQGLAVQVSTITLTVIALDRHRCIVYHLESKISKRISFLIIGLAWGISALLASPLAIFREYSLIEIIPDFEIVACTEKWPGEEKSIYGTVYSLSSLLILYVLPLGIISFSYTRIWSKLKNHVSPGAANDHYHQRRQKTTKMLVCVVVVFAVSWLPLHAFQLAVDIDSQVLDLKEYKLIFTVFHIIAMCSTFANPLLYGWMNSNYRKAFLSAFRCEQRLDAIHSEVSVTFKAKKNLEVRKNSGPNDSFTEATNV

SEQ ID NO: 53721 - protein, 87 aa, Homo sapiens
MEFCRSLESDAEDHKPLKKGSRTPSDRTVKKEDSDDSLVDYGEGVNGQFNEDGSFIGQYSGKKEKEPAEGNESSEAPSPVNAMNSFV

SEQ ID NO: 53722 - protein, 553 aa, Homo sapiens
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKDFSWFGFGKVKSRQGVGPASVISNDDDSASPLHHISNGSNTPSSSEGGPDAVIIGMTKIPVIENPQYFGITNSQLKPDTWPRGSPKTA

SEQ ID NO: 53723 - protein, 537 aa, Homo sapiens
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKGPASVISNDDDSASPLHHISNGSNTPSSSEGGPDAVIIGMTKIPVIENPQYFGITNSQLKPDTWPRGSPKTA

SEQ ID NO: 53724 - protein, 410 aa, Homo sapiens
METSSPRPPRPSSNPGLSLDARLGVDTRLWAKVLFTALYALIWALGAAGNALSVHVVLKARAGRAGRLRHHVLSLALAGLLLLLVGVPVELYSFVWFHYPWVFGDLGCRGYYFVHELCAYATVLSVAGLSAERCLAVCQPLRARSLLTPRRTRWLVALSWAASLGLALPMAVIMGQKHELETADGEPEPASRVCTVLVSRTALQVFIQVNVLVSFVLPLALTAFLNGVTVSHLLALCSQVPSTSTPGSSTPSRLELLSEEGLLSFIVWKKTFIQGGQVSLVRHKDVRRIRSLQRSVQVLRAIVVMYVICWLPYHARRLMYCYVPDDAWTDPLYNFYHYFYMVTNTLFYVSSAVTPLLYNAVSSSFRKLFLEAVSSLCGEHHPMKRLPPKPQSPTLMDTASGFGDPPETRT

SEQ ID NO: 53725 - protein, 255 aa, Homo sapiens
MLRPQRPGDLQLGASLYELVGYRQPPSSSSSSTSSTSSTSSSSTTAPLLPKAAREKPEAPAEPPGPGPGSGAHPGGSARPDAKEEQQQQLRRKINSRERKRMQDLNLAMDALREVILPYSAAHCQGAPGRKLSKIATLLLARNYILLLGSSLQELRRALGEGAGPAAPRLLLAGLPLLAAAPGSVLLAPGAVGPPDALRPAKYLSLALDEPPCGQFALPGGGAGGPGLCTCAVCKFPHLVPASLGLAAVQAQFSK

SEQ ID NO: 53726 - protein, 323 aa, Homo sapiens
MDSDASLVSSRPSSPEPDDLFLPARSKGSSGSAFTGGTVSSSTPSDCPPELSAELRGAMGSAGAHPGDKLGGSGFKSSSSSTSSSTSSAAASSTKKDKKQMTEPELQQLRLKINSRERKRMHDLNIAMDGLREVMPYAHGPSVRKLSKIATLLLARNYILMLTNSLEEMKRLVSEIYGGHHAGFHPSACGGLAHSAPLPAATAHPAAAAHAAHHPAVHHPILPPAAAAAAAAAAAAAVSSASLPGSGLPSVGSIRPPHGLLKSPSAAAAAPLGGGGGGSGASGGFQHWGGMPCPCSMCQVPPPHHHVSAMGAGSLPRLTSDAK

SEQ ID NO: 53727 - protein, 380 aa, Homo sapiens
MDSPIQIFRGEPGPTCAPSACLPPNSSAWFPGWAEPDSNGSAGSEDAQLEPAHISPAIPVIITAVYSVVFVVGLVGNSLVMFVIIRYTKMKTATNIYIFNLALADALVTTTMPFQSTVYLMNSWPFGDVLCKIVISIDYYNMFTSIFTLTMMSVDRYIAVCHPVKALDFRTPLKAKIINICIWLLSSSVGISAIVLGGTKVREDVDVIECSLQFPDDDYSWWDLFMKICVFIFAFVIPVLIIIVCYTLMILRLKSVRLLSGSREKDRNLRRITRLVLVVVAVFVVCWTPIHIFILVEALGSTSHSTAALSSYYFCIALGYTNSSLNPILYAFLDENFKRCFRDFCFPLKMRMERQSTSRVRNTVQDPAYLRDIDGMNKPV

SEQ ID NO: 53728 - protein, 312 aa, Homo sapiens
MEKWNHTSNDFILLGLLPPNQTGIFLLCLIILIFFLASVGNSAMIHLIHVDPRLHTPMYFLLSQLSLMDLMYISTTVPKMAYNFLSGQKGISFLGCGVQSFFFLTMACSEGLLLTSMAYDRYLAICHSLYYPIRMSKMMCVKMIGGSWTLGSINSLAHTVFALHIPYCRSRAIDHFFCDVPAMLLLACTDTWVYEYMVFVSTSLFLLFPFIGITSSCGRVLFAVYHMHSKEGRKKAFTTISTHLTVVIFYYAPFVYTYLRPRNLRSPAEDKILAVFYTILTPMLNPIIYSLRNKEVLGAMRRVFGIFSFLKE

SEQ ID NO: 53729 - protein, 319 aa, Homo sapiens
MEPGNDTQISEFLLLGFSQEPGLQPFLFGLFLSMYLVTVLGNLLIILATISDSHLHTPMYFFLSNLSFADICVTSTTIPKMLMNIQTQNKVITYIACLMQMYFFILFAGFENFLLSVMAYDRFVAICHPLHYMVIMNPHLCGLLVLASWTMSALYSLLQILMVVRLSFCTALEIPHFFCELNQVIQLACSDSFLNHMVIYFTVALLGGGPLTGILYSYSKIISSIHAISSAQGKYKAFSTCASHLSVVSLFYGAILGVYLSSAATRNSHSSATASVMYTVVTPMLNPFIYSLRNKDIKRALGIHLLWGTMKGQFFKKCP

SEQ ID NO: 53730 - protein, 1230 aa, Homo sapiens
MIKTEKSYPERRLRGVLEELSCGCCRFLSLADKDQGHSSRTRLDRERLKSCMRELENMGQQARMLRAQVKRHTVRDKLRLCQNFLQKLRFLADEPQHSIPDIFIWMMSNNKRVAYARVPSKDLLFSIVEEETGKDCAKVKTLFLKLPGKRGFGSAGWTVQAKVELYLWLGLSKQRKEFLCGLPCGFQEVKAAQGLGLHAFPPVSLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDLLAAFELLQIGPAGKADLPPINGPVDVDRGPIMPVPMGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTGEVVVTMEPEVPIKKLETMVKLDATSEAVVKVDVAEEEKEKKKKKKGTAEEPEEEEPDESMLDWWSKYFASIDTMKEQLRQQEPSGIDLEEKEEVDNTEGLKGSMKGKEKARAAKEEKKKKTQSSGSGQGSEAPEKKKPKIDELKVYPKELESEFDNFEDWLHTFNLLRGKTGDDEDGSTEEERIVGRFKGSLCVYKVPLPEDVSREAGYDSTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTSFIWFLNPLKSARYFLWHTYRWLLLKLLLLLLLLLLLALFLYSVPGYLVKKILGA

SEQ ID NO: 53731 - protein, 1997 aa, Homo sapiens
MALLIHLKTVSELRGRGDRIAKVTFRGQSFYSRVLENCEDVADFDETFRWPVASSIDRNEMLEIQVFNYSKVFSNKLIGTFRMVLQKVVEESHVEVTDTLIDDNNAIIKTSLCVEVRYQATDGTVGSWDDGDFLGDESLQEEEKDSQETDGLLPGSRPSSRPPGEKSFRRAGRSVFSAMKLGKNRSHKEEPQRPDEPAVLEMEDLDHLAIRLGDGLDPDSVSLASVTALTTNVSNKRSKPDIKMEPSAGRPMDYQVSITVIEARQLVGLNMDPVVCVEVGDDKKYTSMKESTNCPYYNEYFVFDFHVSPDVMFDKIIKISVIHSKNLLRSGTLVGSFKMDVGTVYSQPEHQFHHKWAILSDPDDISSGLKGYVKCDVAVVGKGDNIKTPHKANETDEDDIEGNLLLPEGVPPERQWARFYVKIYRAEGLPRMNTSLMANVKKAFIGENKDLVDPYVQVFFAGQKGKTSVQKSSYEPLWNEQVVFTDLFPPLCKRMKVQIRDSDKVNDVAIGTHFIDLRKISNDGDKGFLPTLGPAWVNMYGSTRNYTLLDEHQDLNEGLGEGVSFRARLLLGLAVEIVDTSNPELTSSTEVQVEQATPISESCAGKMEEFFLFGAFLEASMIDRRNGDKPITFEVTIGNYGNEVDGLSRPQRPRPRKEPGDEEEVDLIQNASDDEAGDAGDLASVSSTPPMRPQVTDRNYFHLPYLERKPCIYIKSWWPDQRRRLYNANIMDHIADKLEEGLNDIQEMIKTEKSYPERRLRGVLEELSCGCCRFLSLADKDQGHSSRTRLDRERLKSCMRELENMGQQARMLRAQVKRHTVRDKLRLCQNFLQKLRFLADEPQHSIPDIFIWMMSNNKRVAYARVPSKDLLFSIVEEETGKDCAKVKTLFLKLPGKRGFGSAGWTVQAKVELYLWLGLSKQRKEFLCGLPCGFQEVKAAQGLGLHAFPPVSLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDLLAAFELLQIGPAGKADLPPINGPVDVDRGPIMPVPMGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTVRLLRRCRVLCNGGSSSHSTGEVVVTMEPEVPIKKLETMVKLDATSEAVVKVDVAEEEKEKKKKKKGTAEEPEEEEPDESMLDWWSKYFASIDTMKEQLRQQEPSGIDLEEKEEVDNTEGLKGSMKGKEKARAAKEEKKKKTQSSGSGQGSEAPEKKKPKIDELKVYPKELESEFDNFEDWLHTFNLLRGKTGDDEDGSTEEERIVGRFKGSLCVYKVPLPEDVSREAGYDSTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTSFIWFLNPLKSARYFLWHTYRWLLLKLLLLLLLLLLLALFLYSVPGYLVKKILGA

SEQ ID NO: 53732 - protein, 1307 aa, Homo sapiens
MMTDTQDGPSESSQIMRSLTPLINREEAFGEAGEAGLWPSITHTPDSQEEGLNDIQEMIKTEKSYPERRLRGVLEELSCGCCRFLSLADKDQGHSSRTRLDRERLKSCMRELENMGQQARMLRAQVKRHTVRDKLRLCQNFLQKLRFLADEPQHSIPDIFIWMMSNNKRVAYARVPSKDLLFSIVEEETGKDCAKVKTLFLKLPGKRGFGSAGWTVQAKVELYLWLGLSKQRKEFLCGLPCGFQEVKAAQGLGLHAFPPVSLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDLLAAFELLQIGPAGKADLPPINGPVDVDRGPIMPVPMGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTVRLLRRCRVLCNGGSSSHSTGEVVVTMEPEVPIKKLETMVKLDATSEAVVKVDVAEEEKEKKKKKKGTAEEPEEEEPDESMLDWWSKYFASIDTMKEQLRQQEPSGIDLEEKEEVDNTEGLKGSMKGKEKARAAKEEKKKKTQSSGSGQGSEAPEKKKPKIDELKVYPKELESEFDNFEDWLHTFNLLRGKTGDDEDGSTEEERIVGRFKGSLCVYKVPLPEDVSREAGYDSTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTSFIWFLNPLKSARYFLWHTYRWLLLKLLLLLLLLLLLALFLYSVPGYLVKKILGA

SEQ ID NO: 53733 - protein, 1230 aa, Homo sapiens
MIKTEKSYPERRLRGVLEELSCGCCRFLSLADKDQGHSSRTRLDRERLKSCMRELENMGQQARMLRAQVKRHTVRDKLRLCQNFLQKLRFLADEPQHSIPDIFIWMMSNNKRVAYARVPSKDLLFSIVEEETGKDCAKVKTLFLKLPGKRGFGSAGWTVQAKVELYLWLGLSKQRKEFLCGLPCGFQEVKAAQGLGLHAFPPVSLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDLLAAFELLQIGPAGKADLPPINGPVDVDRGPIMPVPMGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTGEVVVTMEPEVPIKKLETMVKLDATSEAVVKVDVAEEEKEKKKKKKGTAEEPEEEEPDESMLDWWSKYFASIDTMKEQLRQQEPSGIDLEEKEEVDNTEGLKGSMKGKEKARAAKEEKKKKTQSSGSGQGSEAPEKKKPKIDELKVYPKELESEFDNFEDWLHTFNLLRGKTGDDEDGSTEEERIVGRFKGSLCVYKVPLPEDVSREAGYDSTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTAFVWFLNPLKSIKYLICTRYKWLIIKIVLALLGLLMLGLFLYSLPGYMVKKLLGA

SEQ ID NO: 53734 - protein, 444 aa, Homo sapiens
MSSSYDEASLAPEETTDSFWEVGNYKRTVKRIDDGHRLCNDLMNCVQERAKIEKAYGQQLTDWAKRWRQLIEKGPQYGSLERAWGAIMTEADKVSELHQEVKNNLLNEDLEKVKNWQKDAYHKQIMGGFKETKEAEDGFRKAQKPWAKKMKELEAAKKAYHLACKEEKLAMTREMNSKTEQSVTPEQQKKLQDKVDKCKQDVQKTQEKYEKVLEDVGKTTPQYMENMEQVFEQCQQFEEKRLVFLKEVLLDIKRHLNLAENSSYIHVYRELEQAIRGADAQEDLRWFRSTSGPGMPMNWPQFEEWNPDLPHTTTKKEKQPKKAEGVALTNATGAVESTSQAGDRGSVSSYDRGQPYATEWSDDESGNPFGGSETNGGANPFEDDSKGVRVRALYDYDGQEQDELSFKAGDELTKLGEEDEQGWCRGRLDSGQLGLYPANYVEAI

SEQ ID NO: 53735 - protein, 544 aa, Homo sapiens
MSDGLDNEEKPPAPPLRMNSNNRDSSALNHSSKPLPMAPEEKNKKARLRSIFPGGGDKTNKKKEKERPEISLPSDFEHTIHVGFDAVTGEFTGIPEQWARLLQTSNITKLEQKKNPQAVLDVLKFYDSKETVNNQKYMSFTSGDKSAHGYIAAHPSSTKTASEPPLAPPVSEEEDEEEEEEEDENEPPPVIAPRPEHTKSIYTRSVVESIASPAVPNKEVTPPSAENANSSTLYRNTDRQRKKSKMTDEEILEKLRSIVSVGDPKKKYTRFEKIGQGASGTVYTALDIATGQEVAIKQMNLQQQPKKELIINEILVMRENKNPNIVNYLDSYLVGDELWVVMEYLAGGSLTDVVTETCMDEGQIAAVCRECLQALDFLHSNQVIHRDIKSDNILLGMDGSVKLTDFGFCAQITPEQSKRSTMVGTPYWMAPEVVTRKAYGPKVDIWSLGIMAIEMVEGEPPYLNENPLRALYLIATNGTPELQNPERLSAVFRDFLNRCLEMDVDRRGSAKELLQHPFLKLAKPLSSLTPLIIAAKEAIKNSSR

SEQ ID NO: 53736 - protein, 316 aa, Homo sapiens
MPLLPAALTSSMLYFQMVIMAGTVMLAYYFEYTDTFTVNVQGFFCHDSAYRKPYPGPEDSSAVPPVLLYSLAAGVPVLVIIVGETAVFCLQLATRDFENQEKTILTGDCCYINPLVRRTVRFLGIYTFGLFATDIFVNAGQVVTGNLAPHFLALCKPNYTALGCQQYTQFISGEEACTGNPDLIMRARKTFPSKEAALSVYAAMYLTMYITNTIKAKGTRLAKPVLCLGLMCLAFLTGLNRVAEYRNHWSDVIAGFLVGISIAVFLVVCVVNNFKGRQAENEHIHMDNLAQMPMISIPRVESPLEKNHITAFAEVT

SEQ ID NO: 53737 - protein, 321 aa, Homo sapiens
MPLLPAALTSSMLYFQMVIMAGTVMLAYYFEYTDTFTVNVQGFFCHDSAYRKPYPGPEDSSAVPPVLLYSLAAGVPVLVIIVGETAVFCLQLATRDFENQEKTILTGDCCYINPLVRRTVRFLGIYTFGLFATDIFVNAGQVVTGNLAPHFLALCKPNYTALGCQQYTQFISGEEACTGNPDLIMRARKTFPSKEAALSVYAAMYLTMYITNTIKAKGTRLAKPVLCLGLMCLAFLTGLNRVAEYRNHWSDVIAGFLVGISIAVFLVVCVVNNFKGRQAENEHIHMDNLAQMPMISIPRVESPLEKVTSVQNHITAFAEVT

SEQ ID NO: 53738 - protein, 351 aa, Homo sapiens
MSPRMRHICYFLDYGALSLYSLGCAFPYAAYSMPASWLHGHLHQFFVPAAALNSFLCTGLSCYSRFLELESPGLSKVLRTGAFAYPFLFDNLPLFYRLGLCWGRGHGCGQEALSTSHGYHLFCALLTGFLFASHLPERLAPGRFDYIGEGTPGPAREEAGADAFPEHRMNWATATSYSTSVQCWAPTSSWRQCWLIWDHAEPGWPHRNLPWAWQAQWPHWSWLQLGTYSLLLLSQPPCFGPPVHALCCRVAHWRGVPRPNNSEAPSLTLSWRGQRPGPSADEEPRFGPNQVGTHLSLEPTGAEERGHRREGREEEGCLGGLAECERDREGALDGSGRSAEGLRGEMHACPG

SEQ ID NO: 53739 - protein, 344 aa, Homo sapiens
MLSLKLPQLLQVHQVPRVFWEDGIMSGYRRPTSSALDCVLSSFQMTNETVNIWTHFLPTWYFLWRLLALAGGPGFRAEPYHWPLLVFLLPACLYPFASCCAHTFSSMSPRMRHICYFLDYGALSLYSLGCAFPYAAYSMPASWLHGHLHQFFVPAAALNSFLCTGLSCYSRFLELESPGLSKVLRTGAFAYPFLFDNLPLFYRLGLCWGRGHGCGQEALSTSHGYHLFCALLTGFLFASHLPERLAPGRFDYIGHSHQLFHICAVLGTHFQLEAVLADMGSRRAWLATQEPALGLAGTVATLVLAAAGNLLIIAAFTATLLRAPSTCPLLQGGPLEGGTQAKQQ

SEQ ID NO: 53740 - protein, 1070 aa, Homo sapiens
MSPVRRWGSPCLFPLQLFSLCWVLSVAQSKTVRYSTFEEDAPGTVIGTLAEDLHMKVSGDTSFRLMKQFNSSLLRVREGDGQLTVGDAGLDRERLCGQAPQCVLAFDVVSFSQEQFRLVHVEVEVRDVNDHAPRFPRAQIPVEVSEGAAVGTRIPLEVPVDEDVGANGLQTVRLAEPHSPFRVELQTRADGAQCADLVLLQELDRESQAAYSLELVAQDGGRPPRSATAALSVRVLDANDHSPAFPQGAVAEVELAEDAPVGSLLLDLDAADPDEGPNGDVVFAFGARTPPEARRLFRLDPRSGRLTLAGPVDYERQDTYELDVRAQDRGPGPRAATCKVIVRIRDVNDNAPDIAITPLAAPGAPATSPFAAAAAAAALGGADASSPAGAGTPEAGATSLVPEGAARESLVALVSTSDRDSGANGQVRCALYGHEHFRLQPAYAGSYLVVTAASLDRERIAEYNLTLVAEDRGAPPLRTVRPYTVRVGDENDNAPLFTRPVYEVSVRENNPPGAYLATVAARDRDLGRNGQVTYRLLEAEVGRAGGAVSTYVSVDPATGAIYALRSFDYETLRQLDVRIQASDGGSPQLSSSALVQVRVLDQNDHAPVLVHPAPANGSLEVAVPGRTAKDTVVARVQARDADEGANGELAFELQQQEPREAFAIGRRTGEILLTGDLSQEPPGRVFRALLVISDGGRPPLTTTATVSFVVTAGGGRGPAAPASAGSPERSRPPGSRLGVSGSVLQWDTPLIVIIVLAGSCTLLLAAIIAIATTCNRRKKEVRKGGALREERPGAAGGGASAPGSPEEAARGAGPRPNMFDVLTFPGTGKAPFGSPAADAPPPAVAAAEVPGSEGGSATGESACHFEGQQRLRGAHAEPYGASPGFGKEPAPPVAVWKGHSFNTISGREAEKFSGKDSGKGDSDFNDSDSDISGDALKKDLINHMQSGLWACTAECKILGHSDRCWSPSCSGPNAHPSPHPPAQMSTFCKSTSLPRDPLRRDNYYQAQLPKTVGLQSVYEKVLHRDYDRTVTLLSPPRPGRLPDLQEIGVPLYQSPPGRYLSPKKGANENV

SEQ ID NO: 53741 - protein, 973 aa, Homo sapiens
MSPVRRWGSPCLFPLQLFSLCWVLSVAQSKTVRYSTFEEDAPGTVIGTLAEDLHMKVSGDTSFRLMKQFNSSLLRVREGDGQLTVGDAGLDRERLCGQAPQCVLAFDVVSFSQEQFRLVHVEVEVRDVNDHAPRFPRAQIPVEVSEGAAVGTRIPLEVPVDEDVGANGLQTVRLAEPHSPFRVELQTRADGAQCADLVLLQELDRESQAAYSLELVAQDGGRPPRSATAALSVRVLDANDHSPAFPQGAVAEVELAEDAPVGSLLLDLDAADPDEGPNGDVVFAFGARTPPEARRLFRLDPRSGRLTLAGPVDYERQDTYELDVRAQDRGPGPRAATCKVIVRIRDVNDNAPDIAITPLAAPGAPATSPFAAAAAAAALGGADASSPAGAGTPEAGATSLVPEGAARESLVALVSTSDRDSGANGQVRCALYGHEHFRLQPAYAGSYLVVTAASLDRERIAEYNLTLVAEDRGAPPLRTVRPYTVRVGDENDNAPLFTRPVYEVSVRENNPPGAYLATVAARDRDLGRNGQVTYRLLEAEVGRAGGAVSTYVSVDPATGAIYALRSFDYETLRQLDVRIQASDGGSPQLSSSALVQVRVLDQNDHAPVLVHPAPANGSLEVAVPGRTAKDTVVARVQARDADEGANGELAFELQQQEPREAFAIGRRTGEILLTGDLSQEPPGRVFRALLVISDGGRPPLTTTATVSFVVTAGGGRGPAAPASAGSPERSRPPGSRLGVSGSVLQWDTPLIVIIVLAGSCTLLLAAIIAIATTCNRRKKEPYGASPGFGKEPAPPVAVWKGHSFNTISGREAEKFSGKDSGKGDSDFNDSDSDISGDALKKDLINHMQSGLWACTAECKILGHSDRCWSPSCSGPNAHPSPHPPAQMSTFCKSTSLPRDPLRRDNYYQAQLPKTVGLQSVYEKVLHRDYDRTVTLLSPPRPGRLPDLQEIGVPLYQSPPGRYLSPKKGANENV

SEQ ID NO: 53742 - protein, 254 aa, Homo sapiens [sequence omitted]

SEQ ID NO: 53743 - protein, 769 aa, Homo sapiens
MGCNMCVVQKPEEQYKVMLQVNGKELSKLSQEQTLQALRSSKEPLVIQVLRRSPRLRGDSSCHDLQLVDSGTQTDITFEHIMALGKLRPPTPPMVILEPPPISHEYYDPAEFMEGGPQEADRLDELEYEEVELYKSSHRDKLGLMVCYRTDDEEDLGIYVGEVNPNSIAAKDGRIREGDRIIQINGVDVQNREEAVAILSQEENTNISLLVARPESQLAKRWKDSDRDDFLDDFGSENEGELRARKLKSPPAQQPGNEEEKGAPDAGPGLSNSQELDSGVGRTDESTRNEESSEHDLLGDEPPSSTNTPGSLRKFGLQGDALQSRDFHFSMDSLLAEGAGLGGGDVPGLTDEEYERYRELLEIKCHLENGNQLGLLFPRASGGNSALDVNRNESLGHEMAMLEEELRHLEFKCRNILRAQKMQQLRERCMKAWLLEEESLYDLAASEPKKHELSDISELPEKSDKDSTSAYNTGESCRSTPLLVEPLPESPLRRAMAGNSNLNRTPPGPAVATPAKAAPPPGSPAKFRSLSRDPEAGRRQHAEERGRRNPKTGLTLERVGPESSPYLSRRHRGQGQEGEHYHSCVQLAPTRGLEELGHGPLSLAGGPRVGGVAAAATEAPRMEWKVKVRSDGTRYVAKRPVRDRLLKARALKIREERSGMTTDDDAVSEMKMGRYWSKEERKQHLIRAREQRKRREFMMQSRLECLREQQNGDSKPELNIIALSHRKTMKKRNKKILDNWITIQEMLAHGARSADGKRVYNPLLSVTTV

SEQ ID NO: 53744 - protein, 622 aa, Homo sapiens
MAENTEGDLNSNLLHAPYHTGDPQLDTAIGQWLRWDKNPKTKEQIENLLRNGMNKELRDRLCCRMTFGTAGLRSAMGAGFCYINDLTVIQSTQGMYKYLERCFSDFKQRGFVVGYDTRGQVTSSCSSQRLAKLTAAVLLAKDVPVYLFSRYVPTPFVPYAVQKLKAVAGVMITASHNRKEDNGYKVYWETGAQITSPHDKEILKCIEECVEPWNGSWNDNLVDTSPLKRDPLQDICRRYMEDLKKICFYRELNSKTTLKFVHTSFHGVGHDYVQLAFKVFGFKPPIPVPEQKDPDPDFSTVKCPNPEEGESVLELSLRLAEKENARVVLATDPDADRLAAAELQENGCWKVFTGNELAALFGWWMFDCWKKNKSRNADVKNVYMLATTVSSKILKAIALKEGFHFEETLPGFKWIGSRIIDLLENGKEVLFAFEESIGFLCGTSVLDKDGVSAAVVVAEMASYLETMNITLKQQLVKVYEKYGYHISKTSYFLCYEPPTIKSIFERLRNFDSPKEYPKFCGTFAILHVRDVTTGYDSSQPNKKSVLPVSKNSQMITFTFQNGCVATLRTSGTEPKIKYYAEMCASPDQSDTALLEEELKKLIDALIENFLQPSKNGLIWRSV

SEQ ID NO: 53745 - protein, 364 aa, Homo sapiens
MALALLEDWCRIMSVDEQKSLMVTGIPADFEEAEIQEVLQETLKSLGRYRLLGKIFRKQENANAVLLELLEDTDVSAIPSEVQGKGGVWKVIFKTPNQDTEFLERLNLFLEKEGQTVSGMFRALGQEGVSPATVPCISPELLAHLLGQAMAHAPQPLLPMRYRKLRVFSGSAVPAPEEESFEVWLEQATEIVKEWPVTEAEKKRWLAESLRGPALDLMHIVQADNPSISVEECLEAFKQVFGSLESRRTAQVRYLKTYQEEGEKVSAYVLRLETLLRRAVEKRAIPRRIADQVRLEQVMAGATLNQMLWCRLRELKDQGPPPSFLELMKVIREEEEEEASFENESIEEPEERDGYGRWNHEGDD

SEQ ID NO: 53746 - protein, 455 aa, Homo sapiens
MPLTLLQDWCRGEHLNTRRCMLILGIPEDCGEDEFEETLQEACRHLGRYRVIGRMFRREENAQAILLELAQDIDYALLPREIPGKGGPWEVIVKPRNSDGEFLNRLNRFLEEERRTVSDMNRVLGSDTNCSAPRVTISPEFWTWAQTLGAAVQPLLEQMLYRELRVFSGNTISIPGALAFDAWLEHTTEMLQMWQVPEGEKRRRLMECLRGPALQVVSGLRASNASITVEECLAALQQVFGPVESHKIAQVKLCKAYQEAGEKVSSFVLRLEPLLQRAVENNVVSRRNVNQTRLKRVLSGATLPDKLRDKLKLMKQRRKPPGFLALVKLLREEEEWEATLGPDRESLEGLEVAPRPPARITGVGAVPLPASGNSFDARPSQGYRRRRGRGQHRRGGVARAGSRGSRKRKRHTFCYSCGEDGHIRVQCINPSNLLLAKETKEILEGGEREAQTNSR

SEQ ID NO: 53747 - protein, 443 aa, Homo sapiens
MATAASNHYSLLTSSASIVHAEPPGGMQQGAGGYREAQSLVQGDYGALQSNGHPLSHAHQWITALSHGGGGGGGGGGGGGGGGGGGGGDGSPWSTSPLGQPDIKPSVVVQQGGRGDELHGPGALQQQHQQQQQQQQQQQQQQQQQQQQQRPPHLVHHAANHHPGPGAWRSAAAAAHLPPSMGASNGGLLYSQPSFTVNGMLGAGGQPAGLHHHGLRDAHDEPHHADHHPHPHSHPHQQPPPPPPPQGPPGHPGAHHDPHSDEDTPTSDDLEQFAKQFKQRRIKLGFTQADVGLALGTLYGNVFSQTTICRFEALQLSFKNMCKLKPLLNKWLEEADSSSGSPTSIDKIAAQGRKRKKRTSIEVSVKGALESHFLKCPKPSAQEITSLADSLQLEKEVVRVWFCNRRQKEKRMTPPGGTLPGAEDVYGGSRDTPPHHGVQTPVQ

SEQ ID NO: 53748 - protein, 755 aa, Homo sapiens
MAGCIPEEKTYRRFLELFLGEFRGPCGGGEPEPEPEPEPEPEPESEPEPEPELVEAEAAEASVEEPGEEAATVAATEEGDQEQDPEPEEEAAVEGEEEEEGAATAAAAPGHSAVPPPPPQLPPLPPLPRPLSERITREEVEGESLDLCLQQLYKYNCPSFLAAALARATSDEVLQSDLSAHYIPKETDGTEGTVEIETVKLARSVFSKLHEICCSWVKDFPLRRRPQLYYETSIHAIKNMRRKMEDKHVCIPDFNMLFNLEDQEEQAYFAVFDGHGGVDAAIYASIHLHVNLVRQEMFPHDPAEALCRAFRVTDERFVQKAARESLRCGTTGVVTFIRGNMLHVAWVGDSQVMLVRKGQAVELMKPHKPDREDEKQRIEALGGCVVWFGAWRVNGSLSVSRAIGDAEHKPYICGDADSASTVLDGTEDYLILACDGFYDTVNPDEAVKVVSDHLKENNGDSSMVAHKLVASARDAGSSDNITVIVVFLRDMNKAVNVSEESDWTENSFQGGQEDGGDDKENHGECKRPWPQHQCSAPADLGYDGRVDSFTDRTSLSPGSQINVLEDPGYLDLTQIEASKPHSAQFLLPVEMFGPGAPKKANLINELMMEKKSVQSSLPEWSGAGEFPTAFNLGSTGEQIYRMQSLSPVCSGLENEQFKSPGNRVSRLSHLRHHYSKKWHRFRFNPKFYSFLSAQEPSHKIGTSLSSLTGSGKRNRIRSSLPWRQNSWKGYSENMRKLRKTHDIPCPDLPWSYKIE

SEQ ID NO: 53749 - protein, 746 aa, Homo sapiens
MISTKEKNKIPKDSMTLLPCFYFVELPIVASSIVSLYFLELTDLFKPAKVGFQCYDRTLSMPYVETNEELIPLLMLLSLAFAAPAASIMVAEGMLYCLQSRLWGRAGGPAGAEGSINAGGCNFNSFLRRTVRFVGVHVFGLCATALVTDVIQLATGYHTPFFLTVCKPNYTLLGTSCEVNPYITQDICSGHDIHAILSARKTFPSQHATLSAFAAVYVSVSPAPHCPSQALLLTRGEPSLTPTPMPQMYFNSVISDTTKLLKPILVFAFAIAAGVCGLTQITQYRSHPVDVYAGFLIGAGIAAYLACHAVGNFQAPPAEKPAAPAPAKDALRALTQRGHDSVYQQNKSVSTDELGPPGRLEGAPRPVAREKTSLGSLKRASVDVDLLAPRSPMAKENMVTFSHTLPRASAPSLDDPARRHMTIHVPLDASRSKQLISEWKQKSLEGRGLGLPDDASPGHLRAPAEPMAEEEEEEEDEEEEEEEEEEEDEGPAPPSLYPTVQARPGLGPRVILPPRAGPPPLVHIPEEGAQTGAGLSPKSGAGVRAKWLMMAEKSGAAVANPPRLLQVIAMSKAPGAPGPKAAETASSSSASSDSSQYRSPSDRDSASIVTIDAHAPHHPVVHLSAGGAPWEWKAAGGGAKAEADGGYELGDLARGFRGGAKPPGVSPGSSVSDVDQEEPRFGAVATVNLATGEGLPPLGAADGALGPGSRESTLRRHAGGLGLAEREAEAEAEGYFRKMQARRFPD

SEQ ID NO: 53750 - protein, 381 aa, Homo sapiens
MASPPACPSEEDESLKGCELYVQLHGIQQVLKDCIVHLCISKPERPMKFLREHFEKLEKEENRQILARQKSNSQSDSHDEEVSPTPPNPVVKARRRRGGVSAEVYTEEDAVSYVRKVIPKDYKTMTALAKAISKNVLFAHLDDNERSDIFDAMFPVTHIAGETVIQQGNEGDNFYVVDQGEVDVYVNGEWVTNISEGGSFGELALIYGTPRAATVKAKTDLKLWGIDRDSYRRILMGSTLRKRKMYEEFLSKVSILESLEKWERLTVADALEPVQFEDGEKIVVQGEPGDDFYIITEGTASVLQRRSPNEEYVEVGRLGPSDYFGEIALLLNRPRAATVVARGPLKCVKLDRPRFERVLGPCSEILKRNIQRYNSFISLTV

SEQ ID NO: 53751 - protein, 697 aa, Homo sapiens
MAGLGPGVGDSEGGPRPLFCRKGALRQKVVHEVKSHKFTARFFKQPTFCSHCTDFIWGIGKQGLQCQVCSFVVHRRCHEFVTFECPGAGKGPQTDDPRNKHKFRLHSYSSPTFCDHCGSLLYGLVHQGMKCSCCEMNVHRRCVRSVPSLCGVDHTERRGRLQLEIRAPTADEIHVTVGEARNLIPMDPNGLSDPYVKLKLIPDPRNLTKQKTRTVKATLNPVWNETFVFNLKPGDVERRLSVEVWDWDRTSRNDFMGAMSFGVSELLKAPVDGWYKLLNQEEGEYYNVPVADADNCSLLQKFEACNYPLELYERVRMGPSSSPIPSPSPSPTDPKRCFFGASPGRLHISDFSFLMVLGKGSFGKVMLAERRGSDELYAIKILKKDVIVQDDDVDCTLVEKRVLALGGRGPGGRPHFLTQLHSTFQTPDRLYFVMEYVTGGDLMYHIQQLGKFKEPHAAFYAAEIAIGLFFLHNQGIIYRDLKLDNVMLDAEGHIKITDFGMCKENVFPGTTTRTFCGTPDYIAPEIIAYQPYGKSVDWWSFGVLLYEMLAGQPPFDGEDEEELFQAIMEQTVTYPKSLSREAVAICKGFLTKHPGKRLGSGPDGEPTIRAHGFFRWIDWERLERLEIPPPFRPRPCGRSGENFDKFFTRAAPALTPPDRLVLASIDQADFQGFTYVNPDFVHPDARSPTSPVPVPVM

SEQ ID NO: 53752 - protein, 394 aa, Homo sapiens
MGMKHSSRCLLLRRKMAENAAESTEVNSPPSQPPQPVVPAKPVQCVHHVSTQPSCPGRGKMSKLLNPEEMTSRDYYFDSYAHFGIHEEMLKDEVRTLTYRNSMYHNKHVFKDKVVLDVGSGTGILSMFAAKAGAKKVFGIECSSISDYSEKIIKANHLDNIITIFKGKVEEVELPVEKVDIIISEWMGYCLFYESMLNTVIFARDKWLKPGGLMFPDRAALYVVAIEDRQYKDFKIHWWENVYGFDMTCIRDVAMKEPLVDIVDPKQVVTNACLIKEVDIYTVKTEELSFTSAFCLQIQRNDYVHALVTYFNIEFTKCHKKMGFSTAPDAPYTHWKQTVFYLEDYLTVRRGEEIYGTISMKPNAKNVRDLDFTVDLDFKGQLCETSVSNDYKMR

SEQ ID NO: 53753 - protein, 771 aa, Homo sapiens
MEEDKLLSAVPEEGDATRDPGPEPEEEPGVRNGMASEGLNSSLCSPGHERRGTPADTEEPTKDPDVAFHGLSLGLSLTNGLALGPDLNILEDSAESRPWRAGVLAEGDNASRSLYPDAEDPQLGLDGPGEPDVRDGFSATFEKILESELLRGTQYSSLDSLDGLSLTDESDSCVSFEAPLTPLIQQRARDSPEPGAGLGIGDMAFEGDMGAAGGDGELGSPLRRSISSSRSENVLSRLSLMAMPNGFHEDGPQGPGGDEDDDEEDTDKLLNSASDPSLKDGLSDSDSELSSSEGLEPGSADPLANGCQGVSEAAHRLARRLYHLEGFQRCDVARQLGKNNEFSRLVAGEYLSFFDFSGLTLDGALRTFLKAFPLMGETQERERVLTHFSRRYCQCNPDDSTSEDGIHTLTCALMLLNTDLHGHNIGKKMSCQQFIANLDQLNDGQDFAKDLLKTLYNSIKNEKLEWAIDEDELRKSLSELVDDKFGTGTKKVTRILDGGNPFLDVPQALSATTYKHGVLTRKTHADMDGKRTPRGRRGWKKFYAVLKGTILYLQKDEYRPDKALSEGDLKNAIRVHHALATRASDYSKKSNVLKLKTADWRVFLFQAPSKEEMLSWILRINLVAAIFSAPAFPAAVSSMKKFCRPLLPSCTTRLCQEEQLRSHENKLRQLTAELAEHRCHPVERGIKSKEAEEYRLKEHYLTFEKSRYETYIHLLAMKIKVGSDDLERIEARLATLEGDDPSLRKTHSSPALSQGHVTGSKTTKDATGPDT

SEQ ID NO: 53754 - protein, 657 aa, Homo sapiens
MRRAVCFPALCLLLNLHAAGCFSGNNDHFLAINQKKSGKPVFIYKHSQDIEKSLDIAPQKIYRHSYHSSSEAQVSKRHQIVNSAFPRPAYDPSLNLLAMDGQDLEVENLPIPAANVIVVTLQMDVNKLNITLLRIFRQGVAAALGLLPQQVHINRLIGKKNSIELFVSPINRKTGISDALPSEEVLRSLNINVLHQSLSQFGITEVSPEKNVLQGQHEADKIWSKEGFYAVVIFLSIFVIIVTCLMILYRLKERFQLSLRQDKEKNQEIHLSPITLQPALSEAKTVHSMVQPEQAPKVLNVVVDPQGRGAPEIRATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKCVLYWPEKRGIYGKVEVLVISVNECDNYTIRNLVLKQGSHTQHVKHYWYTSWPDHKTPDSAQPLLQLMLDVEEDRLASQGRGPVVVHCSAGIGRTGCFIATSIGCQQLKEEGVVDALSIVCQLRMDRGGMVQTSEQYEFVHHALCLYESRLSAETVQ

SEQ ID NO: 53755 - protein, 412 aa, Homo sapiens
MILYRLKERFQLSLRQDKEKNQEIHLSPITLQPALSEAKTVHSMVQPEQAPKVLNVVVDPQGRGAPEIRATTATSVCPSPFKMKPIGLQERRGSNVSLTLDMSSLGNIEPFVSIPTPREKVAMEYLQSASRILTRSQLRDVVASSHLLQSEFMEIPMNFVDPKEIDIPRHGTKNRYKTILPNPLSRVCLRPKNVTDSLSTYINANYIRGYSGKEKAFIATQGPMINTVDDFWQMVWQEDSPVIVMITKLKEKNEKCVLYWPEKRGIYGKVEVLVISVNECDNYTIRNLVLKQGSHTQHVKHYWYTSWPDHKTPDSAQPLLQLMLDVEEDRLASQGRGPVVVHCSAGIGRTGCFIATSIGCQQLKEEGVVDALSIVCQLRMDRGGMVQTSEQYEFVHHALCLYESRLSAETVQ

SEQ ID NO: 53756 - protein, 257 aa, Homo sapiens
MSSAPNGRKKRPSRSTRSSIFQISKPPLQSGDWERRGSGSESAHKTQRALDDCKMLVQEFNTQVALYRELVISIGDVSVSCPSLRAEMHKTRTKGCEMARQAHQKLAAISGPEDGEIHPEICRLYIQLQCCLEMYTTEMLKSICLLGSLQFHRKGKEPGGGTKSLDCKIEESAETPALEDSSSSPVDSQQHSWQVSTDIENTERDMREMKNLLSKLRETMPLPLKNQDDSSLLNLTPYPLVRRRKRRFFGLCCLISS

SEQ ID NO: 53757 - protein, 220 aa, Homo sapiens
MASATDSRYGQKESSDQNFDYMFKILIIGNSSVGKTSFLFRYADDSFTPAFVSTVGIDFKVKTIYRNDKRIKLQIWDTAGQERYRTITTAYYRGAMGFILMYDITNEESFNAVQDWSTQIKTYSWDNAQVLLVGNKCDMEDERVVSSERGRQLADHLGFEFFEASAKDNINVKQTFERLVDVICEKMSESLDTADPAVTGAKQGPQLSDQQVPPHQDCAC

SEQ ID NO: 53758 - protein, 580 aa, Homo sapiens
MGSSRLRVFDPHLERKDSAAALSDRELPLPTFDVPYFKYIDEEDEDDEWSSRSQSSTEDDSVDSLLSDRYVVVSGTPEKILEHLLNDLHLEEVQDKETETLLDDFLLTYTVFMTTDDLCQALLRHYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSYVSVKAKVSSIAQEILKVVAEKIQYAEEDLALVAITFSGEKHELQPNDLVISKSLEASGRIYVYRKDLADTLNPFAENEESQQRSMRILGMNTWDLALELMNFDWSLFNSIHEQELIYFTFSRQGSGEHTANLSLLLQRCNEVQLWVATEILLCSQLGKRVQLVKKFIKIAAHCKAQRNLNSFFAIVMGLNTASVSRLSQTWEKIPGKFKKLFSELESLTDPSLNHKAYRDAFKKMKPPKIPFMPLLLKDVTFIHEGNKTFLDNLVNFEKLHMIADTVRTLRHCRTNQFGDLSPKEHQELKSYVNHLYVIDSQQALFELSHRIEPRV

SEQ ID NO: 53759 - protein, 444 aa, Homo sapiens
MGSSRLRVFDPHLERKDSAAALSDRELPLPTFDVPYFKYIDEEDEDDEWSSRSQSSTEDDSVDSLLSDRYVVVSGTPEKILEHLLNDLHLEEVQDKETETLLDDFLLTYTVFMTTDDLCQALLRHYSAKKYQGKEENSDVPRRKRKVLHLVSQWIALYKDWLPEDEHSKMFLKTIYRNVLDDVYEYPILEKELKEFQKILGMHRRHTVDEYSPQKKNKALFHQFSLKENWLQHRGTVTETEEIFCHVYITEHSYVSVKAKVSSIAQEILLCSQLGKRVQLVKKFIKIAAHCKAQRNLNSFFAIVMGLNTASVSRLSQTWEKIPGKFKKLFSELESLTDPSLNHKAYRDAFKKMKPPKIPFMPLLLKDVTFIHEGNKTFLDNLVNFEKLHMIADTVRTLRHCRTNQFGDLSPKEHQELKSYVNHLYVIDSQQALFELSHRIEPRV

SEQ ID NO: 53760 - protein, 580 aa, Homo sapiens; identical to SEQ ID NO: 53758

SEQ ID NO: 53761 - protein, 444 aa, Homo sapiens; identical to SEQ ID NO: 53759

SEQ ID NO: 53762 - protein, 580 aa, Homo sapiens; identical to SEQ ID NO: 53758

SEQ ID NO: 53763 - protein, 444 aa, Homo sapiens; identical to SEQ ID NO: 53759

SEQ ID NO: 53764 - protein, 186 aa, Homo sapiens
MQHPLWPGSSEGLQLLVCFLLLNSCPGGCSDTSAHDGQDQVGVGQLWPLQGFATPVFQHLQVVLQQIIPQGLFWKDDITQDAMIQKMEHASRLHPQEPCLKDGKALFPTKTTESPLAKVNRDQCFTSEVVSKALKQEVANPVKITYRCSYGGLDMMQAPGPSKEEIIYKIMRLLWATSYCGPQPCG

SEQ ID NO: 53765 - protein, 1052 aa, Homo sapiens
MREAAERRQQLQLEHDQALAVLSAKQQEIDLLQKSKVRELEEKCRTQSEQFNLLSRDLEKFRQHAGKIDLLGGSAVAPLDISTAPSKPFPQFMNGLATSLGKGQESAIGGSSAIGEYIRPLPQPGDRPEPLSAKPTFLSRSGSARCRSESDMENERNSNTSKQRYSGKVHLCVARYSYNPFDGPNENPEAELPLTAGKYLYVYGDMDEDGFYEGELLDGQRGLVPSNFVDFVQDNESRLASTLGNEQDQNFINHSGIGLEGEHILDLHSPTHIDAGITDNSAGTLDVNIDDIGEDIVPYPRKITLIKQLAKSVIVGWEPPAVPPGWGTVSSYNVLVDKETRMNLTLGSRTKALIEKLNMAACTYRISVQCVTSRGSSDELQCTLLVGKDVVVAPSHLRVDNITQISAQLSWLPTNSNYSHVIFLNEEEFDIVKAARYKYQFFNLRPNMAYKVKVLAKPHQMPWQLPLEQREKKEAFVEFSTLPAGPPAPPQDVTVQAGVTPATIRVSWRPPVLTPTGLSNGANVTGYGVYAKGQRVAEVIFPTADSTAVELVRLRSLEAKGVTVRTLSAQGESVDSAVAAVPPELLVPPTPHPRPAPQSKPLASSGVPETKDEHLGPHARMDEAWEQSRAPGPVHGHMLEPPVGPGRRSPSPSRILPQPQGTPVSTTVAKAMAREAAQRVAESSRLEKRSVFLERSSAGQYAASDEEDAYDSPDFKRRGASVDDFLKGSELGKQPHCCHGDEYHTESSRGSDLSDIMEEDEEELYSEMQLEDGGRRRPSGTSHNALKILGNPASAGRVDHMGRRFPRGSAGPQRSRPVTVPSIDDYGRDRLSPDFYEESETDPGAEELPARIFVALFDYDPLTMSPNPDAAEEELPFKEGQIIKVYGDKDADGFYRGETCARLGLIPCNMVSEIQADDEEMMDQLLRQGFLPLNTPVEKIERSRRSGRRHSVSTRRMVALYDYDPRESSPNVDVEAELTFCTGDIITVFGEIDEDGFYYGELNGQKGLVPSNFLEEVPDDVEVYLSDAPSHYSQDTPMRSKAKRKKSVHFIP

SEQ ID NO: 53766 - protein, 325 aa, Homo sapiens
MAVGNNTQRSYSIIPCFIFVELVIMAGTVLLAYYFECTDTFQVHIQGFFCQDGDLMKPYPGTEEESFITPLVLYCVLAATPTAIIFIGEISMYFIKSTRESLIAQEKTILTGECCYLNPLLRRIIRFTGVFAFGLFATDIFVNAGQVVTGHLTPYFLTVCKPNYTSADCQAHHQFINNGNICTGDLEVIEKARRSFPSKHAALSIYSALYATMYITSTIKTKSSRLAKPVLCLGTLCTAFLTGLNRVSEYRNHCSDVIAGFILGTAVALFLGMCVVHNFKGTQGSPSKPKPEDPRGVPLMAFPRIESPLETLSAQNHSASMTEVT

SEQ ID NO: 53767 - protein, 325 aa, Homo sapiens; identical to SEQ ID NO: 53766

SEQ ID NO: 53768 - protein, 732 aa, Homo sapiens
MERGGGGSGTGSRPEGTARGTSLPGKIAEPGAVRTSQPNYRPQGMEGFLKSDERQRLAKERREEREKCLAAREQQILEKQKRARLQYEKQMEERWRKLEEQRQREDQKRAAVEEKRKQKLREEEERLEAMMRRSLERTQQLELKKKYSWGAPLAIGPGGHDACDKLSTSTMSLPKPTEPPMNKRLSSSTVAISYSPDRVFHVCPRLAPLGPLNPSYKSSPTRNIEKKKATSTSTSGAGDVGKEALSGGEASLVEKVKRGQRTATSLPVVNFGSPLRRCEFSGGIPKRPSSPVISKTATKAYPQSPKTTKPPYPGSPVKYRLPALSGQDMPKRKAEKEKSNKEREGTLAQQAAGPQGEEALEKHVVDKHASEKHAAAAGGKAENSAALGKPTAGTTDAGEAAKILAEKRRQARLQKEQEEQERVEKEEQDRLEREELKRKAEEERLRLEEEARKQEEERKRQEEEKKKQEGEEKRKAGEEAKRKAEEELLLKEKQEQEKQEKAMIEKQKEAAETKAREVAEQMRLEREQIMLQIEQERLERKKRIDEIMKRTRKSDVPPQVKKEDPKVGVQPAVCVEKKTKLVVPNKMEINGLNTCQEVNGVDHAAPETYPQDIFSNGLKPAGGLIHLDALDGKSNSLDDSTEEVQSMDVSPVSKEELISIPEFSPVSEMIPGVSLDQNGTGNARALQDLLDFTGPPTFPKRSSENLSLDDCNKNLIEGFNSPGQETPLNTFC

SEQ ID NO: 53769 - protein, 566 aa, Homo sapiens
MSPPGSAAGESAAGGGGGGGGPGVSEELTAAAAAAAADEGPAREEQRPIQPSFTKSLCRESHWKCLLLSLLMYGCLGAVAWCHVTTVTRLTFSSAYQGNSLMYHDSPCSNGYVYIPLAFLLMLYAVYLVECWHCQARHELQHRVDVSSVRERVGRMQQATPCIWWKAISYHYVRRTRQVTRYRNGDAYTTTQVYHERVNTHVAEAEFDYARCGVRDVSKTLVGLEGAPATRLRFTKCFSFASVEAENAYLCQRARFFAENEGLDDYMEAREGMHLKNVDFREFMVAFPDPARPPWYACSSAFWAAALLTLSWPLRVLAEYRTAYAHYHVEKLFGLEGPGSASSAGGGLSPSDELLPPLTHRLPRVNTVDSTELEWHIRSNQQLVPSYSEAVLMDLAGLGTRCGGAGGGYAPSCRYGGVGGPGAAGVAPYRRSCEHCQRAVSSSSIFSRSALSICASPRAGPGPGGGAGCGGSRFSLGRLYGSRRSCLWRSRSGSVNEASCPTEQTRLSSQASMGDDEDDDEEEAGPPPPYHDALYFPVLIVHRQEGCLGHSHRPLHRHGSCVETSL

SEQ ID NO: 53770 - protein, 566 aa, Homo sapiens; identical to SEQ ID NO: 53769

SEQ ID NO: 53771 - protein, 405 aa, Homo sapiens
MEASFVQTTMALGLSSKKASSRNVAVERKNLITVCRFSVKTLLEKYTAEPIDDSSEEFVNFAAILEQILSHRFKACAPAGPVSWFSSDGQRGFWDYIRLACSKVPNNCVSSIENMENISTARAKGRAWIRVALMEKRMSEYITTALRDTRTTRRFYDSGAIMLRDEATILTGMLIGLSAIDFSFCLKGEVLDGKTPVVIDYTPYLKFTQSYDYLTDEEERHSAESSTSEDNSPEHPYLPLVTDEDSWYSKWHKMEQKFRIVYAQKGYLEELVRLRESQLKDLEAENRRLQLQLEEAAAQNQREKRELEGVILELQEQLTGLIPSDHAPLAQGSKELTTPLVNQWPSLGTLNGAEGASNSKLYRRHSFMSTEPLSAEASLSSDSQRLGEGTRDEEPWGPIGSSEPN

SEQ ID NO: 53772 - protein, 120 aa, Homo sapiens
MNATFLNHSGLEEVDGVGGGAGAALGNRTHGLGTWLGCCPGGAPLAASDGVPAGLAPDERSLWVSRVAQIAVLCVLSLTVVFGVFFLGCNLLIKSESMINFLVQERRPSKDVGAAILGLY

SEQ ID NO: 53773 - protein, 776 aa, Homo sapiens
MAAPGDPQDELLPLAGPGSQWLRHRGEGENEAVTPKGATPAPQAGEPSPGLGARAREAASREAGSGPARQSPVAMETASTGVAGVSSAMDHTFSTTSKDGEGSCYTSLISDICYPPQEDSTYFTGILQKENGHVTISESPEELGTPGPSLPDVPGIESRGLFSSDSGIEMTPAESTEVNKILADPLDQMKAEAYKYIDITRPEEVKHQEQHHPELEDKDLDFKNKDTDISIKPEGVREPDKPAPVEGKIIKDHLLEESTFAPYIDDLSEEQRRAPQITTPVKITLTEIEPSVETTTQEKTPEKQDICLKPSPDTVPTVTVSEPEDDSPGSITPPSSGTEPSAAESQGKGSISEDELITAIKEAKGLSYETAENPRPVGQLADRPEVKARSGPPTIPSPLDHEASSAESGDSEIELVSEDPMAAEDALPSGYVSFGHVGGPPPSPASPSIQYSILREEREAELDSELIIESCDASSASEESPKREQDSPPMKPSALDAIREETGVRAEERAPSRRGLAEPGSFLDYPSTEPQPGPELPPGDGALEPETPMLPRKPEEDSSSNQSPAATKGPGPLGPGAPPPLLFLNKQKAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKIQAKIPGAKRHAE

SEQ ID NO: 53774 - protein, 208 aa, Homo sapiens
MQATADSTKMDCVWSNWKSQAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKIQAKIPGAKRHAE

SEQ ID NO: 53775 - protein, 356 aa, Homo sapiens
MAAEDALPSGYVSFGHVGGPPPSPASPSIQYSILREEREAELDSELIIESCDASSASEESPKREQDSPPMKPSALDAIREETGVRAEERAPSRRGLAEPGSFLDYPSTEPQPGPELPPGDGALEPETPMLPRKPEEDSSSNQSPAATKGPGPLGPGAPPPLLFLNKQKAIDLLYWRDIKQTGIVFGSFLLLLFSLTQFSVVSVVAYLALAALSATISFRIYKSVLQAVQKTDEGHPFKAYLELEITLSQEQIQKYTDCLQFYVNSTLKELRRLFLVQDLVDSLKFAVLMWLLTYVGALFNGLTLLLMAVVSMFTLPVVYVKHQAQIDQYLGLVRTHINAVVAKIQAKIPGAKRHAE

SEQ ID NO: 53776 - protein, 235 aa, Homo sapiens
MAEKVNNFPPLPKFIPLKPCFYQDFEADIPPQHVSMTKRLYYLWMLNSVTLAVNLVGCLAWLIGGGGATNFGLAFLWLILFTPCSYVCWFRPIYKAFKTDSSFSFMAFFFTFMAQLVISIIQAVGIPGWGVCGWIATISFFGTNIGSAVVMLIPTVMFTVMAVFSFIALSMVHKFYRGSGGSFSKAQEEWTTGAWKNPHVQQAAQNAAMGAAQGAMNQPQTQYSATPNYTYSNEM

SEQ ID NO: 53777 - protein, 215 aa, Homo sapiens
MHRDAWLPRPAFSLTGLSLFFSLVPPGRSMEVTVPATLNVLNGSDARLPCTFNSCYTVNHKQFSLNWTYQECNNCSEEMFLQFRMKIINLKLERFQDRVEFSGNPSKYDVSVMLRNVQPEDEGIYNCYIMNPPDRHRGHGKIHLQVLMEEPPERDSTVAVIVGASVGGFLAVVILVLMVVKCVRRKKEQKLSTDDLKTEEEGKTDGEGNPDDGAK

SEQ ID NO: 53778 - protein, 215 aa, Homo sapiens
MPAFNRLFPLASLVLIYWVSVCFPVCVEVPSETEAVQGNPMKLRCISCMKREEVEATTVVEWFYRPEGGKDFLIYEYRNGHQEVESPFQGRLQWNGSKDLQDVSITVLNVTLNDSGLYTCNVSREFEFEAHRPFVKTTRLIPLRVTEEAGEDFTSVVSEIMMYILLVFLTLWLLIEMIYCYRKVSKAEEAAQENASDYLAIPSENKENSAVPVEE

SEQ ID NO: 53779 - protein, 228 aa, Homo sapiens
MPGAGDGGKAPARWLGTGLLGLFLLPVTLSLEVSVGKATDIYAVNGTEILLPCTFSSCFGFEDLHFRWTYNSSDAFKILIEGTVKNEKSDPKVTLKDDDRITLVGSTKEKMNNISIVLRDLEFSDTGKYTCHVKNPKENNLQHHATIFLQVVDRLEEVDNTVTLIILAVVGGVIGLLILILLIKKLIIFILKKTREKKKECLVSSSGNDNTENGLPGSKAEEKPPSKV

SEQ ID NO: 53780 - protein, 414 aa, Homo sapiens
MAAAPPSYCFVAFPPRAKDGLVVFGKNSARPRDEVQEVVYFSAADHEPESKVECTYISIDQVPRTYAIMISRPAWLWGAEMGANEHGVCIANEAINTREPAAEIEALLGMDLVRLGLERGETAKEALDVIVSLLEEHGQGGNYFEDANSCHSFQSAYLIVDRDEAWVLETIGKYWAAEKVTEGVRCICSQLSLTTKMDAEHPELRSYAQSQGWWTGEGEFNFSEVFSPVEDHLDCGAGKDSLEKQEESITVQTMMNTLRDKASGVCIDSEFFLTTASGVSVLPQNRSSPCIHYFTGTHDPSRSIFKPFIFVDDVKLVPKTQSPCFGDDDPAKKEPRFQEKPDRRHELYKAHEWARAIIESDQEQGRKLRSTMLELEKQGLEAMEEILTSSEPLDPAEVGDLFYDCVDTEIKFFK

SEQ ID NO: 53781 - protein, 348 aa, Homo sapiens
MPRSFLVKKVKLDAFSSADLESAYGRARSDLGAPLHDKGYLSDYVGPSSVYDGDAEAALLKGPSPEPMYAAAVRGELGPAAAGSAPPPTPRPELATAAGGYINGDAAVSEGYAADAFFITDGRSRRKASNAGSAAAPSTASAAAPDGDAGGGGGAGGRSLGSGPGGRGGTRAGAGTEARAGPGAAGAGGRHACGECGKTYATSSNLSRHKQTHRSLDSQLARRCPTCGKVYVSMPAMAMHLLTHDLRHKCGVCGKAFSRPWLLQGHMRSHTGEKPFGCAHCGKAFADRSNLRAHMQTHSAFKHFQCKRCKKSFALKSYLNKHYESACFKGGAGGPAAPAPPQLSPVQA

SEQ ID NO: 53782 - protein, 776 aa, Homo sapiens
MRFSMVDREHIRLSQDLRCPGSWSSLGPAGFAPAPPAFHSCPGRRVFKAGHTRLEIRDRAPPQALCTPLPGDLHWCSSVNMVQRYQSPVRVYKYPFELVMAAYEKRFPTCPQIPVFLGSEVLRESRSPDGAVHVVERSCRLRVDAPRLLRKIAGVEHVVFVQTNILNWKERTLLIEAHNETFANRVVVNEHCSYTVHPENEDWTCFEQSASLDIRSFFGFENALEKIAMKQYTANVKRGKEVIEHYLNELISQGTSHIPRWTPAPVREEDARNQAGPRDPSSLEAHGPRSTLGPALEAVSMDGDKLDADYIERCLGHLTPMQESCLIQLRHWLQETHKGKIPKDEHILRFLRAHDFHLDKAREMLRQSLSWRKQHQVDLLLQTWQPPALLEEFYAGGWHYQDIDGRPLYILRLGQMDTKGLMKAVGEEALLRHVLSVNEEGQKRCEGSTRQLGRPISSWTCLLDLEGLNMRHLWRPGVKALLRMIEVVEDNYPETLGRLLIVRAPRVFPVLWTLISPFINENTRRKFLIYSGSNYQGPGGLVDYLDREVIPDFLGGESVCNVPEGGLVPKSLYMTEEEQEHTDQLWQWSETYHSASVLRGAPHEVAVEILEGESVITWDFDILRGDVVFSLYHTKQAPRLGAREPGTRASGQLIDKGWVLGRDYSRVEAPLVCREGESIQGSHVTRWPGVYLLQWQMHSPPSSVACSLPGVDDVLTALHSPGPKCKLLYYCEVLASEDFRGSMSSLESCTSGFSQLSAATSSSSSGQSHSSSLVSR

SEQ ID NO: 53783 - protein, 830 aa, Homo sapiens [sequence omitted]

SEQ ID NO: 53784 - protein, 337 aa, Homo sapiens
MSELVPEPRPKPAVPMKPMSINSNLLGYIGIDTIIEQMRKKTMKTGFDFNIMVVGQSGLGKSTLVNTLFKSQVSRKASSWNREEKIPKTVEIKAIGHVIEEGGVKMKLTVIDTPGFGDQINNENCWEPIEKYINEQYEKFLKEEVNIARKKRIPDTRVHCCLYFISPTGHSLRPLDLEFMKHLSKVVNIIPVIAKADTMTLEEKSEFKQRVRKELEVNGIEFYPQKEFDEDLEDKTENDKIRQESMPFAVVGSDKEYQVNGKRVLGRKTPWGIIEVENLNHCEFALLRDFVIRTHLQDLKEVTHNIHYETYRAKRLNDNGGLPPVSVDTEESHDSNP

SEQ ID NO: 53785 - protein, 345 aa, Homo sapiens
MSELVPEPRPKPAVPMKPMSINSNLLGYIGIDTIIEQMRKKTMKTGFDFNIMVVGQSGLGKSTLVNTLFKSQVSRKASSWNREEKIPKTVEIKAIGHVIEEGGVKMKLTVIDTPGFGDQINNENCWEPIEKYINEQYEKFLKEEVNIARKKRIPDTRVHCCLYFISPTGHSLRPLDLEFMKHLSKVVNIIPVIAKADTMTLEEKSEFKQRVRKELEVNGIEFYPQKEFDEDLEDKTENDKIRQESMPFAVVGSDKEYQVNGKRVLGRKTPWGIIEVENLNHCEFALLRDFVIRTHLQDLKEVTHNIHYETYRAKRLNDNGGLPPGEGLLGTVLPPVPATPCPTAE

SEQ ID NO: 53786 - protein, 478 aa, Homo sapiens
MDRSLGWQGNSVPEDRTEAGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 53787 - protein, 274 aa, Homo sapiens
MIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGYGPSLRLLAPPGAVKGTGQEHQGQGCH

SEQ ID NO: 53788 - protein, 459 aa, Homo sapiens
MIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 53789 - protein, 208 aa, Homo sapiens
MDRSLGWQGNSVPEDRTEAGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEVEPPALPLPFSGLLQEDRGQGAECVCVCVCVCVCVCLCVCVSGTYFSPVSALAPRYLPPRALEICSFSKGRRPSWWPQMGTHRSLALLF

SEQ ID NO: 53790 - protein, 410 aa, Homo sapiens
MAFLGLFSLLVLQSMATGATFPEEAIADLSVNMYNRLRATGEDENILFSPLSIALAMGMMELGAQGSTQKEIRHSMGYDSLKNGEEFSFLKEFSNMVTAKESQYVMKIANSLFVQNGFHVNEEFLQMMKKYFNAAVNHVDFSQNVAVANYINKWVENNTNNLVKDLVSPRDFDAATYLALINAVYFKGNWKSQFRPENTRTFSFTKDDESEVQIPMMYQQGEFYYGEFSDGSNEAGGIYQVLEIPYEGDEISMMLVLSRQEVPLATLEPLVKAQLVEEWANSVKKQKVEVYLPRFTVEQEIDLKDVLKALGITEIFIKDANLTGLSDNKEIFLSKAIHKSFLEVNEEGSEAAAVSGMIAISRMAVLYPQVIVDHPFFFLIRNRRTGTILFMGRVMHPETMNTSGHDFEEL

SEQ ID NO: 53791 - protein, 994 aa, Homo sapiens
MRPVALLLLPSLLALLAHGLSLEAPTVGKGQAPGIEETDGELTAAPTPEQPERGVHFVTTAPTLKLLNHHPLLEEFLQEGLEKGDEELRPALPFQPDPPAPFTPSPLPRLANQDSRPVFTSPTPAMAAVPTQPQSKEGPWSPESESPMLRITAPLPPGPSMAVPTLGPGEIASTTPPSRAWTPTQEGPGDMGRPWVAEVVSQGAGIGIQGTITSSTASGDDEETTTTTTIITTTITTVQTPGPCSWNFSGPEGSLDSPTDLSSPTDVGLDCFFYISVYPGYGVEIKVQNISLREGETVTVEGLGGPDPLPLANQSFLLRGQVIRSPTHQAALRFQSLPPPAGPGTFHFHYQAYLLSCHFPRRPAYGDVTVTSLHPGGSARFHCATGYQLKGARHLTCLNATQPFWDSKEPVCIGECPGVIRNATTGRIVSPGFPGNYSNNLTCHWLLEAPEGQRLHLHFEKVSLAEDDDRLIIRNGDNVEAPPVYDSYEVEYLPIEGLLSSGKHFFVELSTDSSGAAAGMALRYEAFQQGHCYEPFVKYGNFSSSTPTYPVGTTVEFSCDPGYTLEQGSIIIECVDPHDPQWNETEPACRAVCSGEITDSAGVVLSPNWPEPYGRGQDCIWGVHVEEDKRIMLDIRVLRIGPGDVLTFYDGDDLTARVLGQYSGPRSHFKLFTSMADVTIQFQSDPGTSVLGYQQGFVIHFFEVPRNDTCPELPEIPNGWKSPSQPELVHGTVVTYQCYPGYQVVGSSVLMCQWDLTWSEDLPSCQRVTSCHDPGDVEHSRRLISSPKFPVGATVQYICDQGFVLMGSSILTCHDRQAGSPKWSDRAPKCLLEQLKPCHGLSAPENGARSPEKQLHPAGATIHFSCAPGYVLKGQASIKCVPGHPSHWSDPPPICRAASLDGFYNSRSLDVAKAPAASSTLDAAHIAAAIFLPLVAMVLLVGGVYFYFSRLQGKSSLQLPRPRPRPYNRITIESAFDNPTYETGSLSFAGDERI

SEQ ID NO: 53792 - protein, 352 aa, Homo sapiens
MSVAGLKKQFHKATQKVSEKVGGAEGTKLDDDFKEMERKVDVTSRAVMEIMTKTIEYLQPNPASRAKLSMINTMSKIRGQEKGPGYPQAEALLAEAMLKFGRELGDDCNFGPALGEVGEAMRELSEVKDSLDIEVKQNFIDPLQNLHDKDLREIQHHLKKLEGRRLDFDYKKKRQGKIPDEELRQALEKFDESKEIAESSMFNLLEMDIEQVSQLSALVQAQLEYHKQAVQILQQVTVRLEERIRQASSQPRREYQPKPRMSLEFPTGDSTQPNGGLSHTGTPKPSGVQMDQPCCRALYDFEPENEGELGFKEGDIITLTNQIDENWYEGMLHGHSGFFPINYVEILVALPH

SEQ ID NO: 53793 - protein, 2161 aa, Homo sapiens
MTHSPATSEDEERHSASECPEGGSESDSSPDGPGRGPRGTRGQGSGAPGSLASVRGLQGRSMSVPDDAHFSMMVFRIGIPDLHQTKCLRFNPDATIWTAKQQVLCALSESLQDVLNYGLFQPATSGRDANFLEEERLLREYPQSFEKGVPYLEFRYKTRVYKQTNLDEKQLAKLHTKTGLKKFLEYVQLGTSDKVARLLDKGLDPNYHDSDSGETPLTLAAQTEGSVEVIRTLCLGGAHIDFRARDGMTALHKAACARHCLALTALLDLGGSPNYKDRRGLTPLFHTAMVGGDPRCCELLLFNRAQLGIADENGWQEIHQACQRGHSQHLEHLLFYGAEPGAQNASGNTALHICALYNKETCARILLYRGADKDVKNNNGQTPFQVAVIAGNFELGELIRNHREQDVVPFQESPKYAARRRGPPGTGLTVPPALLRANSDTSMALPDWMVFSAPGAASSGAPGPTSGSQGQSQPSAPTTKLSSGTLRSASSPRGARARSPSRGRHPEDAKRQPRGRPSSSGTPREGPAGGTGGSGGPGGSLGSRGRRRKLYSAVPGRSFMAVKSYQAQAEGEISLSKGEKIKVLSIGEGGFWEGQVKGRVGWFPSDCLEEVANRSQESKQESRSDKAKRLFRHYTVGSYDSFDAPSLMDGIGPGSDYIIKEKTVLLQKKDSEGFGFVLRGAKAQTPIEEFTPTPAFPALQYLESVDEGGVAWRAGLRMGDFLIEVNGQNVVKVGHRQVVNMIRQGGNTLMVKVVMVTRHPDMDEAVHKKAPQQAKRLPPPTISLRSKSMTSELEEMEYEQQPAPVPSMEKKRTVYQMALNKLDEILAAAQQTISASESPGPGGLASLGKHRPKGFFATESSFDPHHRAQPSYERPSFLPPGPGLMLRQKSIGAAEDDRPYLAPPAMKFSRSLSVPGSEDIPPPPTTYPPEPPYSTPTVPSSSGRLTPSPRGGPFNPGSGGPLPASSPATFDGPSPPDTRVGSREKSLYHSGPLPPAHHHPPHHHHHHAPPPQPHHHHAHPPHPPEMETGGSPDDPPPRLALGPQPSLRGWRGGGPSPTPGAPSPSHHGSAGGGGGSSQGPALRYIQLPPRAASAAMYVPARSGRGRKGPLVKQTKVEGEPQKGGGLPPAPSPSSPASPQPPPAVAAPSEKNSIPIPTIIIKAPSTSSSGRSSQGSSTEAEPPTQPEPTGGGGGGGSSPSPAPAMSPVPPSPSPVPTPASPSGPATLDFTSQFGAALVGAARREGGWQNEARRRSTLFLSTDAGDEDGGDGGLGTGAAPGPRLRHSKSIDEGMFSAEPYLRLESAGSGAGYGGYGAGSRAYGGGGGSSAFTSFLPPRPLVHPLTGKALDPASPLGLALAARERALKESSEGGGAPQPPPRPPSPRYEAPPPTPHHHSPHAHHEPVLRLWGASPPDPARRELGYRAGLGSQEKSLPASPPAARRSLLHRLPPTAPGVGPLLLQLGTEPPAPHPGVSKPWRSAAPEEPERLPLHVRFLENCQPRAPVTSGRGPPSEDGPGVPPPSPRRSVPPSPTSPRASEENGLPLLVLPPPAPSVDVEDGEFLFVEPLPPPLEFSNSFEKPESPLTPGPPHPLPDTPAPATPLPPVPPPAVAAAPPTLDSTASSLTSYDSEVATLTQGASAAPGDPHPPGPPAPAAPAPAAPQPGPDPPPGTDSGIEEVDSRSSSDHPLETISSASTLSSLSAEGGGSAGGGGGAGAGVASGPELLDTYVAYLDGQAFGGSSTPGPPYPPQLMTPSKLRGRALGASGGLRPGPSGGLRDPVTPTSPTVSVTGAGTDGLLALRACSGPPTAGVAGGPVAVEPEVPPVPLPTASCLPRKLLPWEEGPGPPPPPLPGPLAQPQASALATVKASIISELSSKLQQFGGSSAAGGALPWARGGSGGGGDSHHGGASYVPERTSSLQRQRLSDDSQSSLLSKPVSSLFQNWPKPPLPPLPTGTGVSPTAAAAPGATSPSASSSSTSTRHLQGVEFEMRPPLLRRAPSPSLLPASEHKVSPAPRPSSLPILPSGPLYPGLFDIRGSPTGGAGGSADPFAPVFVPPHPGISGGLGGALSGASRSLSPTRLLSLPPDKPFGAKPLGFWTKFDVADWLEWLGLAEHRAQFLDHEIDGSHLPALTKEDYVDLGVTRVGHRMNIDRALKFFLER

SEQ ID NO: 53794 - protein, 332 aa, Homo sapiens
MVFRSPLDLYSSHFLLPNFADSHHRSILLASSGGGNGAGGGGGAGGGSGGGNGAGGGGAGGAGGGGGGGSRAPPEELSMFQLPTLNFSPEQVASVCETLEETGDIERLGRFLWSLPVAPGACEAINKHESILRARAVVAFHTGNFRDLYHILENHKFTKESHGKLQAMWLEAHYQEAEKLRGRPLGPVDKYRVRKKFPLPRTIWDGEQKTHCFKERTRSLLREWYLQDPYPNPSKKRELAQATGLTPTQVGNWFKNRRQRDRAAAAKNRLQHQAIGPSGMRSLAEPGCPTHGSAESPSTAASPTTSVSSLTERADTGTSILSVTSSDSECDV

SEQ ID NO: 53795 - protein, 560 aa, Homo sapiens
MEFRQEEFRKLAGRALGKLHRLLEKRQEGAETLELSADGRPVTTQTRDPPVVDCTCFGLPRRYIIAIMSGLGFCISFGIRCNLGVAIVSMVNNSTTHRGGHVVVQKAQFSWDPETVGLIHGSFFWGYIVTQIPGGFICQKFAANRVFGFAIVATSTLNMLIPSAARVHYGCVIFVRILQGLVEGVTYPACHGIWSKWAPPLERSRLATTAFCGSYAGAVVAMPLAGVLVQYSGWSSVFYVYGSFGIFWYLFWLLVSYESPALHPSISEEERKYIEDAIGESAKLMNPLTKFSTPWRRFFTSMPVYAIIVANFCRSWTFYLLLISQPAYFEEVFGFEISKVGLVSALPHLVMTIIVPIGGQIADFLRSRRIMSTTNVRKLMNCGGFGMEATLLLVVGYSHSKGVAISFLVLAVGFSGFAISGFNVNHLDIAPRYASILMGISNGVGTLSGMVCPIIVGAMTKHKTREEWQYVFLIASLVHYGGVIFYGVFASGEKQPWAEPEEMSEEKCGFVGHDQLAGSDDSEMEDEAEPPGAPPAPPPSYGATHSTFQPPRPPPPVRDY

SEQ ID NO: 53796 - protein, 542 aa, Homo sapiens
MTKSNGEEPKMGGRMERFQQGVSKRTLLAKKKVQNITKEDVKSYLFRNAFVLLTVTAVIVGTILGFTLRPYRMSYREVKYFSFPGELLMRMLQMLVLPLIISSLVTGMAALDSKASGKMGMRAVVYYMTTTIIAVVIGIIIVIIIHPGKGTKENMHREGKIVRVTAADAFLDLIRNMFPPNLVEACFKQFKTNYEKRSFKVPIQANETLVGAVINNVSEAMETLTRITEELVPVPGSVNGVNALGLVVFSMCFGFVIGNMKEQGQALREFFDSLNEAIMRLVAVIMWYAPVGILFLIAGKIVEMEDMGVIGGQLAMYTVTVIVGLLIHAVIVLPLLYFLVTRKNPWVFIGGLLQALITALGTSSSSATLPITFKCLEENNGVDKRVTRFVLPVGATINMDGTALYEALAAIFIAQVNNFELNFGQIITISITATAASIGAAGIPQAGLVTMVIVLTSVGLPTDDITLIIAVDWFLDRLRTTTNVLGDSLGAGIVEHLSRHELKNRDVEMGNSVIEENEMKKPYQLIAQDNETEKPIDSETKM

SEQ ID NO: 53797 - protein, 525 aa, Homo sapiens
MATLLRSKLSNVATSVSNKSQAKMSGMFARMGFQAATDEEAVGFAHCDDLDFEHRQGLQMDILKAEGEPCGDEGAEAPVEGDIHYQRGSGAPLPPSGSKDQVGGGGEFGGHDKPKITAWEAGWNVTNAIQGMFVLGLPYAILHGGYLGLFLIIFAAVVCCYTGKILIACLYEENEDGEVVRVRDSYVAIANACCAPRFPTLGGRVVNVAQIIELVMTCILYVVVSGNLMYNSFPGLPVSQKSWSIIATAVLLPCAFLKNLKAVSKFSLLCTLAHFVINILVIAYCLSRARDWAWEKVKFYIDVKKFPISIGIIVFSYTSQIFLPSLEGNMQQPSEFHCMMNWTHIAACVLKGLFALVAYLTWADETKEVITDNLPGSIRAVVNIFLVAKALLSYPLPFFAAVEVLEKSLFQEGSRAFFPACYSGDGRLKSWGLTLRCALVVFTLLMAIYVPHFALLMGLTGSLTGAGLCFLLPSLFHLRLLWRKLLWHQVFFDVAIFVIGGICSVSGFVHSLEGLIEAYRTNAED

SEQ ID NO: 53798 - protein, 408 aa, Homo sapiens
MIPPEQPQQQLQPPSPAPPNHVVTTIENLPAEGSGGGGSLSASSRAGVRQRIRKVLNREMLISVALGQVLSLLICGIGLTSKYLSEDFHANTPVFQSFLNYILLFLVYTTTLAVRQGEENLLAILRRRWWKYMILGLIDLEANYLVVKAYQYTNLTSIQLLDCFVIPVVILLSWFFLLIRYKAVHFIGIVVCILGMGCMVGADVLVGRHQGAGENKLVGDLLVLGGATLYGISNVWEEYIIRTLSRVEFLGMIGLFGAFFSGIQLAIMEHKELLKVPWDWQIGLLYVGFSACMFGLYSFMQVVIKKTSATSVNLSLLTADLYSLFCGLFLFHYKFSGLYLLSFFTILIGLVLYSSTSTYIAQDPRVYKQFRNPSGPVVDLPTTAQVEPSVTYTSLGQETEEEPHVRVA

SEQ ID NO: 53799 - protein, 636 aa, Homo sapiens
MKKLQGAHLRKPVTPDLLMTPSDQGDVDLDVDFAAHRGNWTGKLDFLLSCIGYCVGLGNVWRFPYRAYTNGGGAFLVPYFLMLAICGIPLFFLELSLGQFSSLGPLAVWKISPLFKGAGAAMLLIVGLVAIYYNMIIAYVLFYLFASLTSDLPWEHCGNWWNTELCLEHRVSKDGNGALPLNLTCTVSPSEEYWSRYVLHIQGSQGIGSPGEIRWNLCLCLLLAWVIVFLCILKGVKSSGKVVYFTATFPYLILLMLLVRGVTLPGAWKGIQFYLTPQFHHLLSSKVWIEAALQIFYSLGVGFGGLLTFASYNTFHQNIYRDTFIVTLGNAITSILAGFAIFSVLGYMSQELGVPVDQVAKAGPGLAFVVYPQAMTMLPLSPFWSFLFFFMLLTLGLDSQFAFLETIVTAVTDEFPYYLRPKKAVFSGLICVAMYLMGLILTTDGGMYWLVLLDDYSASFGLMVVVITTCLAVTRVYGIQRFCRDIHMMLGFKPGLYFRACWLFLSPATLLALLVYSIVKYQPSEYGSYRFPPWAELLGILMGLLSCLMIPAGMLVAVLREEGSLWERLQQASRPAMDWGPSLEENRTGMYVATLAGSQSPKPLMVHMRKYGGITSFENTAIEVDREIAEEEESMM

SEQ ID NO: 53800 - protein, 921 aa, Homo sapiens
MAPLALVGVTLLLAAPPCSGAATPTPSLPPPPANDSDTSTGGCQGSYRCQPGVLLPVWEPDDPSLGDKAARAVVYFVAMVYMFLGVSIIADRFMAAIEVITSKEKEITITKANGETSVGTVRIWNETVSNLTLMALGSSAPEILLSVIEVCGHNFQAGELGPGTIVGSAAFNMFVVIAVCIYVIPAGESRKIKHLRVFFVTASWSIFAYVWLYLILAVFSPGVVQVWEALLTLVFFPVCVVFAWMADKRLLFYKYVYKRYRTDPRSGIIIGAEGDPPKSIELDGTFVGAEAPGELGGLGPGPAEARELDASRREVIQILKDLKQKHPDKDLEQLVGIANYYALLHQQKSRAFYRIQATRLMTGAGNVLRRHAADASRRAAPAEGAGEDEDDGASRIFFEPSLYHCLENCGSVLLSVTCQGGEGNSTFYVDYRTEDGSAKAGSDYEYSEGTLVFKPGETQKELRIGIIDDDIFEEDEHFFVRLLNLRVGDAQGMFEPDGGGRPKGRLVAPLLATVTILDDDHAGIFSFQDRLLHVSECMGTVDVRVVRSSGARGTVRLPYRTVDGTARGGGVHYEDACGELEFGDDETMKTLQVKIVDDEEYEKKDNFFIELGQPQWLKRGISALLLNQGDGDRKLTAEEEEARRIAEMGKPVLGENCRLEVIIEESYDFKNTVDKLIKKTNLALVIGTHSWREQFLEAITVSAGDEEEEEDGSREERLPSCFDYVMHFLTVFWKVLFACVPPTEYCHGWACFGVSILVIGLLTALIGDLASHFGCTVGLKDSVNAVVFVALGTSIPDTFASKVAALQDQCADASIGNVTGSNAVNVFLGLGVAWSVAAVYWAVQGRPFEVRTGTLAFSVTLFTVFAFVGIAVLLYRRRPHIGGELGGPRGPKLATTALFLGLWLLYILFASLEAYCHIRGF

SEQ ID NO: 53801 - protein, 712 aa, Homo sapiens
MDTSSKENIQLFCKTSVQPVGRPSFKTEYPSSEEKQPCCGELKVFLCALSFVYFAKALAEGYLKSTITQIERRFDIPSSLVGVIDGSFEIGNLLVITFVSYFGAKLHRPKIIGAGCVIMGVGTLLIAMPQFFMEQYKYERYSPSSNSTLSISPCLLESSSQLPVSVMEKSKSKISNECEVDTSSSMWIYVFLGNLLRGIGETPIQPLGIAYLDDFASEDNAAFYIGCVQTVAIIGPIFGFLLGSLCAKLYVDIGFVNLDHITITPKDPQWVGAWWLGYLIAGIISLLAAVPFWYLPKSLPRSQSREDSNSSSEKSKFIIDDHTDYQTPQGENAKIMEMARDFLPSLKNLFGNPVYFLYLCTSTVQFNSLFGMVTYKPKYIEQQYGQSSSRANFVIGLINIPAVALGIFSGGIVMKKFRISVCGAAKLYLGSSVFGYLLFLSLFALGCENSDVAGLTVSYQGTKPVSYHERALFSDCNSRCKCSETKWEPMCGENGITYVSACLAGCQTSNRSGKNIIFYNCTCVGIAASKSGNSSGIVGRCQKDNGCPQMFLYFLVISVITSYTLSLGGIPGYILLLRCIKPQLKSFALGIYTLAIRVLAGIPAPVYFGVLIDTSCLKWGFKRCGSRGSCRLYDSNVFRHIYLGLTVILGTVSILLSIAVLFILKKNYVSKHRSFITKRERTMVSTRFQKENYTTSDHLLQPNYWPGKETQL

SEQ ID NO: 53802 - protein, 696 aa, Homo sapiens
MLLWILLLETSLCFAAGNVTGDVCKEKICSCNEIEGDLHVDCEKKGFTSLQRFTAPTSQFYHLFLHGNSLTRLFPNEFANFYNAVSLHMENNGLHEIVPGAFLGLQLVKRLHINNNKIKSFRKQTFLGLDDLEYLQADFNLLRDIDPGAFQDLNKLEVLILNDNLISTLPANVFQYVPITHLDLRGNRLKTLPYEEVLEQIPGIAEILLEDNPWDCTCDLLSLKEWLENIPKNALIGRVVCEAPTRLQGKDLNETTEQDLCPLKNRVDSSLPAPPAQEETFAPGPLPTPFKTNGQEDHATPGSAPNGGTKIPGNWQIKIRPTAAIATGSSRNKPLANSLPCPGGCSCDHIPGSGLKMNCNNRNVSSLADLKPKLSNVQELFLRDNKIHSIRKSHFVDYKNLILLDLGNNNIATVENNTFKNLLDLRWLYMDSNYLDTLSREKFAGLQNLEYLNVEYNAIQLILPGTFNAMPKLRILILNNNLLRSLPVDVFAGVSLSKLSLHNNYFMYLPVAGVLDQLTSIIQIDLHGNPWECSCTIVPFKQWAERLGSEVLMSDLKCETPVNFFRKDFMLLSNDEICPQLYARISPTLTSHSKNSTGLAETGTHSNSYLDTSRVSISVLVPGLLLVFVTSAFTVVGMLVFILRNRKRSKRRDANSSASEINSLQTVCDSSYWHNGPYNADGAHRVYDCGSHSLSD

SEQ ID NO: 53803 - protein, 845 aa, Homo sapiens
MLSGVWFLSVLTVAGILQTESRKTAKDICKIRCLCEEKENVLNINCENKGFTTVSLLQPPQYRIYQLFLNGNLLTRLYPNEFVNYSNAVTLHLGNNGLQEIRTGAFSGLKTLKRLHLNNNKLEILREDTFLGLESLEYLQADYNYISAIEAGAFSKLNKLKVLILNDNLLLSLPSNVFRFVLLTHLDLRGNRLKVMPFAGVLEHIGGIMEIQLEENPWNCTCDLLPLKAWLDTITVFVGEIVCETPFRLHGKDVTQLTRQDLCPRKSASDSSQRGSHADTHVQRLSPTMNPALNPTRAPKASRPPKMRNRPTPRVTVSKDRQSFGPIMVYQTKSPVPLTCPSSCVCTSQSSDNGLNVNCQERKFTNISDLQPKPTSPKKLYLTGNYLQTVYKNDLLEYSSLDLLHLGNNRIAVIQEGAFTNLTSLRRLYLNGNYLEVLYPSMFDGLQSLQYLYLEYNVIKEIKPLTFDALINLQLLFLNNNLLRSLPDNIFGGTALTRLNLRNNHFSHLPVKGVLDQLPAFIQIDLQENPWDCTCDIMGLKDWTEHANSPVIINEVTCESPAKHAGEILKFLGREAICPDSPNLSDGTVLSMNHNTDTPRSLSVSPSSYPELHTEVPLSVLILGLLVVFILSVCFGAGLFVFVLKRRKGVPSVPRNTNNLDVSSFQLQYGSYNTETHDKTDGHVYNYIPPPVGQMCQNPIYMQKEGDPVAYYRNLQEFSYSNLEEKKEEPATPAYTISATELLEKQATPREPELLYQNIAERVKELPSAGLVHYNFCTLPKRQFAPSYESRRQNQDRINKTVLYGTPRKCFVGQSKPNHPLLQAKPQSEPDYLEVLEKQTAISQL

SEQ ID NO: 53804 - protein, 134 aa, Homo sapiens
MDVFMKGLSMAKEGVVAAAEKTKQGVTEAAEKTKEGVLYVGSKTREGVVQGVASVAEKTKEQASHLGGAVFSGAGNIAAATGLVKREEFPTDLKPEEVAQEAAEEPLIEPLMEPEGESYEDPPQEEYQEYEPEA

SEQ ID NO: 53805 - protein, 134 aa, Homo sapiens; identical to SEQ ID NO: 53804

SEQ ID NO: 53806 - protein, 1183 aa, Homo sapiens
MGNAPSQDPERSSPPMLSADDAEYPREYRTLGGGGGGGSGGRRFSNVGLVHTSERRHTVIAAQSLEALSGLQKADADRKRDAFMDHLKSKYPQHALALRGQQDRMREQPNYWSFKTRSSRHTQGAQPGLADQAAKLSYASAESLETMSEAELPLGFSRMNRFRQSLPLSRSASQTKPRSPGVLFLQFGEETRRVHITHEVSSLDTLHALIAHMFPQKLTMGMLKSPNTAILIKDEARNVFYELEDVRDIQDRSIIKIYRKEPLYAAFPGSHLTNGDLRREMVYASRESSPTRRLNNLSPAPHLASGSPPPGLPSGLPSGLQSGSPSRSRLSYAGGRPPSYAGSPVHHAAERLGGAPAAQGVSPSPSAILERRDVKPDEDLASKAGGMVLVKGEGLYADPYGLLHEGRLSLAAAAGDPFAYPGAGGLYKRGSVRSLSTYSAAALQSDLEDSLYKAAGGGGPLYGDGYGFRLPPSSPQKLADVAAPPGGPPPPHSPYSGPPSRGSPVRQSFRKDSGSSSVFAESPGGKTRSAGSASTAGAPPSELFPGPGERSLVGFGPPVPAKDTETRERMEAMEKQIASLTGLVQSALLRGSEPETPSEKIEGSNGAATPSAPCGSGGRSSGATPVSGPPPPSASSTPAGQPTAVSRLQMQLHLRGLQNSASDLRGQLQQLRKLQLQNQESVRALLKRTEAELSMRVSEAARRQEDPLQRQRTLVEEERLRYLNDEELITQQLNDLEKSVEKIQRDVSHNHRLVPGPELEEKALVLKQLGETLTELKAHFPGLQSKMRVVLRVEVEAVKFLKEEPQRLDGLLKRCRGVTDTLAQIRRQVDEGVWPPPNNLLSQSPKKVTAETDFNKSVDFEMPPPSPPLNLHELSGPAEGASLTPKGGNPTKGLDTPGKRSVDKAVSVEAAERDWEEKRAALTQYSAKDINRLLEETQAELLKAIPDLDCASKAHPGPAPTPDHKPPKAPHGQKAAPRTEPSGRRGSDELTVPRYRTEKPSKSPPPPPPRRSFPSSHGLTTTRTGEVVVTSKKDSAFIKKAESEELEVQKPQVKLRRAVSEVARPASTPPIMASAIKDEDDEDRIIAELESGGGSVPPMKVVTPGASRLKAAQGQAGSPDKSKHGKQRAEYMRIQAQQQATKPSKEMSGSNETSSPVSEKPSASRTSIPVLTSFGARNSSISF

SEQ ID NO: 53807 - protein, 494 aa, Homo sapiens
MAMSLPGSRRTSAGSRRRTSPPVSVRDAYGTSSLSSSSNSGSYKGSDSSPTPRRSMKYTLCSDNHGIKPPTPEQYLTPLQQKEVCIRHLKARLKDTQDRLQDRDTEIDDLKTQLSRMQEDWIEEECHRVEAQLALKEARKEIKQLKQVIDTVKNNLIDKDKGLQKYFVDINIQNKKLETLLHSMEVAQNGMAKEDGTGESAGGSPARSLTRSSTYTKLSDPAVCGDRQPGDPSSGSAEDGADSGFAAADDTLSRTDALEASSLLSSGVDCGTEETSLHSSFGLGPRFPASNTYEKLLCGMEAGVQASCMQERAIQTDFVQYQPDLDTILEKVTQAQVCGTDPESGDRCPELDAHPSGPRDPNSAVVVTVGDELEAPEPITRGPTPQRPGANPNPGQSVSVVCPMEEEEEAAVAEKEPKSYWSRHYIVDLLAVVVPAVPTVAWLCRSQRRQGQPIYNISSLLRGCCTVALHSIRRISCRSLSQPSPSPAGGGSQL

SEQ ID NO: 53808 - protein, 317 aa, Homo sapiens
MYNMMETELKPPGPQQTSGGGGGNSTAAAAGGNQKNSPDRVKRPMNAFMVWSRGQRRKMAQENPKMHNSEISKRLGAEWKLLSETEKRPFIDEAKRLRALHMKEHPDYKYRPRRKTKTLMKKDKYTLPGGLLAPGGNSMASGVGVGAGLGAGVNQRMDSYAHMNGWSNGSYSMMQDQLGYPQHPGLNAHGAAQMQPMHRYDVSALQYNSMTSSQTYMNGSPTYSMSYSQQGTPGMALGSMGSVVKSEASSSPPVVTSSSHSRAPCQAGDLRDMISMYLPGAEVPEPAAPSRLHMSQHYQSGPVPGTAINGTLPLSHM

SEQ ID NO: 53809 - protein, 151 aa, Homo sapiens
MNWAPATCWALLLAAAFLCDSGAAKGGRGGARGSARGGVRGGARGASRVRVRPAQRYGAPGSSLRVAAAGAAAGAAAGAAAGLAAGSGWRRAAGPGERGLEDEEDGVPGGNGTGPGIYSYRAWTSGAGPTRGPRLCLVLGGALGALGLLRP

SEQ ID NO: 53810 - protein, 216 aa, Homo sapiens
MTLAAYKEKMKELPLVSLFCSCFLADPLNKSSYKYEGWCGRQCRRKDESQRKDSADWRERRAQADTVDLNWCVISDMEVIELNKCTSGQSFEVILKPPSFDGVPEFNASLPRRRDPSLEEIQKKLEAAEERRKYQEAELLKHLAEKREHEREVIQKAIEENNNFIKMAKEKLAQKMESNKENREAHLAAMLERLQEKDKHAEEVRKNKELKEEASR

SEQ ID NO: 53811 - protein, 713 aa, Homo sapiens
MDELAGGGGGGPGMAAPPRQQQGPGGNLGLSPGGNGAAGGGGPPASEGAGPAAGPELSRPQQNTIPGILHYIQHEWARFEMERAHWEVERAELQARIAFLQGERKGQENLKKDLVRRIKMLEYALKQERAKYHKLKYGTELNQGDLKMPTFESEETKDTEAPTAPQNSQLTWKQGRQLLRQYLQEVGYTDTILDVRSQRVRSLLGLSNSEPNGSVETKNLEQILNGGESPKQKGQEIKRSSGDVLETFNFLENADDSDEDEENDMIEGIPEGKDKHRMNKHKIGNEGLAADLTDDPDTEEALKEFDFLVTAEDGEGAGEARSSGDGTEWAEPITFPSGGGKSFIMGSDDVLLSVLGLGDLADLTVTNDADYSYDLPANKDAFRKTWNPKYTLRSHFDGVRALAFHPVEPVLVTASEDHTLKLWNLQKTVPAKKSASLDVEPIYTFRAHIGPVLSLAISSNGEQCFSGGIDATIQWWNMPSPSVDPYDTYEPNVLAGTLVGHTDAVWGLAYSGIKNQLLSCSADGTVRLWNPQEKLPCICTYNGDKKHGIPTSVDFIGCDPAHMVTSFNTGSAVIYDLETSQSLVILSSQVDSGLQSNNHINRVVSHPTLPVTITAHEDRHIKFFDNKTGKMIHSMVAHLDAVTSLAVDPNGIYLMSGSHDCSIRLWNLDSKTCVQEITAHRKKLDESIYDVAFHSSKAYIASAGADALAKVFV

SEQ ID NO: 53812 - protein, 284 aa, Homo sapiens
MAESEAETPSTPGEFESKYFEFHGVRLPPFCRGKMEEIANFPVRPSDVWIVTYPKSGTSLLQEVVYLVSQGADPDEIGLMNIDEQLPVLEYPQPGLDIIKELTSPRLIKSHLPYRFLPSDLHNGDSKVIYMARNPKDLVVSYYQFHRSLRTMSYRGTFQEFCRRFMNDKLGYGSWFEHVQEFWEHRMDSNVLFLKYEDMHRDLVTMVEQLARFLGVSCDKAQLEALTEHCHQLVDQCCNAEALPVGRGRVGLWKDIFTVSMNEKFDLVYKQKMGKCDLTFDFYL

SEQ ID NO: 53813 - protein, 260 aa, Homo sapiens
MAESEAETPSTPGEFESKYFEFHGVRLPPFCRGKMEEIANFPVRPSDVWIVTYPKSGTSLLQEVVYLVSQGADPDEIGLMNIDEQLPVLEYPQPGLDIIKELTSPRLIKSHLPYRFLPSDLHNGDSKVIYMARNPKDLVVSYYQFHRSLRTMSYRGTFQEFCRRFMNDKLGYGSWFEHVQEFWEHRMDSNVLFLKYEDMHRDLVTMVEQLARFLGVSCDKAQLEALTEHCHQLVDQCCNAEALPVGRAHCVFARKIFLSW

SEQ ID NO: 53814 - protein, 492 aa, Homo sapiens
MYHGMNPSNGDGFLEQQQQQQQPQSPQRLLAVILWFQLALCFGPAQLTGGFDDLQVCADPGIPENGFRTPSGGVFFEGSVARFHCQDGFKLKGATKRLCLKHFNGTLGWIPSDNSICVQEDCRIPQIEDAEIHNKTYRHGEKLIITCHEGFKIRYPDLHNMVSLCRDDGTWNNLPICQGCLRPLASSNGYVNISELQTSFPVGTVISYRCFPGFKLDGSAYLECLQNLIWSSSPPRCLALEAQVCPLPPMVSHGDFVCHPRPCERYNHGTVVEFYCDPGYSLTSDYKYITCQYGEWFPSYQVYCIKSEQTWPSTHETLLTTWKIVAFTATSVLLVLLLVILARMFQTKFKAHFPPRGPPRSSSSDPDFVVVDGVPVMLPSYDEAVSGGLSALGPGYMASVGQGCPLPVDDQSPPAYPGSGDTDTGPGESETCDSVSGSSELLQSLYSPPRCQESTHPASDNPDIIASTAEEVASTSPGIDIADEIPLMEEDP

SEQ ID NO: 53815 - protein, 742 aa, Homo sapiens
MEEGFRDRAAFIRGAKDIAKEVKKHAAKKVVKGLDRVQDEYSRRSYSRFEEEDDDDDFPAPSDGYYRGEGTQDEEEGGASSDATEGHDEDDEIYEGEYQDIPRAESGGKGERMADGAPLAGVRGGLSDGEGPPGGRGEAQRRKEREELAQQYEAILRECGHGRFQWTLYFVLGLALMADGVEVFVVGFVLPSAEKDMCLSDSNKGMLGLIVYLGMMVGAFLWGGLADRLGRRQCLLISLSVNSVFAFFSSFVQGYGTFLFCRLLSGVGIGGSIPIVFSYFSEFLAQEKRGEHLSWLCMFWMIGGVYAAAMAWAIIPHYGWSFQMGSAYQFHSWRVFVLVCAFPSVFAIGALTTQPESPRFFLENGKHDEAWMVLKQVHDTNMRAKGHPERVFSVTHIKTIHQEDELIEIQSDTGTWYQRWGVRALSLGGQVWGNFLSCFGPEYRRITLMMMGVWFTMSFSYYGLTVWFPDMIRHLQAVDYASRTKVFPGERVGHVTFNFTLENQIHRGGQYFNDKFIGLRLKSVSFEDSLFEECYFEDVTSSNTFFRNCTFINTVFYNTDLFEYKFVNSRLINSTFLHNKEGCPLDVTGTGEGAYMVYFVSFLGTLAVLPGNIVSALLMDKIGRLRMLAGSSVMSCVSCFFLSFGNSESAMIALLCLFGGVSIASWNALDVLTVELYPSDKRTTAFGFLNALCKLAAVLGISIFTSFVGITKAAPILFASAALALGSSLALKLPETRGQVLQ

SEQ ID NO: 53816 - protein, 683 aa, Homo sapiens
MDDYKYQDNYGGYAPSDGYYRGNESNPEEDAQSDVTEGHDEEDEIYEGEYQGIPHPDDVKAKQAKMAPSRMDSLRGQTDLMAERLEDEEQLAHQYETIMDECGHGRFQWILFFVLGLALMADGVEVFVVSFALPSAEKDMCLSSSKKGMLGMIVYLGMMAGAFILGGLADKLGRKRVLSMSLAVNASFASLSSFVQGYGAFLFCRLISGIGIGGALPIVFAYFSEFLSREKRGEHLSWLGIFWMTGGLYASAMAWSIIPHYGWGFSMGTNYHFHSWRVFVIVCALPCTVSMVALKFMPESPRFLLEMGKHDEAWMILKQVHDTNMRAKGTPEKVFTVSNIKTPKQMDEFIEIQSSTGTWYQRWLVRFKTIFKQVWDNALYCVMGPYRMNTLILAVVWFAMAFSYYGLTVWFPDMIRYFQDEEYKSKMKVFFGEHVYGATINFTMENQIHQHGKLVNDKFTRMYFKHVLFEDTFFDECYFEDVTSTDTYFKNCTIESTIFYNTDLYEHKFINCRFINSTFLEQKEGCHMDLEQDNDFLIYLVSFLGSLSVLPGNIISALLMDRIGRLKMIGGSMLISAVCCFFLFFGNSESAMIGWQCLFCGTSIAAWNALDVITVELYPTNQRATAFGILNGLCKFGAILGNTIFASFVGITKVVPILLAAASLVGGGLIALRLPETREQVLM

SEQ ID NO: 53817 - protein, 548 aa, Homo sapiens
MEEDLFQLRQLPVVKFRRTGESARSEDDTASGEHEVQIEGVHVGLEAVELDDGAAVPKEFANPTDDTFMVEDAVEAIGFGKFQWKLSVLTGLAWMADAMEMMILSILAPQLHCEWRLPSWQVALLTSVVFVGMMSSSTLWGNISDQYGRKTGLKISVLWTLYYGILSAFAPVYSWILVLRGLVGFGIGGVPQSVTLYAEFLPMKARAKCILLIEVFWAIGTVFEVVLAVFVMPSLGWRWLLILSAVPLLLFAVLCFWLPESARYDVLSGNQEKAIATLKRIATENGAPMPLGKLIISRQEDRGKMRDLFTPHFRWTTLLLWFIWFSNAFSYYGLVLLTTELFQAGDVCGISSRKKAVEAKCSLACEYLSEEDYMDLLWTTLSEFPGVLVTLWIIDRLGRKKTMALCFVIFSFCSLLLFICVGRNVLTLLLFIARAFISGGFQAAYVYTPEVYPTATRALGLGTCSGMARVGALITPFIAQVMLESSVYLTLAVYSGCCLLAALASCFLPIETKGRGLQESSHREWGQEMVGRGMHGAGVTRSNSGSQE

SEQ ID NO: 53818 - protein, 705 aa, Homo sapiens
MNYLRRRLSDSNFMANLPNGYMTDLQRPQPPPPPPGAHSPGATPGPGTATAERSSGVAPAASPAAPSPGSSGGGGFFSSLSNAVKQTTAAAAATFSEQVGGGSGGAGRGGAASRVLLVIDEPHTDWAKYFKGKKIHGEIDIKVEQAEFSDLNLVAHANGGFSVDMEVLRNGVKVVRSLKPDFVLIRQHAFSMARNGDYRSLVIGLQYAGIPSVNSLHSVYNFCDKPWVFAQMVRLHKKLGTEEFPLIDQTFYPNHKEMLSSTTYPVVVKMGHAHSGMGKVKVDNQHDFQDIASVVALTKTYATAEPFIDAKYDVRVQKIGQNYKAYMRTSVSGNWKTNTGSAMLEQIAMSDRYKLWVDTCSEIFGGLDICAVEALHGKDGRDHIIEVVGSSMPLIGDHQDEDKQLIVELVVNKMAQALPRQRQRDASPGRGSHGQTPSPGALPLGRQTSQQPAGPPAQQRPPPQGGPPQPGPGPQRQGPPLQQRPPPQGQQHLSGLGPPAGSPLPQRLPSPTSAPQQPASQAAPPTQGQGRQSRPVAGGPGAPPAARPPASPSPQRQAGPPQATRQTSVSGPAPPKASGAPPGGQQRQGPPQKPPGPAGPTRQASQAGPVPRTGPPTTQQPRPSGPGPAGRPKPQLAQKPSQDVPPPATAAAGGPPHPQLNKSQSLTNAFNLPEPAPPRPSLSQDEVKAETIRSLRKSFASLFSD

SEQ ID NO: 53819 - protein, 669 aa, Homo sapiens
MNYLRRRLSDSNFMANLPNGYMTDLQRPQPPPPPPGAHSPGATPGPGTATAERSSGVAPAASPAAPSPGSSGGGGFFSSLSNAVKQTTAAAAATFSEQVGGGSGGAGRGGAASRVLLVIDEPHTDWAKYFKGKKIHGEIDIKVEQAEFSDLNLVAHANGGFSVDMEVLRNGVKVVRSLKPDFVLIRQHAFSMARNGDYRSLVIGLQYAGIPSVNSLHSVYNFCDKPWVFAQMVRLHKKLGTEEFPLIDQTFYPNHKEMLSSTTYPVVVKMGHAHSGMGKVKVDNQHDFQDIASVVALTKTYATAEPFIDAKYDVRVQKIGQNYKAYMRTSVSGNWKTNTGSAMLEQIAMSDRYKLWVDTCSEIFGGLDICAVEALHGKDGRDHIIEVVGSSMPLIGDHQDEDKQLIVELVVNKMAQALPRQRQRDASPGRGSHGQTPSPGALPLGRQTSQQPAGPPAQQRPPPQGGPPQPGPGPQRQGPPLQQRPPPQGQQHLSGLGPPAGSPLPQRLPSPTSAPQQPASQAAPPTQGQGRQSRPVAGGPGAPPAARPPASPSPQRQAGPPQATRQTSVSGPAPPKASGAPPGGQQRQGPPQKPPGPAGPTRQASQAGPVPRTGPPTTQQPRPSGPGPAGRPKPQLAQKPSQDVPPPATAAAGGPPHPQLKASPAQAQP

SEQ ID NO: 53820 - protein, 478 aa, Homo sapiens
MMNFLRRRLSDSSFIANLPNGYMTDLQRPEPQQPPPPPPPGPGAASASAAPPTASPGPERRPPPASAPAPQPAPTPSVGSSFFSSLSQAVKQTAASAGLVDAPAPAPAAARKAKVLLVVDEPHADWAKCFRGKKVLGDYDIKVEQAEFSELNLVAHADGTYAVDMQVLRNGTKVVRSFRPDFVLIRQHAFGMAENEDFRHLIIGMQYAGLPSINSLESIYNFCDKPWVFAQLVAIYKTLGGEKFPLIEQTYYPNHKEMLTLPTFPVVVKIGHAHSGMGKVKVENHYDFQDIASVVALTQTYATAEPFIDSKYDIRVQKIGNNYKAYMRTSISGNWKTNTGSAMLEQIAMSDRYKLWVDTCSEMFGGLDICAVKAVHGKDGKDYIFEVMDCSMPLIGEHQVEDRQLITELVISKMNQLLSRTPALSPQRPLTTQQPQSGTLKDPDSSKTPPQRPPPQGCLQYILDCNGIAVGPKQVQAS

SEQ ID NO: 53821 - protein, 582 aa, Homo sapiens
MMNFLRRRLSDSSFIANLPNGYMTDLQRPEPQQPPPPPPPGPGAASASAAPPTASPGPERRPPPASAPAPQPAPTPSVGSSFFSSLSQAVKQTAASAGLVDAPAPAPAAARKAKVLLVVDEPHADWAKCFRGKKVLGDYDIKVEQAEFSELNLVAHADGTYAVDMQVLRNGTKVVRSFRPDFVLIRQHAFGMAENEDFRHLIIGMQYAGLPSINSLESIYNFCDKPWVFAQLVAIYKTLGGEKFPLIEQTYYPNHKEMLTLPTFPVVVKIGHAHSGMGKVKVENHYDFQDIASVVALTQTYATAEPFIDSKYDIRVQKIGNNYKAYMRTSISGNWKTNTGSAMLEQIAMSDRYKLWVDTCSEMFGGLDICAVKAVHGKDGKDYIFEVMDCSMPLIGEHQVEDRQLITELVISKMNQLLSRTPALSPQRPLTTQQPQSGTLKDPDSSKTPPQRPPPQGGPGQPQGMQPPGKVLPPRRLPPGPSLPPSSSSSSSSSSSAPQRPGGPTTHGDAPSSSSSLAEAQPPLAAPPQKPQPHPQLNKSQSLTNAFSFSESSFFRSSANEDEAKAETIRSLRKSFASLFSD

SEQ ID NO: 53822 - protein, 229 aa, Homo sapiens
MEGASFGAGRAGAALDPVSFARRPQTLLRVASWVFSIAVFGPIVNEGYVNTDSGPELRCVFNGNAGACRFGVALGLGAFLACAAFLLLDVRFQQISSVRDRRRAVLLDLGFSGLWSFLWFVGFCFLTNQWQRTAPGPATTQAGDAARAAIAFSFFSILSWVALTVKALQRFRLGTDMSLFATEQLSTGASQAYPGYPVGSGVEGTETYQSPPFTETLDTSPKGYQVPAY

SEQ ID NO: 53823 - protein, 313 aa, Homo sapiens
MLLLADMDVVNQLVAGGQFRVVKEPLGFVKVLQWVFAIFAFATCGSYSGELQLSVDCANKTESDLSIEVEFEYPFRLHQVYFDAPTCRGGTTKVFLVGDYSSSAEFFVTVAVFAFLYSMGALATYIFLQNKYRENNKGPMLDFLATAVFAFMWLVSSSAWAKGLSDVKMATDPENIIKEMPVCRQTGNTCKELRDPVTSGLNTSVVFGFLNLVLWVGNLWFVFKETGWAAPFLRAPPGAPEKQPAPGDAYGDAGYGQGPGGYGPQDSYGPQGGYQPDYGQPAGSGGSGYGPQGDYGQQGYGPQGAPTSFSNQM

SEQ ID NO: 53824 - protein, 129 aa, Homo sapiens
MKILVALAVFFLVSTQLFAEEIGANDDLNYWSDWYDSDQIKEELPEPFEHLLQRIARRPKPQQFFGLMGKRDADSSIEKQVALLKALYGHGQISHKRHKTDSFVGLMGKRALNSVAYERSAMQNYERRR

SEQ ID NO: 53825 - protein, 111 aa, Homo sapiens
MKILVALAVFFLVSTQLFAEEIGANDDLNYWSDWYDSDQIKEELPEPFEHLLQRIARRPKPQQFFGLMGKRDADSSIEKQVALLKALYGHGQISHKMAYERSAMQNYERRR

SEQ ID NO: 53826 - protein, 114 aa, Homo sapiens
MKILVALAVFFLVSTQLFAEEIGANDDLNYWSDWYDSDQIKEELPEPFEHLLQRIARRPKPQQFFGLMGKRDAGHGQISHKRHKTDSFVGLMGKRALNSVAYERSAMQNYERRR

SEQ ID NO: 53827 - protein, 96 aa, Homo sapiens
MKILVALAVFFLVSTQLFAEEIGANDDLNYWSDWYDSDQIKEELPEPFEHLLQRIARRPKPQQFFGLMGKRDAGHGQISHKMAYERSAMQNYERRR

SEQ ID NO: 53828 - protein, 682 aa, Homo sapiens
MQLEHCLSPSIMLSKKFLNVSSSYPHSGGSELVLHDHPIISTTDNLERSSPLKKITRGMTNQSDTDNFPDSKDSPGDVQRSKLSPVLDGVSELRHSFDGSAADRYLLSQSSQPQSAATAPSAMFPYPGQHGPAHPAFSIGSPSRYMAHHPVITNGAYNSLLSNSSPQGYPTAGYPYPQQYGHSYQGAPFYQFSSTQPGLVPGKAQVYLCNRPLWLKFHRHQTEMIITKQGRRMFPFLSFNISGLDPTAHYNIFVDVILADPNHWRFQGGKWVPCGKADTNVQGNRVYMHPDSPNTGAHWMRQEISFGKLKLTNNKGASNNNGQMVVLQSLHKYQPRLHVVEVNEDGTEDTSQPGRVQTFTFPETQFIAVTAYQNTDITQLKIDHNPFAKGFRDNYDTIYTGCDMDRLTPSPNDSPRSQIVPGARYAMAGSFLQDQFVSNYAKARFHPGAGAGPGPGTDRSVPHTNGLLSPQQAEDPGAPSPQRWFVTPANNRLDFAASAYDTATDFAGNAATLLSYAAAGVKALPLQAAGCTGRPLGYYADPSGWGARSPPQYCGTKSGSVLPCWPNSAAAAARMAGANPYLGEEAEGLAAERSPLPPGAAEDAKPKDLSDSSWIETPSSIKSIDSSDSGIYEQAKRRRISPADTPVSESSSPLKSEVLAQRDCEKNCAKDISGYYGFYSHS

SEQ ID NO: 53829 - protein, 497 aa, Homo sapiens
MPTPDATTPQAKGFRRAVSELDAKQAEAIMSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 53830 - protein, 528 aa, Homo sapiens
MPTPDATTPQAKGFRRAVSELDAKQAEAIMVRGQGAPGPSLTGSPWPGTAAPAASYTPTPRSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 53831 - protein, 524 aa, Homo sapiens
MPTPDATTPQAKGFRRAVSELDAKQAEAIMGAPGPSLTGSPWPGTAAPAASYTPTPRSPRFIGRRQSLIEDARKEREAAVAAAAAAVPSEPGDPLEAVAFEEKEGKAVLNLLFSPRATKPSALSRAVKVFETFEAKIHHLETRPAQRPRAGGPHLEYFVRLEVRRGDLAALLSGVRQVSEDVRSPAGPKVPWFPRKVSELDKCHHLVTKFDPDLDLDHPGFSDQVYRQRRKLIAEIAFQYRHGDPIPRVEYTAEEIATWKEVYTTLKGLYATHACGEHLEAFALLERFSGYREDNIPQLEDVSRFLKERTGFQLRPVAGLLSARDFLASLAFRVFQCTQYIRHASSPMHSPEPDCCHELLGHVPMLADRTFAQFSQDIGLASLGASDEEIEKLSTLYWFTVEFGLCKQNGEVKAYGAGLLSSYGELLHCLSEEPEIRAFDPEAAAVQPYQDQTYQSVYFVSESFSDAKDKLRSYASRIQRPFSVKFDPYTLAIDVLDSPQAVRRSLEGVQDELDTLAHALSAIG

SEQ ID NO: 53832 - protein, 1099 aa, Homo sapiens
MCPSEMGTLWHHWSPVLISLAALFSKVTEGRGILESIQRFSLLPTYLPVTYHINNADVSFFLKEANQDIMRNSSLQSRVESFLIYKSRRLPVLNASYGPFSIEQVVPQDLMLPSNPFGFTNKFSLNWKLKAHILRDKVYLSRPKVQVLFHIMGRDWDDRSAGEKLPCLRVFAFRETREVRGSCRLQGDLGLCVAELELLSSWFSPPTVVAGRRKSVDQPEGTPVELYYTVHPGGERGDCVREDARRSNGIRTGHSDIDESGPPLQRIGSIFLYQTHRKPSLRELRLDNSVAIHYIPKTVRKGDVLTFPVSISRNSTEDRFTLRAKVKKGVNIIGVRASSPSIWDVKERTDYTGKYAPAVIVCQKKAAGSENSADGASYEVMQIDVEVEEPGDLPATQLVTWQVEYPGEITSDLGVSKIYVSPKDLIGVVPLAMEAEILNTAILTGKTVAVPVKVVSVEDDGTVTELLESVECRSSDEDVIKVSDRCDYVFVNGKEMKGKVNVVVNFTYQHLSSPLEMTVWVPRLPLQIEVSDTELNQIKGWRVPIVSSRRPAGDSEEEEDDERRGRGCTLQYQHAMVRVLTQFVAEAAGPGGHLAHLLGSDWQVDITELINDFMQVEEPRIAKLQGGQILMGQELGMTTIQILSPLSDTILAEKTITVLDEKVTITDLGVQLVTGLSLSLQLSPGSNRAIFATAVTQELLQRPKQEAAISCWVQFSDGSVTPLDIYDGKDFSLMATSLDEKVVSIHQDPKFKWPIIAAETEGQGTLVKVEMVISESCQKSKRKSVLAVGTANIKVKFGQNDANPNTSDSRHTGAGVHMENNVSDRRPKKPSQEWGSQEGQYYGSSSMGLMEGRGTTTDRSILQKKKGQESLLDDNSHLQTIPSDLTSFPAQVDLPRSNGEMDGNDLMQASKGLSDLEIGMYALLGVFCLAILVFLINCVTFALKYRHKQVPFEEQEGMSHSHDWVGLSNRTELLENHINFASSQDEQITAIDRGMDFEESKYLLSTNSQKSINGQLFKPLGPIIIDGKDQKSEPPTSPTSKRKRVKFTTFTAVSSDDEYPTRNSIVMSSEDDIKWVCQDLDPGDCKELHNYMERLHENV

SEQ ID NO: 53833 - protein, 465 aa, Homo sapiens
MKEPDAIKLFVGQIPRHLEEKDLKPIFEQFGRIFELTVIKDKYTGLHKGCAFLTYCARDSALKAQSALHEQKTLPGMNRPIQVKPADSESRGEDRKLFVGMLGKQQTDEDVRKMFEPFGTIDECTVLRGPDGTSKGCAFVKFQTHAEAQAAINTLHSSRTLPGASSSLVVKFADTEKERGLRRMQQVATQLGMFSPIALQFGAYSAYTQALMQQQAALVAAHSAYLSPMATMAAVQMQHMAAINANGLIATPITPSSGTSTPPAIAATPVSAIPAALGVNGYSPVPTQPTGQPAPDALYPNGVHPYPAQSPAAPVDPLQQAYAGMQHYTAAYPAAYSLVAPAFPQPPALVAQQPPPPPQQQQQQQQQQQQQQQREGPDGCNIFIYHLPQEFTDSEILQMFVPFGHVISAKVFVDRATNQSKCFGFVSFDNPASAQAAIQAMNGFQIGMKRLKVQLKRPKDANRPY

SEQ ID NO: 53834 - protein, 219 aa, Homo sapiens
MADKAKPAKAANRTPPKSPGDPSKDRAAKRLSLESEGAGEGAAASPELSALEEAFRRFAVHGDARATGREMHGKNWSKLCKDCQVIDGRNVTVTDVDIVFSKIKGKSCRTITFEQFQEALEELAKKRFKDKSSEEAVREVHRLIEGKAPIISGVTKAISSPTVSRLTDTTKFTGSHKERFDPSGKGKGKAGRVDLVDESGYVSGYKHAGTYDQKVQGGK

SEQ ID NO: 53835 - protein, 550 aa, Homo sapiens
MEEMEEELKCPVCGSFYREPIILPCSHNLCQACARNILVQTPESESPQSHRAAGSGVSDYDYLDLDKMSLYSEADSGYGSYGGFASAPTTPCQKSPNGVRVFPPAMPPPATHLSPALAPVPRNSCITCPQCHRSLILDDRGLRGFPKNRVLEGVIDRYQQSKAAALKCQLCEKAPKEATVMCEQCDVFYCDPCRLRCHPPRGPLAKHRLVPPAQGRVSRRLSPRKVSTCTDHELENHSMYCVQCKMPVCYQCLEEGKHSSHEVKALGAMWKLHKSQLSQALNGLSDRAKEAKEFLVQLRNMVQQIQENSVEFEACLVAQCDALIDALNRRKAQLLARVNKEHEHKLKVVRDQISHCTVKLRQTTGLMEYCLEVIKENDPSGFLQISDALIRRVHLTEDQWGKGTLTPRMTTDFDLSLDNSPLLQSIHQLDFVQVKASSPVPATPILQLEECCTHNNSATLSWKQPPLSTVPADGYILELDDGNGGQFREVYVGKETMCTVDGLHFNSTYNARVKAFNKTGVSPYSKTLVLQTSEGKALQQYPSERELRGI

SEQ ID NO: 53836 - protein, 460 aa, Homo sapiens
MGAPPGYRPSAWVHLLHQLPRADFQLRPVPSVFAPQEQEYQQALLLVAALAGLGLGLSLIFIAVYLIRFCCCRPPEPPGSKIPSPGGGCVTWSCIVALLAGCTGIGIGFYGNSETSDGVSQLSSALLHANHTLSTIDHLVLETVERLGEAVRTELTTLEEVLEPRTELVAAARGARRQAEAAAQQLQGLAFWQGVPLSPLQVAENVSFVEEYRWLAYVLLLLLELLVCLFTLLGLAKQSKWLVIVMTVMSLLVLVLSWGSMGLEAATAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKDYGAALRGLCEDALEGLLFLLLFSLLSAGALATALCSLPRAWALFPPRNPSALCSGSRLSEPLLPAGLEPGSPLRSFPGCRRRPH

SEQ ID NO: 53837 - protein, 450 aa, Homo sapiens
MGAPPGYRPSAWVHLLHQLPRADFQLRPVPSVFAPQEQEYQQALLLVAALAGLGLGLSLIFIAVYLIRFCCCRPPEPPGSKIPSPGGGCVTWSCIVALLAGCTGIGIGFYGNSETSDGVSQLSSALLHANHTLSTIDHLVLETVERLGEAVRTELTTLEEVLEPRTELVAAARGARRQAEAAAQQLQGLAFWQGVPLSPLQVAENVSFVEEYRWLAYVLLLLLELLVCLFTLLGLAKQSKWLVIVMTVMSLLVLVLSWGSMGLEAATAVGLSDFCSNPDPYVLNLTQEETGLSSDILSYYLLCNRAVSNPFQQRLTLSQRALANIHSQLLGLEREAVPQFPSAQKPLLSLEETLNVTEGNFHQLVALLHCRSLHKDYGAALRGLCEDALEGLLFLLLFSLLSAGALATALCSLPRAWALFPPSDDYDDTDDDDPFNPQESKRFVQWQSSI

SEQ ID NO: 53838 - protein, 444 aa, Homo sapiens
MREIVHLQAGQCGNQIGAKFWEVISDEHGIDPTGTYHGDSDLQLERINVYYNEATGGNYVPRAVLVDLEPGTMDSVRSGPFGQIFRPDNFVFGQSGAGNNWAKGHYTEGAELVDAVLDVVRKEAESCDCLQGFQLTHSLGGGTGSGMGTLLISKIREEFPDRIMNTFSVVPSPKVSDTVVEPYNATLSVHQLVENTDETYCIDNEALYDICFRTLKLTTPTYGDLNHLVSATMSGVTTCLRFPGQLNADLRKLAVNMVPFPRLHFFMPGFAPLTSRGSQQYRALTVPELTQQMFDAKNMMAACDPRHGRYLTVAAVFRGRMSMKEVDEQMLSVQSKNSSYFVEWIPNNVKTAVCDIPPRGLKMAATFIGNSTAIQELFKRISEQFTAMFRRKAFLHWYTGEGMDEMEFTEAESNMNDLVSEYQQYQDATAEEGEFEEEAEEEVA

SEQ ID NO: 53839 - protein, 1703 aa, Homo sapiens
MSLLCVGVKKAKFDGAQEKFNTYVTLKVQNVKSTTIAVRGSQPSWEQDFMFEINRLDLGLTVEVWNKGLIWDTMVGTVWIPLRTIRQSNEEGPGEWLTLDSQVIMADSEICGTKDPTFHRILLDTRFELPLDIPEEEARYWAKKLEQLNAMRDQDEYSFQDEQDKPLPVPSNQCCNWNYFGWGEQHNDDPDSAVDDRDSDYRSETSNSIPPPYYTTSQPNASVHQYSVRPPPLGSRESYSDSMHSYEEFSEPQALSPTGSSRYASSGELSQGSSQLSEDFDPDEHSLQGSDMEDERDRDSYHSCHSSVSYHKDSPRWDQDEEELEEDLEDFLEEEELPEDEEELEEEEEEVPDDLGSYAQREDVAVAEPKDFKRISLPPAAPGKEDKAPVAPTEAPDMAKVAPKPATPDKVPAAEQIPEAEPPKDEESFRPREDEEGQEGQDSMSRAKANWLRAFNKVRMQLQEARGEGEMSKSLWFKGGPGGGLIIIDSMPDIRKRKPIPLVSDLAMSLVQSRKAGITSALASSTLNNEELKNHVYKKTLQALIYPISCTTPHNFEVWTATTPTYCYECEGLLWGIARQGMRCTECGVKCHEKCQDLLNADCLQRAAEKSSKHGAEDRTQNIIMVLKDRMKIRERNKPEIFELIQEIFAVTKTAHTQQMKAVKQSVLDGTSKWSAKISITVVCAQGLQAKDKTGSSDPYVTVQVGKTKKRTKTIYGNLNPVWEENFHFECHNSSDRIKVRVWDEDDDIKSRVKQRFKRESDDFLGQTIIEVRTLSGEMDVWYNLDKRTDKSAVSGAIRLHISVEIKGEEKVAPYHVQYTCLHENLFHFVTDVQNNGVVKIPDAKGDDAWKVYYDETAQEIVDEFAMRYGVESIYQAMTHFACLSSKYMCPGVPAVMSTLLANINAYYAHTTASTNVSASDRFAASNFGKERFVKLLDQLHNSLRIDLSMYRNNFPASSPERLQDLKSTVDLLTSITFFRMKVQELQSPPRASQVVKDCVKACLNSTYEYIFNNCHELYSREYQTDPAKKGEVLPEEQGPSIKNLDFWSKLITLIVSIIEEDKNSYTPCLNQFPQELNVGKISAEVMWNLFAQDMKYAMEEHDKHRLCKSADYMNLHFKVKWLYNEYVTELPAFKDRVPEYPAWFEPFVIQWLDENEEVSRDFLHGALERDKKDGFQQTSEHALFSCSVVDVFSQLNQSFEIIKKLECPDPQIVGHYMRRFAKTISNVLLQYADIISKDFASYCSKEKEKVPCILMNNTQQLRVQLEKMFEAMGGKELDAEASDILKELQVKLNNVLDELSRVFATSFQPHIEECVKQMGDILSQVKGTGNVPASACSSVAQDADNVLQPIMDLLDSNLTLFAKICEKTVLKRVLKELWKLVMNTMEKTIVLPPLTDQTMIGNLLRKHGKGLEKGRVKLPSHSDGTQMIFNAAKELGQLSKLKDHMVREEAKSLTPKQCAVVELALDTIKQYFHAGGVGLKKTFLEKSPDLQSLRYALSLYTQATDLLIKTFVQTQSAQGLGVEDPVGEVSVHVELFTHPGTGEHKVTVKVVAANDLKWQTSGIFRPFIEVNIIGPQLSDKKRKFATKSKNNSWAPKYNESFQFTLSADAGPECYELQVCVKDYCFAREDRTVGLAVLQLRELAQRGSAACWLPLGRRIHMDDTGLTVLRILSQRSNDEVAKEFVKLKSDTRSAEEGGAAPAP

SEQ ID NO: 53840 - protein, 842 aa, Homo sapiens
MAVRPGLWPALLGIVLAAWLRGSGAQQSATVANPVPGANPDLLPHFLVEPEDVYIVKNKPVLLVCKAVPATQIFFKCNGEWVRQVDHVIERSTDGSSGLPTMEVRINVSRQQVEKVFGLEEYWCQCVAWSSSGTTKSQKAYIRIAYLRKNFEQEPLAKEVSLEQGIVLPCRPPEGIPPAEVEWLRNEDLVDPSLDPNVYITREHSLVVRQARLADTANYTCVAKNIVARRRSASAAVIVYVDGSWSPWSKWSACGLDCTHWRSRECSDPAPRNGGEECQGTDLDTRNCTSDLCVHTASGPEDVALYVGLIAVAVCLVLLLLVLILVYCRKKEGLDSDVADSSILTSGFQPVSIKPSKADNPHLLTIQPDLSTTTTTYQGSLCPRQDGPSPKFQLTNGHLLSPLGGGRHTLHHSSPTSEAEEFVSRLSTQNYFRSLPRGTSNMTYGTFNFLGGRLMIPNTGISLLIPPDAIPRGKIYEIYLTLHKPEDVRLPLAGCQTLLSPIVSCGPPGVLLTRPVILAMDHCGEPSPDSWSLRLKKQSCEGSWEDVLHLGEEAPSHLYYCQLEASACYVFTEQLGRFALVGEALSVAAAKRLKLLLFAPVACTSLEYNIRVYCLHDTHDALKEVVQLEKQLGGQLIQEPRVLHFKDSYHNLRLSIHDVPSSLWKSKLLVSYQEIPFYHIWNGTQRYLHCTFTLERVSPSTSDLACKLWVWQVEGDGQSFSINFNITKDTRFAELLALESEAGVPALVGPSAFKIPFLIRQKIISSLDPPCRRGADWRTLAQKLHLDSHLSFFASKPSPTAMILNLWEARHFPNGNLSQLAAAVAGLGQPDAGLFTVSEAEC

SEQ ID NO: 53841 - protein, 76 aa, Homo sapiens
MGAAISQGALIAIVCNGLVGFLLLLLWVILCWACHSRSADVDSLSESSPNSSPGPCPEKAPPPQKPSHEGSYLLQP

SEQ ID NO: 53842 - protein, 195 aa, Homo sapiens
MSSCSNVCGSRQAQAAAEGGYQRYGVRSYLHQFYEDCTASIWEYEDDFQIQRSPNRWSSVFWKVGLISGTVFVILGLTVLAVGFLVPPKIEAFGEADFVVVDTHAVQFNSALDMYKLAGAVLFCIGGTSMAGCLLMSVFVKSYSKEEKFLQQKFKERIADTKAHTQPVTKAPGPGETKIPVTLSRVQNVQPLLAT

SEQ ID NO: 53843 - protein, 191 aa, Homo sapiens
MGKQNSKLAPEVMEDLVKSTEFNEHELKQWYKGFLKDCPSGRLNLEEFQQLYVKFFPYGDASKFAQHAFRTFDKNGDGTIDFREFICALSITSRGSFEQKLNWAFNMYDLDGDGKITRVEMLEIIEAIYKMVGTVIMMKMNEDGLTPEQRVDKIFSKMDKNKDDQITLDEFKEAAKSDPSIVLLLQCDIQK

SEQ ID NO: 53844 - protein, 402 aa, Homo sapiens
MASIIARVGNSRRLNAPLPPWAHSMLRSLGRSLGPIMASMADRNMKLFSGRVVPAQGEETFENWLTQVNGVLPDWNMSEEEKLKRLMKTLRGPAREVMRVLQATNPNLSVADFLRAMKLVFGESESSVTAHGKFFNTLQAQGEKASLYVIRLEVQLQNAIQAGIIAEKDANRTRLQQLLLGGELSRDLRLRLKDFLRMYANEQERLPNFLELIRMVREEEDWDDAFIKRKRPKRSESMVERAVSPVAFQGSPPIVIGSADCNVIEIDDTLDDSDEDVILVESQDPPLPSWGAPPLRDRARPQDEVLVIDSPHNSRAQFPSTSGGSGYKNNGPGEMRRARKRKHTIRCSYCGEEGHSKETCDNESDKAQVFENLIITLQELTHTEMERSRVAPGEYNDFSEPL

SEQ ID NO: 53845 - protein, 229 aa, Homo sapiens
MKSSDIDQDLFTDSYCKVCSAQLISESQRVAHYESRKHASKVRLYYMLHPRDGGCPAKRLRSENGSDADMVDKNKCCTLCNMSFTSAVVADSHYQGKIHAKRLKLLLGEKTPLKTTATPLSPLKPPRMDTAPVVASPYQRRDSDRYCGLCAAWFNNPLMAQQHYDGKKHKKNAARVALLEQLGTTLDMGELRGLRRNYRCTICSVSLNSIEQYHAHLKGSKHQTNLKNK

SEQ ID NO: 53846 - DNA, 20 bp, Homo sapiens
gatcaaccacaaaaactcct

SEQ ID NO: 53847 - DNA, 20 bp, Homo sapiens
gatctcacggactgaaaaat

SEQ ID NO: 53848 - DNA, 20 bp, Homo sapiens
gatcatgtgaacatataata

SEQ ID NO: 53849 - DNA, 20 bp, Homo sapiens
gatcagaaaaccaagcatgt

SEQ ID NO: 53850 - DNA, 20 bp, Homo sapiens
gatcatccctcctgctgccc

SEQ ID NO: 53851 - DNA, 20 bp, Homo sapiens
gatccacttcatgttactac

SEQ ID NO: 53852 - DNA, 20 bp, Homo sapiens
gatcctgcagtgatggaatg

SEQ ID NO: 53853 - DNA, 20 bp, Homo sapiens
gatctgcccaccttggcgct

SEQ ID NO: 53854 - DNA, 20 bp, Homo sapiens
gatcaaagagaagctattag

SEQ ID NO: 53855 - DNA, 20 bp, Homo sapiens
gatcagctctccttccagaa

SEQ ID NO: 53856 - DNA, 20 bp, Homo sapiens
gatctccaagcaggaatatg

SEQ ID NO: 53857 - DNA, 20 bp, Homo sapiens
gatctttaatcgatgctcct

SEQ ID NO: 53858 - DNA, 20 bp, Homo sapiens
gatcaatacgggtctatttt

SEQ ID NO: 53859 - DNA, 20 bp, Homo sapiens
gatctaaaaagcagttcagt

SEQ ID NO: 53860 - DNA, 20 bp, Homo sapiens
gatcactcttgaccatgctt

SEQ ID NO: 53861 - DNA, 20 bp, Homo sapiens
gatcatctggttctcctctc

SEQ ID NO: 53862 - DNA, 20 bp, Homo sapiens
gatccatttctgggatagaa

SEQ ID NO: 53863 - DNA, 20 bp, Homo sapiens
gatctatgtgtatgcagaag

SEQ ID NO: 53864 - DNA, 20 bp, Homo sapiens
gatcaacatatatgatagac

SEQ ID NO: 53865 - DNA, 20 bp, Homo sapiens
gatcatctattttttaaata

SEQ ID NO: 53866 - DNA, 20 bp, Homo sapiens
gatcagttacattcatcagt

SEQ ID NO: 53867 - DNA, 20 bp, Homo sapiens
gatcatctcagttaggttta

SEQ ID NO: 53868 - DNA, 20 bp, Homo sapiens
gatcgacccatctgagcaaa

SEQ ID NO: 53869 - DNA, 20 bp, Homo sapiens
gatctctaatactgcctaaa

SEQ ID NO: 53870 - DNA, 20 bp, Homo sapiens
gatcacagagaaactcatgc

SEQ ID NO: 53871 - DNA, 20 bp, Homo sapiens
gatcactaaggaatccatgg

SEQ ID NO: 53872 - DNA, 20 bp, Homo sapiens
gatcatgaaaaacaagatta

SEQ ID NO: 53873 - DNA, 20 bp, Homo sapiens
gatcagcaactgggttttag

SEQ ID NO: 53874 - DNA, 20 bp, Homo sapiens
gatcgattttaaagaggggg

SEQ ID NO: 53875 - DNA, 20 bp, Homo sapiens
gatctgcccaggctgaaggc

SEQ ID NO: 53876 - DNA, 20 bp, Homo sapiens
gatctttgataaagattttt

SEQ ID NO: 53877 - DNA, 20 bp, Homo sapiens
gatcacttcaagactccctg

SEQ ID NO: 53878 - DNA, 20 bp, Homo sapiens
gatcagcagacccgacacag

SEQ ID NO: 53879 - DNA, 20 bp, Homo sapiens
gatcatgggagcgggcggag

SEQ ID NO: 53880 - DNA, 20 bp, Homo sapiens
gatcatttcacacccttttg

SEQ ID NO: 53881 - DNA, 20 bp, Homo sapiens
gatcggttccgtggtgtgga

SEQ ID NO: 53882 - DNA, 20 bp, Homo sapiens
gatctgcctgcagggctgcc

SEQ ID NO: 53883 - DNA, 20 bp, Homo sapiens
gatcaaaaattgtggccatc

SEQ ID NO: 53884 - DNA, 20 bp, Homo sapiens
gatcaagggctgtcttctct

SEQ ID NO: 53885 - DNA, 20 bp, Homo sapiens
gatccttgaattaaatgtct

SEQ ID NO: 53886 - DNA, 20 bp, Homo sapiens
gatctcttctctgtgtatct

SEQ ID NO: 53887 - DNA, 20 bp, Homo sapiens
gatctgattccaaagagcac

SEQ ID NO: 53888 - DNA, 20 bp, Homo sapiens
gatctccttcaaggtccaca

SEQ ID NO: 53889 - DNA, 20 bp, Homo sapiens
gatcaagtagttgtggagag

SEQ ID NO: 53890 - DNA, 20 bp, Homo sapiens
gatcttgaaaaaaatctcta

SEQ ID NO: 53891 - DNA, 20 bp, Homo sapiens
gatccagggcctgggaaaga

SEQ ID NO: 53892 - DNA, 20 bp, Homo sapiens
gatcagttgtatttattgta

SEQ ID NO: 53893 - DNA, 20 bp, Homo sapiens
gatccttgctcccaacgtct

SEQ ID NO: 53894 - DNA, 20 bp, Homo sapiens
gatctgtgaaatgctaagtg

SEQ ID NO: 53895 - DNA, 20 bp, Homo sapiens
gatctttcagattaatcttt

SEQ ID NO: 53896 - DNA, 20 bp, Homo sapiens
gatcaactgtatcacagtgc

SEQ ID NO: 53897 - DNA, 20 bp, Homo sapiens
gatcaagtaatacaggtagc

SEQ ID NO: 53898 - DNA, 20 bp, Homo sapiens
gatcacttgtgtggattttc

SEQ ID NO: 53899 - DNA, 20 bp, Homo sapiens
gatcagactctctgaaaact

SEQ ID NO: 53900 - DNA, 20 bp, Homo sapiens
gatcagagacaactggagtc

SEQ ID NO: 53901 - DNA, 20 bp, Homo sapiens
gatcccttaaaaaatttcct

SEQ ID NO: 53902 - DNA, 20 bp, Homo sapiens
gatctcagacccatacctga

SEQ ID NO: 53903 - DNA, 20 bp, Homo sapiens
gatcgctgtcccgcacccat

SEQ ID NO: 53904 - DNA, 20 bp, Homo sapiens
gatccctcctggctgtgagc

SEQ ID NO: 53905 - DNA, 20 bp, Homo sapiens
gatcaatagtgtcttccaag

SEQ ID NO: 53906 - DNA, 20 bp, Homo sapiens
gatcagcagaaaaattggct

SEQ ID NO: 53907 - DNA, 20 bp, Homo sapiens
gatctcaacctgctgacttt

SEQ ID NO: 53908 - DNA, 20 bp, Homo sapiens
gatcttcgggctgtttgagg

SEQ ID NO: 53909 - DNA, 20 bp, Homo sapiens
gatcagtcagacagggagct

SEQ ID NO: 53910 - DNA, 20 bp, Homo sapiens
gatccagctagagaaaaagg

SEQ ID NO: 53911 - DNA, 20 bp, Homo sapiens
gatcggtgcatcttccgccg

SEQ ID NO: 53912 - DNA, 20 bp, Homo sapiens
gatctactgtaaaaagagga

SEQ ID NO: 53913 - DNA, 20 bp, Homo sapiens
gatctctcatactttctccc

SEQ ID NO: 53914 - DNA, 20 bp, Homo sapiens
gatctgacacaggcattaaa

SEQ ID NO: 53915 - DNA, 20 bp, Homo sapiens
gatctgcccccaccatcctt

SEQ ID NO: 53916 - DNA, 20 bp, Homo sapiens
gatctgggctcaggggaagg

SEQ ID NO: 53917 - DNA, 20 bp, Homo sapiens
gatctgtgtttcttcccttc

SEQ ID NO: 53918 - DNA, 20 bp, Homo sapiens
gatcaccatatttcacttga

SEQ ID NO: 53919 - DNA, 20 bp, Homo sapiens
gatcagtcatgtgtccgtga

SEQ ID NO: 53920 - DNA, 20 bp, Homo sapiens
gatctccactgggggcttac

SEQ ID NO: 53921 - DNA, 20 bp, Homo sapiens
gatcacagatacgtaataat

SEQ ID NO: 53922 - DNA, 20 bp, Homo sapiens
gatcagcatcttcatgcaaa

SEQ ID NO: 53923 - DNA, 20 bp, Homo sapiens
gatcagaaggtctctgggaa

SEQ ID NO: 53924 - DNA, 20 bp, Homo sapiens
gatctaaaatgatactgtgt

SEQ ID NO: 53925 - DNA, 20 bp, Homo sapiens
gatcttagaaagcaatgagc

SEQ ID NO: 53926 - DNA, 20 bp, Homo sapiens
gatctttgtctttattagat

SEQ ID NO: 53927 - DNA, 20 bp, Homo sapiens
gatccctgagccaccttgca

SEQ ID NO: 53928 - DNA, 20 bp, Homo sapiens
gatccggctcattctcctgc

SEQ ID NO: 53929 - DNA, 20 bp, Homo sapiens
gatctgattccatcagatgg

SEQ ID NO: 53930 - DNA, 20 bp, Homo sapiens
gatcactgccaacctttggc

SEQ ID NO: 53931 - DNA, 20 bp, Homo sapiens
gatcatctccctctcctacg

SEQ ID NO: 53932 - DNA, 20 bp, Homo sapiens
gatccagagacatgtggcag

SEQ ID NO: 53933 - DNA, 20 bp, Homo sapiens
gatctggccctccccagaac

SEQ ID NO: 53934 - DNA, 20 bp, Homo sapiens
gatcccgctggtgggccagg

SEQ ID NO: 53935 - DNA, 20 bp, Homo sapiens
gatctctccagaatccctat

SEQ ID NO: 53936 - DNA, 20 bp, Homo sapiens
gatcaacgatatcaatgagt

SEQ ID NO: 53937 - DNA, 20 bp, Homo sapiens
gatcggtttttgtttttcag

SEQ ID NO: 53938 - DNA, 20 bp, Homo sapiens
gatcttccatcagggccgga

SEQ ID NO: 53939 - DNA, 20 bp, Homo sapiens
gatctcagggaagcctggga

SEQ ID NO: 53940 - DNA, 20 bp, Homo sapiens
gatcatcgactcttctgacc

SEQ ID NO: 53941 - DNA, 20 bp, Homo sapiens
gatcgccacgctgctgctcg

SEQ ID NO: 53942 - DNA, 20 bp, Homo sapiens
gatcaaaatattttaataaa

SEQ ID NO: 53943 - DNA, 20 bp, Homo sapiens
gatcacccagccgccagggg

SEQ ID NO: 53944 - DNA, 20 bp, Homo sapiens
gatcctgggcccccagggct

SEQ ID NO: 53945 - DNA, 20 bp, Homo sapiens
gatccggacagggccctctg

SEQ ID NO: 53946 - DNA, 20 bp, Homo sapiens
gatcccggggcttttccagc

SEQ ID NO: 53947 - DNA, 20 bp, Homo sapiens
gatcggtaagcagcgtctcc

SEQ ID NO: 53948 - DNA, 20 bp, Homo sapiens
gatcggcatgaagaggctca

SEQ ID NO: 53949 - DNA, 20 bp, Homo sapiens
gatcatgtgcatacacatac

SEQ ID NO: 53950 - DNA, 20 bp, Homo sapiens
gatcatgtgtgtatgtgcgt

SEQ ID NO: 53951 - DNA, 20 bp, Homo sapiens
gatcatcttgaattactgtg

SEQ ID NO: 53952 - DNA, 20 bp, Homo sapiens
gatccttactggtactctga

SEQ ID NO: 53953 - DNA, 20 bp, Homo sapiens
gatcccgccctcttcccagc

SEQ ID NO: 53954 - DNA, 20 bp, Homo sapiens
gatcctggcctgctgcctct

SEQ ID NO: 53955 - DNA, 20 bp, Homo sapiens
gatcgggcactggttcctcc

SEQ ID NO: 53956 - DNA, 20 bp, Homo sapiens
gatcgccttctatgtgggtc

SEQ ID NO: 53957 - DNA, 20 bp, Homo sapiens
gatctttttcacattttctt

SEQ ID NO: 53958 - DNA, 20 bp, Homo sapiens
gatcctctgagctgcgctcg

SEQ ID NO: 53959 - DNA, 20 bp, Homo sapiens
gatcatgctgaggagccatc

SEQ ID NO: 53960 - DNA, 20 bp, Homo sapiens
gatctatatggctatagcac

SEQ ID NO: 53961 - DNA, 20 bp, Homo sapiens
gatctcataacatttaactt

SEQ ID NO: 53962 - DNA, 20 bp, Homo sapiens
gatcaggtagaacaacaaaa

SEQ ID NO: 53963 - DNA, 20 bp, Homo sapiens
gatcgcgcatatgcactcaa

SEQ ID NO: 53964 - DNA, 20 bp, Homo sapiens
gatcgctgcgctggccaggt

SEQ ID NO: 53965 - DNA, 20 bp, Homo sapiens
gatccatcctcccacctcag

SEQ ID NO: 53966 - DNA, 20 bp, Homo sapiens
gatccatttgctgtttcttg

SEQ ID NO: 53967 - DNA, 20 bp, Homo sapiens
gatctcacaaagtacaaaac

SEQ ID NO: 53968 - DNA, 20 bp, Homo sapiens
gatcaaccaccagggcttct

SEQ ID NO: 53969 - DNA, 20 bp, Homo sapiens
gatcaacatgaacctgggtg

SEQ ID NO: 53970 - DNA, 20 bp, Homo sapiens
gatccctgtggggcggtcag

SEQ ID NO: 53971 - DNA, 20 bp, Homo sapiens
gatcctaacaggtgtgattg

SEQ ID NO: 53972 - DNA, 20 bp, Homo sapiens
gatccagacccactggtgca

SEQ ID NO: 53973 - DNA, 20 bp, Homo sapiens
gatcaccatggggaccctcc

SEQ ID NO: 53974 - DNA, 20 bp, Homo sapiens
gatcaatgatgcttcattca

SEQ ID NO: 53975 - DNA, 20 bp, Homo sapiens
gatccatcttgcttttgcct

SEQ ID NO: 53976 - DNA, 20 bp, Homo sapiens
gatcgcccccttgccgtggc

SEQ ID NO: 53977 - DNA, 20 bp, Homo sapiens
gatcgttctgggtcagcttg

SEQ ID NO: 53978 - DNA, 20 bp, Homo sapiens
gatcaccatcaccgaggcac

SEQ ID NO: 53979 - DNA, 20 bp, Homo sapiens
gatcaaacatcctcaccagt

SEQ ID NO: 53980 - DNA, 20 bp, Homo sapiens
gatcccattatcccaggggc

SEQ ID NO: 53981 - DNA, 20 bp, Homo sapiens
gatcctagtggatgtgccaa

SEQ ID NO: 53982 - DNA, 20 bp, Homo sapiens
gatctgcctccacttctctg

SEQ ID NO: 53983 - DNA, 20 bp, Homo sapiens
gatctgtcttgggctgtagg

SEQ ID NO: 53984 - DNA, 20 bp, Homo sapiens
gatcattaagaccacggagc

SEQ ID NO: 53985 - DNA, 20 bp, Homo sapiens
gatcactgcagaagaggcca

SEQ ID NO: 53986 - DNA, 20 bp, Homo sapiens
gatcgtgcacaggaatctca

SEQ ID NO: 53987 - DNA, 20 bp, Homo sapiens
gatcagctttgacaacagtg

SEQ ID NO: 53988 - DNA, 20 bp, Homo sapiens
gatctagctaatctcggtag

SEQ ID NO: 53989 - DNA, 20 bp, Homo sapiens
gatcagcacaaagtacttct

SEQ ID NO: 53990 - DNA, 20 bp, Homo sapiens
gatcgccttatttatattca

SEQ ID NO: 53991 - DNA, 20 bp, Homo sapiens
gatcattttttcatcattgg

SEQ ID NO: 53992 - DNA, 20 bp, Homo sapiens
gatctattcttcttcttaga

SEQ ID NO: 53993 - DNA, 20 bp, Homo sapiens
gatcccgcgggctccgggct

SEQ ID NO: 53994 - DNA, 20 bp, Homo sapiens
gatctgcgggaggcaccggc

SEQ ID NO: 53995 - DNA, 20 bp, Homo sapiens
gatcaattgttaattgtaat

SEQ ID NO: 53996 - DNA, 20 bp, Homo sapiens
gatcagctttacttgggtag

SEQ ID NO: 53997 - DNA, 20 bp, Homo sapiens
gatcctttcagccggcctga

SEQ ID NO: 53998 - DNA, 20 bp, Homo sapiens
gatcaacaataaaaaaaaac

SEQ ID NO: 53999 - DNA, 20 bp, Homo sapiens
gatctaaaagtagtcttcat

SEQ ID NO: 54000 - DNA, 20 bp, Homo sapiens
gatcgactgaggtgccagga

SEQ ID NO: 54001 - DNA, 20 bp, Homo sapiens
gatctcctacccactcaagc

SEQ ID NO: 54002 - DNA, 20 bp, Homo sapiens
gatcgggtcttccaggaggt

SEQ ID NO: 54003 - DNA, 20 bp, Homo sapiens
gatctggggtagggggcacc

SEQ ID NO: 54004 - DNA, 20 bp, Homo sapiens
gatctgagaatgtccttctt

SEQ ID NO: 54005 - DNA, 20 bp, Homo sapiens
gatccataattttggcagat

SEQ ID NO: 54006 - DNA, 20 bp, Homo sapiens
gatccggatgagcaattgga

SEQ ID NO: 54007 - DNA, 20 bp, Homo sapiens
gatctcataagggtgggtcc

SEQ ID NO: 54008 - DNA, 20 bp, Homo sapiens
gatctccagaactagacgcc

SEQ ID NO: 54009 - DNA, 20 bp, Homo sapiens
gatcaatcagaagctcataa

SEQ ID NO: 54010 - DNA, 20 bp, Homo sapiens
gatcgctgacaaagcattct

SEQ ID NO: 54011 - DNA, 20 bp, Homo sapiens
gatctaccggactgagatgg

SEQ ID NO: 54012 - DNA, 20 bp, Homo sapiens
gatcagtaataaaatatttc

SEQ ID NO: 54013 - DNA, 20 bp, Homo sapiens
gatcgcctttgctttaccac

SEQ ID NO: 54014 - DNA, 20 bp, Homo sapiens
gatcggggcccgggcagccg

SEQ ID NO: 54015 - DNA, 20 bp, Homo sapiens
gatcacaagccaacacactc

SEQ ID NO: 54016 - DNA, 20 bp, Homo sapiens
gatcccactcctaggacatg

SEQ ID NO: 54017 - DNA, 20 bp, Homo sapiens
gatcatgagaccacagttct

SEQ ID NO: 54018 - DNA, 20 bp, Homo sapiens
gatcccaccttctgtggccc

SEQ ID NO: 54019 - DNA, 20 bp, Homo sapiens
gatccgctcccagacggcct

SEQ ID NO: 54020 - DNA, 20 bp, Homo sapiens
gatctccaagacttcctggg

SEQ ID NO: 54021 - DNA, 20 bp, Homo sapiens
gatccgtccacctcggcctt

SEQ ID NO: 54022 - DNA, 20 bp, Homo sapiens
gatctaaaacaagtttaacc

SEQ ID NO: 54023 - DNA, 20 bp, Homo sapiens
gatcgctccgccgtgagtat

SEQ ID NO: 54024 - DNA, 20 bp, Homo sapiens
gatcatatgcatatgtgtag

SEQ ID NO: 54025 - DNA, 20 bp, Homo sapiens
gatcccagcctggccagagc

SEQ ID NO: 54026 - DNA, 20 bp, Homo sapiens
gatcccctatcagggggaca

SEQ ID NO: 54027 - DNA, 20 bp, Homo sapiens
gatcccctttcccacatccg

SEQ ID NO: 54028 - DNA, 20 bp, Homo sapiens
gatccgagataagtatgggc

SEQ ID NO: 54029 - DNA, 20 bp, Homo sapiens
gatcgcctgggaggtgaggt

SEQ ID NO: 54030 - DNA, 20 bp, Homo sapiens
gatcacccaaggaagtcact

SEQ ID NO: 54031 - DNA, 20 bp, Homo sapiens
gatcctgactttctagccat

SEQ ID NO: 54032 - DNA, 20 bp, Homo sapiens
gatcattaaaacctataaag

SEQ ID NO: 54033 - DNA, 20 bp, Homo sapiens
gatcattgttgtttcattgt

SEQ ID NO: 54034 - DNA, 20 bp, Homo sapiens
gatccctgctgctcatactt

SEQ ID NO: 54035 - DNA, 20 bp, Homo sapiens
gatcttgtttaaacaatgtt

SEQ ID NO: 54036 - DNA, 20 bp, Homo sapiens
gatctttcccttttggatgt

SEQ ID NO: 54037 - DNA, 20 bp, Homo sapiens
gatcagaaaaagaaaagagt

SEQ ID NO: 54038 - DNA, 20 bp, Homo sapiens
gatcactagtaatggcacaa

SEQ ID NO: 54039 - DNA, 20 bp, Homo sapiens
gatcatgtttttttcccccc

SEQ ID NO: 54040 - DNA, 20 bp, Homo sapiens
gatcaattgtaatttatttt

SEQ ID NO: 54041 - DNA, 20 bp, Homo sapiens
gatcactttagctttctact

SEQ ID NO: 54042 - DNA, 20 bp, Homo sapiens
gatcctaaatatgacagtgg

SEQ ID NO: 54043 - DNA, 20 bp, Homo sapiens
gatctgtcatccatatttgc

SEQ ID NO: 54044 - DNA, 20 bp, Homo sapiens
gatcctgagcgcagtcctgg

SEQ ID NO: 54045 - DNA, 20 bp, Homo sapiens
gatcgcttcggccctggagc

SEQ ID NO: 54046 - DNA, 20 bp, Homo sapiens
gatcggggttgaaagtcagc

SEQ ID NO: 54047 - DNA, 20 bp, Homo sapiens
gatcatcatttggaaagaat

SEQ ID NO: 54048 - DNA, 20 bp, Homo sapiens
gatctctgctgtgcaggtgc

SEQ ID NO: 54049 - DNA, 20 bp, Homo sapiens
gatctttacaattcattgca

SEQ ID NO: 54050 - DNA, 20 bp, Homo sapiens
gatcttatttttgatttcac

SEQ ID NO: 54051 - DNA, 20 bp, Homo sapiens
gatccttggacacctcctct

SEQ ID NO: 54052 - DNA, 20 bp, Homo sapiens
gatcactgttgaaggtgttc

SEQ ID NO: 54053 - DNA, 20 bp, Homo sapiens
gatccccaattgactcagag

SEQ ID NO: 54054 - DNA, 20 bp, Homo sapiens
gatcgtggtaccttatggaa

SEQ ID NO: 54055 - DNA, 20 bp, Homo sapiens
gatcaattgaaatcaactgt

SEQ ID NO: 54056 - DNA, 20 bp, Homo sapiens
gatcaaacattattttataa

SEQ ID NO: 54057 - DNA, 20 bp, Homo sapiens
gatcaacaacaagctttgtc

SEQ ID NO: 54058 - DNA, 20 bp, Homo sapiens
gatcagattcactgtttcat

SEQ ID NO: 54059 - DNA, 20 bp, Homo sapiens
gatccagtatgtgcttgtct

SEQ ID NO: 54060 - DNA, 20 bp, Homo sapiens
gatcgtgccattcccttaac

SEQ ID NO: 54061 - DNA, 20 bp, Homo sapiens
gatctatgtagaacctaaag

SEQ ID NO: 54062 - DNA, 20 bp, Homo sapiens
gatctctttctctcttttgt

SEQ ID NO: 54063 - DNA, 20 bp, Homo sapiens
gatctcttttgtgtgcacat

SEQ ID NO: 54064 - DNA, 20 bp, Homo sapiens
gatcgtggggatttgccgca

SEQ ID NO: 54065 - DNA, 20 bp, Homo sapiens
gatcagctatgctatcaaga

SEQ ID NO: 54066 - DNA, 20 bp, Homo sapiens
gatccctcctcttctcggag

SEQ ID NO: 54067 - DNA, 20 bp, Homo sapiens
gatcggcatggctgacgctc

SEQ ID NO: 54068 - DNA, 20 bp, Homo sapiens
gatctgtttagaggtcgaag

SEQ ID NO: 54069 - DNA, 20 bp, Homo sapiens
gatcggctggggaccccggg

SEQ ID NO: 54070 - DNA, 20 bp, Homo sapiens
gatcactcattgtacattct

SEQ ID NO: 54071 - DNA, 20 bp, Homo sapiens
gatcattcaaagctatctgt

SEQ ID NO: 54072 - DNA, 20 bp, Homo sapiens
gatctctaattggaattata

SEQ ID NO: 54073 - DNA, 20 bp, Homo sapiens
gatctggtgaacgaataatc

SEQ ID NO: 54074 - DNA, 20 bp, Homo sapiens
gatcatttttaaatcacttt

SEQ ID NO: 54075 - DNA, 20 bp, Homo sapiens
gatcttacctgtaccagaaa

SEQ ID NO: 54076 - DNA, 20 bp, Homo sapiens
gatcacctctacttggaagg

SEQ ID NO: 54077 - DNA, 20 bp, Homo sapiens
gatcctaacaattggcatga

SEQ ID NO: 54078 - DNA, 20 bp, Homo sapiens
gatcggggttaccacatgta

SEQ ID NO: 54079 - DNA, 20 bp, Homo sapiens
gatccattttaggtcttttt

SEQ ID NO: 54080 - DNA, 20 bp, Homo sapiens
gatcggtcctgtttatcagc

SEQ ID NO: 54081 - DNA, 20 bp, Homo sapiens
gatctggactctagaagtgc

SEQ ID NO: 54082 - DNA, 20 bp, Homo sapiens
gatcgtaaatttaatgctgg

SEQ ID NO: 54083 - DNA, 20 bp, Homo sapiens
gatcagaggcacactgtcca

SEQ ID NO: 54084 - DNA, 20 bp, Homo sapiens
gatctgcacgccgctgaccc

SEQ ID NO: 54085 - DNA, 20 bp, Homo sapiens
gatcggcctcctcttcaccc

SEQ ID NO: 54086 - DNA, 20 bp, Homo sapiens
gatcaattagaaccacaacc

SEQ ID NO: 54087 - DNA, 20 bp, Homo sapiens
gatccatggaaataatgtga

SEQ ID NO: 54088 - DNA, 20 bp, Homo sapiens
gatcatttattttaatgctt

SEQ ID NO: 54089 - DNA, 20 bp, Homo sapiens
gatccacctcatttgcagat

SEQ ID NO: 54090 - DNA, 20 bp, Homo sapiens
gatcctgaacaactagatgt

SEQ ID NO: 54091 - DNA, 20 bp, Homo sapiens
gatctaagaaatagaattag

SEQ ID NO: 54092 - DNA, 20 bp, Homo sapiens
gatcagccgcttggcagagc

SEQ ID NO: 54093 - DNA, 20 bp, Homo sapiens
gatcttggtgccagctgctt

SEQ ID NO: 54094 - DNA, 20 bp, Homo sapiens
gatcacaggcctggccgcgg

SEQ ID NO: 54095 - DNA, 20 bp, Homo sapiens
gatcccccgccccatcctcc

SEQ ID NO: 54096 - DNA, 20 bp, Homo sapiens
gatcccggtaataaatagtc

SEQ ID NO: 54097 - DNA, 20 bp, Homo sapiens
gatctcgagccccggccccc

SEQ ID NO: 54098 - DNA, 20 bp, Homo sapiens
gatctctgcagagaacctgg

SEQ ID NO: 54099 - DNA, 20 bp, Homo sapiens
gatcagaacagtgccagggt

SEQ ID NO: 54100 - DNA, 20 bp, Homo sapiens
gatccaagcatatttgcttg

SEQ ID NO: 54101 - DNA, 20 bp, Homo sapiens
gatccaacattagacgtgtg

SEQ ID NO: 54102 - DNA, 20 bp, Homo sapiens
gatcgcttttctcagactca

SEQ ID NO: 54103 - DNA, 20 bp, Homo sapiens
gatctagtccttgtcttgta

SEQ ID NO: 54104 - DNA, 20 bp, Homo sapiens
gatccagagaaaacaaaata

SEQ ID NO: 54105 - DNA, 20 bp, Homo sapiens
gatcttttccatctgagggt

SEQ ID NO: 54106 - DNA, 20 bp, Homo sapiens
gatcacccagtcttcggaga

SEQ ID NO: 54107 - DNA, 20 bp, Homo sapiens
gatcgaattgtttcttctaa

SEQ ID NO: 54108 - DNA, 20 bp, Homo sapiens
gatctgctaatgctgtttgg

SEQ ID NO: 54109 - DNA, 20 bp, Homo sapiens
gatcctccagagacagcgct

SEQ ID NO: 54110 - DNA, 20 bp, Homo sapiens
gatcctgcccccaacctcca

SEQ ID NO: 54111 - DNA, 20 bp, Homo sapiens
gatctcaggcagggtgtgcg

SEQ ID NO: 54112 - DNA, 20 bp, Homo sapiens
gatctggcccgagctctcct

SEQ ID NO: 54113 - DNA, 20 bp, Homo sapiens
gatcacatagccatcctaag

SEQ ID NO: 54114 - DNA, 20 bp, Homo sapiens
gatcaccacttccccaaaga

SEQ ID NO: 54115 - DNA, 20 bp, Homo sapiens
gatcacgcccccgagtttat

SEQ ID NO: 54116 - DNA, 20 bp, Homo sapiens
gatccccagtgatttttatg

SEQ ID NO: 54117 - DNA, 20 bp, Homo sapiens
gatcctgcatttctaacaag

SEQ ID NO: 54118 - DNA, 20 bp, Homo sapiens
gatctttattttagggattg

SEQ ID NO: 54119 - DNA, 20 bp, Homo sapiens
gatctgccaaagaaggttgt

SEQ ID NO: 54120 - DNA, 20 bp, Homo sapiens
gatctatgtgaccaaatgtt

SEQ ID NO: 54121 - DNA, 20 bp, Homo sapiens
gatcaatatatttttctaat

SEQ ID NO: 54122 - DNA, 20 bp, Homo sapiens
gatctgtaaagttgattggt

SEQ ID NO: 54123 - DNA, 20 bp, Homo sapiens
gatcagtcattgaaaattgg

SEQ ID NO: 54124 - DNA, 20 bp, Homo sapiens
gatcaacagcccaaagattt

SEQ ID NO: 54125 - DNA, 20 bp, Homo sapiens
gatcaccaaccacggcgtgg

SEQ ID NO: 54126 - DNA, 20 bp, Homo sapiens
gatcgccagcccttccgccc

SEQ ID NO: 54127 - DNA, 20 bp, Homo sapiens
gatctgtttctgattcaaca

SEQ ID NO: 54128 - DNA, 20 bp, Homo sapiens
gatcagttggactaaggatg

SEQ ID NO: 54129 - DNA, 20 bp, Homo sapiens
gatctctatgcccttttctc

SEQ ID NO: 54130 - DNA, 20 bp, Homo sapiens
gatcctttgtttcataaagt

SEQ ID NO: 54131 - DNA, 20 bp, Homo sapiens
gatccgcccctccgggtacg

SEQ ID NO: 54132 - DNA, 20 bp, Homo sapiens
gatcacttggtatcctttgg

SEQ ID NO: 54133 - DNA, 20 bp, Homo sapiens
gatctaacactaggaaaata

SEQ ID NO: 54134 - DNA, 20 bp, Homo sapiens
gatctcctctggttcttcag

SEQ ID NO: 54135 - DNA, 20 bp, Homo sapiens
gatctcctcttccaagacac

SEQ ID NO: 54136 - DNA, 20 bp, Homo sapiens
gatccaacccctggcctcct

SEQ ID NO: 54137 - DNA, 20 bp, Homo sapiens
gatcccggcctgttctcctt

SEQ ID NO: 54138 - DNA, 20 bp, Homo sapiens
gatccagaagtcctcgtagg

SEQ ID NO: 54139 - DNA, 20 bp, Homo sapiens
gatctacccgcagcaagtgt

SEQ ID NO: 54140 - DNA, 20 bp, Homo sapiens
gatcaacttaggaattagcc

SEQ ID NO: 54141 - DNA, 20 bp, Homo sapiens
gatcagagatttgaggagag

SEQ ID NO: 54142 - DNA, 20 bp, Homo sapiens
gatcctttcaatatgacagt

SEQ ID NO: 54143 - DNA, 20 bp, Homo sapiens
gatcctcccaaacacaatga

SEQ ID NO: 54144 - DNA, 20 bp, Homo sapiens
gatctgtgacctcggacccg

SEQ ID NO: 54145 - DNA, 20 bp, Homo sapiens
gatcttttcttccctctctc

SEQ ID NO: 54146 - DNA, 20 bp, Homo sapiens
gatcattaaaagtaatggaa

SEQ ID NO: 54147 - DNA, 20 bp, Homo sapiens
gatcgctatgtgcaatactg

SEQ ID NO: 54148 - DNA, 20 bp, Homo sapiens
gatctttgttaaatgcccta

SEQ ID NO: 54149 - DNA, 20 bp, Homo sapiens
gatcattttcacctctttcc

SEQ ID NO: 54150 - DNA, 20 bp, Homo sapiens
gatcccgtacgccacgcacc

SEQ ID NO: 54151 - DNA, 20 bp, Homo sapiens
gatcgatgaagtggtcataa

SEQ ID NO: 54152 - DNA, 20 bp, Homo sapiens
gatcactgaagttgaaaaag

SEQ ID NO: 54153 - DNA, 20 bp, Homo sapiens
gatccgtccccctggcccct

SEQ ID NO: 54154 - DNA, 20 bp, Homo sapiens
gatcgtcattgccaaggcct

SEQ ID NO: 54155 - DNA, 20 bp, Homo sapiens
gatcccaaggggagagctca

SEQ ID NO: 54156 - DNA, 20 bp, Homo sapiens
gatccgtgaggtatgagtat

SEQ ID NO: 54157 - DNA, 20 bp, Homo sapiens
gatcctatagaagatataaa

SEQ ID NO: 54158 - DNA, 20 bp, Homo sapiens
gatccaaacccaagtcttga

SEQ ID NO: 54159 - DNA, 20 bp, Homo sapiens
gatcatatatgaatatcatc

SEQ ID NO: 54160 - DNA, 20 bp, Homo sapiens
gatctttagcagtcttttct

SEQ ID NO: 54161 - DNA, 20 bp, Homo sapiens
gatcatctcaaaggtgatgc

SEQ ID NO: 54162 - DNA, 20 bp, Homo sapiens
gatcgtgtttccattcactt

SEQ ID NO: 54163 - DNA, 20 bp, Homo sapiens
gatctacagaagaatcttgt

SEQ ID NO: 54164 - DNA, 20 bp, Homo sapiens
gatcagagcgtgggaggagg

SEQ ID NO: 54165 - DNA, 20 bp, Homo sapiens
gatcacagcctatcttactt

SEQ ID NO: 54166 - DNA, 20 bp, Homo sapiens
gatcataaaactcttcatca

SEQ ID NO: 54167 - DNA, 20 bp, Homo sapiens
gatccttagaacaaaaaaaa

SEQ ID NO: 54168 - DNA, 20 bp, Homo sapiens
gatctgtctagattcttatt

SEQ ID NO: 54169 - DNA, 20 bp, Homo sapiens
gatccaaaataaatggactg

SEQ ID NO: 54170 - DNA, 20 bp, Homo sapiens
gatccaaagaactttagcta

SEQ ID NO: 54171 - DNA, 20 bp, Homo sapiens
gatctagttattatccaaca

SEQ ID NO: 54172 - DNA, 20 bp, Homo sapiens
gatctcagataaagtgacca

SEQ ID NO: 54173 - DNA, 20 bp, Homo sapiens
gatccaagtattttatctgt

SEQ ID NO: 54174 - DNA, 20 bp, Homo sapiens
gatctggatgcatgtggatg

SEQ ID NO: 54175 - DNA, 20 bp, Homo sapiens
gatcaaacacgcacggcact

SEQ ID NO: 54176 - DNA, 20 bp, Homo sapiens
gatcaaataacttggataca

SEQ ID NO: 54177 - DNA, 20 bp, Homo sapiens
gatcccaagtcaaacagtgt

SEQ ID NO: 54178 - DNA, 20 bp, Homo sapiens
gatctggtgcgtgtggccct

SEQ ID NO: 54179 - DNA, 20 bp, Homo sapiens
gatctttcctgctttttttt

SEQ ID NO: 54180 - DNA, 20 bp, Homo sapiens
gatcctcggggaactggcca

SEQ ID NO: 54181 - DNA, 20 bp, Homo sapiens
gatcaactcaccgccaacag

SEQ ID NO: 54182 - DNA, 20 bp, Homo sapiens
gatcaccattcccgtgcaga

SEQ ID NO: 54183 - DNA, 20 bp, Homo sapiens
gatcagggtcagtctaggag

SEQ ID NO: 54184 - DNA, 20 bp, Homo sapiens
gatcccaccagtctgctcac

SEQ ID NO: 54185 - DNA, 20 bp, Homo sapiens
gatcccagaaggacctcctg

SEQ ID NO: 54186 - DNA, 20 bp, Homo sapiens
gatccgcacgcagtatgagg

SEQ ID NO: 54187 - DNA, 20 bp, Homo sapiens
gatcgagccgcagccgcagc

SEQ ID NO: 54188 - DNA, 20 bp, Homo sapiens
gatctgttgtgtacgtggag

SEQ ID NO: 54189 - DNA, 20 bp, Homo sapiens
gatcattcggcatgaagatg

SEQ ID NO: 54190 - DNA, 20 bp, Homo sapiens
gatcaagaagtcacctttga

SEQ ID NO: 54191 - DNA, 20 bp, Homo sapiens
gatctcctggtagcatgacc

SEQ ID NO: 54192 - DNA, 20 bp, Homo sapiens
gatcttcatctgcttcacaa

SEQ ID NO: 54193 - DNA, 20 bp, Homo sapiens
gatcccctcatcacccctgt

SEQ ID NO: 54194 - DNA, 20 bp, Homo sapiens
gatcccgaggtcaggagttt

SEQ ID NO: 54195 - DNA, 20 bp, Homo sapiens
gatccctgcttggctcactt

SEQ ID NO: 54196 - DNA, 20 bp, Homo sapiens
gatcctgcaatgaatgcacg

SEQ ID NO: 54197 - DNA, 20 bp, Homo sapiens
gatcgcaggaggcctggccg

SEQ ID NO: 54198 - DNA, 20 bp, Homo sapiens
gatcgtgcagtttagcgacg

SEQ ID NO: 54199 - DNA, 20 bp, Homo sapiens
gatctttttgcttttccacc

SEQ ID NO: 54200 - DNA, 20 bp, Homo sapiens
gatcctttttcaatgtaaca

SEQ ID NO: 54201 - DNA, 20 bp, Homo sapiens
gatcacatacttaaagatgt

SEQ ID NO: 54202 - DNA, 20 bp, Homo sapiens
gatcagtggccatattactg

SEQ ID NO: 54203 - DNA, 20 bp, Homo sapiens
gatcattcttcaatagtcta

SEQ ID NO: 54204 - DNA, 20 bp, Homo sapiens
gatctctatggggatttcaa

SEQ ID NO: 54205 - DNA, 20 bp, Homo sapiens
gatctctttgtgatttaaga

SEQ ID NO: 54206 - DNA, 20 bp, Homo sapiens
gatcttcagacaaaatttcc

SEQ ID NO: 54207 - DNA, 20 bp, Homo sapiens
gatcttttctacaagctcct

SEQ ID NO: 54208 - DNA, 20 bp, Homo sapiens
gatcacatggttcactacca

SEQ ID NO: 54209 - DNA, 20 bp, Homo sapiens
gatcataaaaaaattgtttt

SEQ ID NO: 54210 - DNA, 20 bp, Homo sapiens
gatctggtggctatttccac

SEQ ID NO: 54211 - DNA, 20 bp, Homo sapiens
gatcatttcataaagagcaa

SEQ ID NO: 54212 - DNA, 20 bp, Homo sapiens
gatcattttgtcaaagtgtt

SEQ ID NO: 54213 - DNA, 20 bp, Homo sapiens
gatccaattttcattattct

SEQ ID NO: 54214 - DNA, 20 bp, Homo sapiens
gatccacttcctcatgatac

SEQ ID NO: 54215 - DNA, 20 bp, Homo sapiens
gatccatataactgttgggt

SEQ ID NO: 54216 - DNA, 20 bp, Homo sapiens
gatctatttaggtggaaata

SEQ ID NO: 54217 - DNA, 20 bp, Homo sapiens
gatctttaaaataagcatac

SEQ ID NO: 54218 - DNA, 20 bp, Homo sapiens
gatctctcctgctgtaaccc

SEQ ID NO: 54219 - DNA, 20 bp, Homo sapiens
gatcgaaaactgttcctcaa

SEQ ID NO: 54220 - DNA, 20 bp, Homo sapiens
gatctctcctgatttaccag

SEQ ID NO: 54221 - DNA, 20 bp, Homo sapiens
gatccctgggttgccctgtc

SEQ ID NO: 54222 - DNA, 20 bp, Homo sapiens
gatcccaatggtgtgagtct

SEQ ID NO: 54223 - DNA, 20 bp, Homo sapiens
gatctgtcccttccccgagg

SEQ ID NO: 54224 - DNA, 20 bp, Homo sapiens
gatccgtcttgactgtgatt

SEQ ID NO: 54225 - DNA, 20 bp, Homo sapiens
gatcccacagcaatccatca

SEQ ID NO: 54226 - DNA, 20 bp, Homo sapiens
gatcaaatgcttttgtgtta

SEQ ID NO: 54227 - DNA, 20 bp, Homo sapiens
gatcagtcacactgacattc

SEQ ID NO: 54228 - DNA, 20 bp, Homo sapiens
gatcctaaggtaatataata

SEQ ID NO: 54229 - DNA, 20 bp, Homo sapiens
gatctctcgtgattgataag

SEQ ID NO: 54230 - DNA, 20 bp, Homo sapiens
gatctgtgattagggacagc

SEQ ID NO: 54231 - DNA, 20 bp, Homo sapiens
gatccctcggtcagcaccgt

SEQ ID NO: 54232 - DNA, 20 bp, Homo sapiens
gatctgagaggttgagcggg

SEQ ID NO: 54233 - DNA, 20 bp, Homo sapiens
gatcttcctgattttcatcg

SEQ ID NO: 54234 - DNA, 20 bp, Homo sapiens
gatcccagtgaaaacttccg

SEQ ID NO: 54235 - DNA, 20 bp, Homo sapiens
gatccttgctctacctggct

SEQ ID NO: 54236 - DNA, 20 bp, Homo sapiens
gatcagaagccttcagatag

SEQ ID NO: 54237 - DNA, 20 bp, Homo sapiens
gatcactttattactctgaa

SEQ ID NO: 54238 - DNA, 20 bp, Homo sapiens
gatcctggatgggaagaagt

SEQ ID NO: 54239 - DNA, 20 bp, Homo sapiens
gatcttatgcactgtgtacg

SEQ ID NO: 54240 - DNA, 20 bp, Homo sapiens
gatcgctgagcccgaccttg

SEQ ID NO: 54241 - DNA, 20 bp, Homo sapiens
gatcagtgtgataaggactt

SEQ ID NO: 54242 - DNA, 20 bp, Homo sapiens
gatcccggagtgcgcagttt

SEQ ID NO: 54243 - DNA, 20 bp, Homo sapiens
gatcgtcaagtacgaccgcg

SEQ ID NO: 54244 - DNA, 20 bp, Homo sapiens
gatcgttttctaagtgcaat

SEQ ID NO: 54245 - DNA, 20 bp, Homo sapiens
gatcatgttccccccaaatg

SEQ ID NO: 54246 - DNA, 20 bp, Homo sapiens
gatccccccagctcagaaca

SEQ ID NO: 54247 - DNA, 20 bp, Homo sapiens
gatcacagctgcccagaggg

SEQ ID NO: 54248 - DNA, 20 bp, Homo sapiens
gatcatcgtatgcaacagct

SEQ ID NO: 54249 - DNA, 20 bp, Homo sapiens
gatccacacctggatactgc

SEQ ID NO: 54250 - DNA, 20 bp, Homo sapiens
gatctagaaaatgcaagcaa

SEQ ID NO: 54251 - DNA, 20 bp, Homo sapiens
gatctcagcaacacagcaag

SEQ ID NO: 54252 - DNA, 20 bp, Homo sapiens
gatcgtgcaggccatttaca

SEQ ID NO: 54253 - DNA, 20 bp, Homo sapiens
gatctacgccaacttctttc

SEQ ID NO: 54254 - DNA, 20 bp, Homo sapiens
gatctccagcatctcctccc

SEQ ID NO: 54255 - DNA, 20 bp, Homo sapiens
gatcttcttgaactcatcca

SEQ ID NO: 54256 - DNA, 20 bp, Homo sapiens
gatcacatagtcaggaggtg

SEQ ID NO: 54257 - DNA, 20 bp, Homo sapiens
gatcactgtggggtcaagaa

SEQ ID NO: 54258 - DNA, 20 bp, Homo sapiens
gatcttcaggaaatatttgt

SEQ ID NO: 54259 - DNA, 20 bp, Homo sapiens
gatcatccgggccgcctgcc

SEQ ID NO: 54260 - DNA, 20 bp, Homo sapiens
gatctgaagtagtgtgagtg

SEQ ID NO: 54261 - DNA, 20 bp, Homo sapiens
gatcagctggcgcgcgcccc

SEQ ID NO: 54262 - DNA, 20 bp, Homo sapiens
gatcaggggctcagaggctg

SEQ ID NO: 54263 - DNA, 20 bp, Homo sapiens
gatctgaacaaccttgctct

SEQ ID NO: 54264 - DNA, 20 bp, Homo sapiens
gatcttactattaggatatt

SEQ ID NO: 54265 - DNA, 20 bp, Homo sapiens
gatcgcccaaaggacactgc

SEQ ID NO: 54266 - DNA, 20 bp, Homo sapiens
gatcactgccagagataaac

SEQ ID NO: 54267 - DNA, 20 bp, Homo sapiens
gatcagaacgagctgttaga

SEQ ID NO: 54268 - DNA, 20 bp, Homo sapiens
gatccttggcgtcttgcatt

SEQ ID NO: 54269 - DNA, 20 bp, Homo sapiens
gatcagtaaccatgggagaa

SEQ ID NO: 54270 - DNA, 20 bp, Homo sapiens
gatctccacgggttttcaca

SEQ ID NO: 54271 - DNA, 20 bp, Homo sapiens
gatcagccacaacctcaaac

SEQ ID NO: 54272 - DNA, 20 bp, Homo sapiens
gatccagaagaaatgagata

SEQ ID NO: 54273 - DNA, 20 bp, Homo sapiens
gatcccctccttctgttgtt

SEQ ID NO: 54274 - DNA, 20 bp, Homo sapiens
gatcccctgaactgcccagc

SEQ ID NO: 54275 - DNA, 20 bp, Homo sapiens
gatctgtctctgtattcctc

SEQ ID NO: 54276 - DNA, 20 bp, Homo sapiens
gatctttcctccctcccctg

SEQ ID NO: 54277 - DNA, 20 bp, Homo sapiens
gatcataaggcaatgcatga

SEQ ID NO: 54278 - DNA, 20 bp, Homo sapiens
gatcattttcagttgttcat

SEQ ID NO: 54279 - DNA, 20 bp, Homo sapiens
gatcaaggagcaatgtcagt

SEQ ID NO: 54280 - DNA, 20 bp, Homo sapiens
gatcatgcgcatcgcgcgca

SEQ ID NO: 54281 - DNA, 20 bp, Homo sapiens
gatccagcctatcctctctg

SEQ ID NO: 54282 - DNA, 20 bp, Homo sapiens
gatccctggggcaggcctct

SEQ ID NO: 54283 - DNA, 20 bp, Homo sapiens
gatcctgaatccaacagaca

SEQ ID NO: 54284 - DNA, 20 bp, Homo sapiens
gatctggcatcttctcccac

SEQ ID NO: 54285 - DNA, 20 bp, Homo sapiens
gatccaccacccttccccca

SEQ ID NO: 54286 - DNA, 20 bp, Homo sapiens
gatcgtcgttatcctcgagg

SEQ ID NO: 54287 - DNA, 20 bp, Homo sapiens
gatccctggccgggcctctc

SEQ ID NO: 54288 - DNA, 20 bp, Homo sapiens
gatctacccaactctgtcat

SEQ ID NO: 54289 - DNA, 20 bp, Homo sapiens
gatccctcagacagcatggc

SEQ ID NO: 54290 - DNA, 20 bp, Homo sapiens
gatcgagcaagggaagctga

SEQ ID NO: 54291 - DNA, 20 bp, Homo sapiens
gatcgtgcgctccagcagct

SEQ ID NO: 54292 - DNA, 20 bp, Homo sapiens
gatcttttacttgttaacaa

SEQ ID NO: 54293 - DNA, 20 bp, Homo sapiens
gatcagactcttccacctaa

SEQ ID NO: 54294 - DNA, 20 bp, Homo sapiens
gatctaactaaaacagagct

SEQ ID NO: 54295 - DNA, 20 bp, Homo sapiens
gatctgcacatctgttttgc

SEQ ID NO: 54296 - DNA, 20 bp, Homo sapiens
gatctttgggagataaagca

SEQ ID NO: 54297 - DNA, 20 bp, Homo sapiens
gatctcgtctgccctcattc

SEQ ID NO: 54298 - DNA, 20 bp, Homo sapiens
gatctcgccattgtctgggt

SEQ ID NO: 54299 - DNA, 20 bp, Homo sapiens
gatctgtcccccagccaaac

SEQ ID NO: 54300 - DNA, 20 bp, Homo sapiens
gatcacatctgcccaaaggt

SEQ ID NO: 54301 - DNA, 20 bp, Homo sapiens
gatctccagccagtggctca

SEQ ID NO: 54302 - DNA, 20 bp, Homo sapiens
gatcagtccctttacttttt

SEQ ID NO: 54303 - DNA, 20 bp, Homo sapiens
gatcctctaatctttctaca

SEQ ID NO: 54304 - DNA, 20 bp, Homo sapiens
gatctaaattaaattggaaa

SEQ ID NO: 54305 - DNA, 20 bp, Homo sapiens
gatctttctctccaagaaac

SEQ ID NO: 54306 - DNA, 20 bp, Homo sapiens
gatcaagcctgtggtggact

SEQ ID NO: 54307 - DNA, 20 bp, Homo sapiens
gatcactgttgttttttgaa

SEQ ID NO: 54308 - DNA, 20 bp, Homo sapiens
gatcagcttgactcaatgtc

SEQ ID NO: 54309 - DNA, 20 bp, Homo sapiens
gatcatggagcaccctggag

SEQ ID NO: 54310 - DNA, 20 bp, Homo sapiens
gatcccaagtgctggtcggc

SEQ ID NO: 54311 - DNA, 20 bp, Homo sapiens
gatcggaattcagggcgacg

SEQ ID NO: 54312 - DNA, 20 bp, Homo sapiens
gatcgtttccaagaaggggt

SEQ ID NO: 54313 - DNA, 20 bp, Homo sapiens
gatctgatgggacacggcca

SEQ ID NO: 54314 - DNA, 20 bp, Homo sapiens
gatctgtctcacctccccca

SEQ ID NO: 54315 - DNA, 20 bp, Homo sapiens
gatctataaaaagtcaattg

SEQ ID NO: 54316 - DNA, 20 bp, Homo sapiens
gatctcagtctctctgtctc

SEQ ID NO: 54317 - DNA, 20 bp, Homo sapiens
gatcttacactgagtgtaga

SEQ ID NO: 54318 - DNA, 20 bp, Homo sapiens
gatctgcgttgtgagcttcc

SEQ ID NO: 54319 - DNA, 20 bp, Homo sapiens
gatcaagtaaaatggaacta

SEQ ID NO: 54320 - DNA, 20 bp, Homo sapiens
gatcaatttccaagtagtaa

SEQ ID NO: 54321 - DNA, 20 bp, Homo sapiens
gatcttttgttacatggact

SEQ ID NO: 54322 - DNA, 20 bp, Homo sapiens
gatcctagaggctgctagac

SEQ ID NO: 54323 - DNA, 20 bp, Homo sapiens
gatcagtgatgatgctttta

SEQ ID NO: 54324 - DNA, 20 bp, Homo sapiens
gatcattcacacatgtgtcc

SEQ ID NO: 54325 - DNA, 20 bp, Homo sapiens
gatctacctgcaacacaaca

SEQ ID NO: 54326 - DNA, 20 bp, Homo sapiens
gatcagctgagccttacggc

SEQ ID NO: 54327 - DNA, 20 bp, Homo sapiens
gatcagttacagtagttttc

SEQ ID NO: 54328 - DNA, 20 bp, Homo sapiens
gatccaacataactcagaca

SEQ ID NO: 54329 - DNA, 20 bp, Homo sapiens
gatcttgaaatagtaatagt

SEQ ID NO: 54330 - DNA, 20 bp, Homo sapiens
gatcaacagtgaaacatgct

SEQ ID NO: 54331 - DNA, 20 bp, Homo sapiens
gatcgtcagcatcatcggag

SEQ ID NO: 54332 - DNA, 20 bp, Homo sapiens
gatctcaaataagccataga

SEQ ID NO: 54333 - DNA, 20 bp, Homo sapiens
gatcatcatgaagtctttat

SEQ ID NO: 54334 - DNA, 20 bp, Homo sapiens
gatcccgcagtccccgaggc

SEQ ID NO: 54335 - DNA, 20 bp, Homo sapiens
gatcgctgagcctgacgctc

SEQ ID NO: 54336 - DNA, 20 bp, Homo sapiens
gatccctcagaagacttaac

SEQ ID NO: 54337 - DNA, 20 bp, Homo sapiens
gatcgctgatttggaatcac

SEQ ID NO: 54338 - DNA, 20 bp, Homo sapiens
gatctgggagctgtccagcc

SEQ ID NO: 54339 - DNA, 20 bp, Homo sapiens
gatctaacatgaatttagat

SEQ ID NO: 54340 - DNA, 20 bp, Homo sapiens
gatcattcactatttgacaa

SEQ ID NO: 54341 - DNA, 20 bp, Homo sapiens
gatcaagagacatctttgct

SEQ ID NO: 54342 - DNA, 20 bp, Homo sapiens
gatcactttcaaatatgagt

SEQ ID NO: 54343 - DNA, 20 bp, Homo sapiens
gatcagaaagtgttatttaa

SEQ ID NO: 54344 - DNA, 20 bp, Homo sapiens
gatctctatcccaatagatt

SEQ ID NO: 54345 - DNA, 20 bp, Homo sapiens
gatctgaaagcactaaggaa

SEQ ID NO: 54346 - DNA, 20 bp, Homo sapiens
gatcagcgtgcggggtgtga

SEQ ID NO: 54347 - DNA, 20 bp, Homo sapiens
gatcctcccgtggtccctgg

SEQ ID NO: 54348 - DNA, 20 bp, Homo sapiens
gatctggggattttctaaag

SEQ ID NO: 54349 - DNA, 20 bp, Homo sapiens
gatcaatctcacagctcaga

SEQ ID NO: 54350 - DNA, 20 bp, Homo sapiens
gatcttcccctacagtgatt

SEQ ID NO: 54351 - DNA, 20 bp, Homo sapiens
gatctaagccacagtgggga

SEQ ID NO: 54352 - DNA, 20 bp, Homo sapiens
gatcaccatttatttcctat

SEQ ID NO: 54353 - DNA, 20 bp, Homo sapiens
gatcagcaaatgtttgttga

SEQ ID NO: 54354 - DNA, 20 bp, Homo sapiens
gatccccgacagtggctctc

SEQ ID NO: 54355 - DNA, 20 bp, Homo sapiens
gatcttccttccgctctgag

SEQ ID NO: 54356 - DNA, 20 bp, Homo sapiens
gatcttcgtttaaaaacaca

SEQ ID NO: 54357 - DNA, 20 bp, Homo sapiens
gatcctctggccaacacaca

SEQ ID NO: 54358 - DNA, 20 bp, Homo sapiens
gatcaaagaaccaggaggcc

SEQ ID NO: 54359 - DNA, 20 bp, Homo sapiens
gatcaaccatctctgttgtt

SEQ ID NO: 54360 - DNA, 20 bp, Homo sapiens
gatcatattttgctttctat

SEQ ID NO: 54361 - DNA, 20 bp, Homo sapiens
gatcttagctcactttccaa

SEQ ID NO: 54362 - DNA, 20 bp, Homo sapiens
gatcttcccataatcaaaag

SEQ ID NO: 54363 - DNA, 20 bp, Homo sapiens
gatccatctcactatttaat

SEQ ID NO: 54364 - DNA, 20 bp, Homo sapiens
gatcctcgcctcacccccgc

SEQ ID NO: 54365 - DNA, 20 bp, Homo sapiens
gatcactcaggaaaacagga

SEQ ID NO: 54366 - DNA, 20 bp, Homo sapiens
gatcgagtatgtgccccgaa

SEQ ID NO: 54367 - DNA, 20 bp, Homo sapiens
gatctgtccatattcaggaa

SEQ ID NO: 54368 - DNA, 20 bp, Homo sapiens
gatcactgctctccatccca

SEQ ID NO: 54369 - DNA, 20 bp, Homo sapiens
gatcatgtaagtcagctgtt

SEQ ID NO: 54370 - DNA, 20 bp, Homo sapiens
gatcgttttcctaatacagg

SEQ ID NO: 54371 - DNA, 20 bp, Homo sapiens
gatcatatattgattataca

SEQ ID NO: 54372 - DNA, 20 bp, Homo sapiens
gatcactctttcaaaagaca

SEQ ID NO: 54373 - DNA, 20 bp, Homo sapiens
gatcggtgattcggacactg

SEQ ID NO: 54374 - DNA, 20 bp, Homo sapiens
gatcttaaaggtcgacgtgg

SEQ ID NO: 54375 - DNA, 20 bp, Homo sapiens
gatcgggcctgtgggcgccg

SEQ ID NO: 54376 - DNA, 20 bp, Homo sapiens
gatctgagaggaggctgctg

SEQ ID NO: 54377 - DNA, 20 bp, Homo sapiens
gatcaggataattgaaatgg

SEQ ID NO: 54378 - DNA, 20 bp, Homo sapiens
gatcctctgtccaagagcgg

SEQ ID NO: 54379 - DNA, 20 bp, Homo sapiens
gatctgggaggtggaagcca

SEQ ID NO: 54380 - DNA, 20 bp, Homo sapiens
gatcaatctacttgtgtgtt

SEQ ID NO: 54381 - DNA, 20 bp, Homo sapiens
gatcagcgtatgtgtgtccc

SEQ ID NO: 54382 - DNA, 20 bp, Homo sapiens
gatcagctagatttgtgtcc

SEQ ID NO: 54383 - DNA, 20 bp, Homo sapiens
gatcagttcctttctgttaa

SEQ ID NO: 54384 - DNA, 20 bp, Homo sapiens
gatcattatatctattttct

SEQ ID NO: 54385 - DNA, 20 bp, Homo sapiens
gatcgtttgtaccagtaaaa

SEQ ID NO: 54386 - DNA, 20 bp, Homo sapiens
gatctactatgccagtttct

SEQ ID NO: 54387 - DNA, 20 bp, Homo sapiens
gatctctttgagccaaatca

SEQ ID NO: 54388 - DNA, 20 bp, Homo sapiens
gatctttactttgggtaaga

SEQ ID NO: 54389 - DNA, 20 bp, Homo sapiens
gatcaacaggaattgactcc

SEQ ID NO: 54390 - DNA, 20 bp, Homo sapiens
gatcatctcttgagaaacat

SEQ ID NO: 54391 - DNA, 20 bp, Homo sapiens
gatccctggcgaaagaaacc

SEQ ID NO: 54392 - DNA, 20 bp, Homo sapiens
gatctaagcaattagtttga

SEQ ID NO: 54393 - DNA, 20 bp, Homo sapiens
gatctttcctaagcatcgtt

SEQ ID NO: 54394 - DNA, 20 bp, Homo sapiens
gatcttttcaaaactggtag

SEQ ID NO: 54395 - DNA, 20 bp, Homo sapiens
gatcaggtcaggccaaataa

SEQ ID NO: 54396 - DNA, 20 bp, Homo sapiens
gatcatccatttagccttga

SEQ ID NO: 54397 - DNA, 20 bp, Homo sapiens
gatcccttgagattcactat

SEQ ID NO: 54398 - DNA, 20 bp, Homo sapiens
gatcacctgcgtgtcccatc

SEQ ID NO: 54399 - DNA, 20 bp, Homo sapiens
gatcatgagattcgtggtga

SEQ ID NO: 54400 - DNA, 20 bp, Homo sapiens
gatccccccagctggcagtg

SEQ ID NO: 54401 - DNA, 20 bp, Homo sapiens
gatctgattcggttccctgt

SEQ ID NO: 54402 - DNA, 20 bp, Homo sapiens
gatcttggggtgcagcactt

SEQ ID NO: 54403 - DNA, 20 bp, Homo sapiens
gatcacgaagcagtcgaacc

SEQ ID NO: 54404 - DNA, 20 bp, Homo sapiens
gatcacccatggctagacgc

SEQ ID NO: 54405 - DNA, 20 bp, Homo sapiens
gatcacgttccttcccccgc

SEQ ID NO: 54406 - DNA, 20 bp, Homo sapiens
gatccaagtacctggccaca

SEQ ID NO: 54407 - DNA, 20 bp, Homo sapiens
gatccagagcgactatctct

SEQ ID NO: 54408 - DNA, 20 bp, Homo sapiens
gatccatacgtggccgcacc

SEQ ID NO: 54409 - DNA, 20 bp, Homo sapiens
gatcgcagagccgacctcag

SEQ ID NO: 54410 - DNA, 20 bp, Homo sapiens
gatcttcacacagaaaggga

SEQ ID NO: 54411 - DNA, 20 bp, Homo sapiens
gatcatctgttgctatcccc

SEQ ID NO: 54412 - DNA, 20 bp, Homo sapiens
gatcactggctccatcatac

SEQ ID NO: 54413 - DNA, 20 bp, Homo sapiens
gatcatctcttcagagctgc

SEQ ID NO: 54414 - DNA, 20 bp, Homo sapiens
gatctagctgtccttctccg

SEQ ID NO: 54415 - DNA, 20 bp, Homo sapiens
gatccagtgttggagaggta

SEQ ID NO: 54416 - DNA, 20 bp, Homo sapiens
gatcatcaggaaagtgaaga

SEQ ID NO: 54417 - DNA, 20 bp, Homo sapiens
gatccatggggcccaggcct

SEQ ID NO: 54418 - DNA, 20 bp, Homo sapiens
gatcagcacagtgaaagtcc

SEQ ID NO: 54419 - DNA, 20 bp, Homo sapiens
gatctcttctaacaattatc

SEQ ID NO: 54420 - DNA, 20 bp, Homo sapiens
gatctagcctcatctggagt

SEQ ID NO: 54421 - DNA, 20 bp, Homo sapiens
gatcccacctcacttcctgc

SEQ ID NO: 54422 - DNA, 20 bp, Homo sapiens
gatcacagacctaaggccca

SEQ ID NO: 54423 - DNA, 20 bp, Homo sapiens
gatcaggagacggaaggcga

SEQ ID NO: 54424 - DNA, 20 bp, Homo sapiens
gatcctagtggcctgctttc

SEQ ID NO: 54425 - DNA, 20 bp, Homo sapiens
gatctgctgcgcctgccaga

SEQ ID NO: 54426 - DNA, 20 bp, Homo sapiens
gatctgctgtcagtctgctt

SEQ ID NO: 54427 - DNA, 20 bp, Homo sapiens
gatcatgagaaattaccaaa

SEQ ID NO: 54428 - DNA, 20 bp, Homo sapiens
gatccagatgagatacagct

SEQ ID NO: 54429 - DNA, 20 bp, Homo sapiens
gatcatctgctacaactggc

SEQ ID NO: 54430 - DNA, 20 bp, Homo sapiens
gatctctctagtatgaaaga

SEQ ID NO: 54431 - DNA, 20 bp, Homo sapiens
gatcacaaaagtgtcacata

SEQ ID NO: 54432 - DNA, 20 bp, Homo sapiens
gatcaatatttgtttggaaa

SEQ ID NO: 54433 - DNA, 20 bp, Homo sapiens
gatcatttcatagccacaga

SEQ ID NO: 54434 - DNA, 20 bp, Homo sapiens
gatcccttcttttcttgggg

SEQ ID NO: 54435 - DNA, 20 bp, Homo sapiens
gatcagagagaaaagtgggg

SEQ ID NO: 54436 - DNA, 20 bp, Homo sapiens
gatccacatcaggtggccac

SEQ ID NO: 54437 - DNA, 20 bp, Homo sapiens
gatctgttagaaatggaatt

SEQ ID NO: 54438 - DNA, 20 bp, Homo sapiens
gatcttgtgatatgtgtgtg

SEQ ID NO: 54439 - DNA, 20 bp, Homo sapiens
gatctttatgggatgcctat

SEQ ID NO: 54440 - DNA, 20 bp, Homo sapiens
gatcaaaattgttacccatt

SEQ ID NO: 54441 - DNA, 20 bp, Homo sapiens
gatctggcacttcagtctat

SEQ ID NO: 54442 - DNA, 20 bp, Homo sapiens
gatcaagagtgtgtgtgtgt

SEQ ID NO: 54443 - DNA, 20 bp, Homo sapiens
gatcacagaacgcactgggg

SEQ ID NO: 54444 - DNA, 20 bp, Homo sapiens
gatcccttgcttccctcccc

SEQ ID NO: 54445 - DNA, 20 bp, Homo sapiens
gatcgccaagttcaaagctg

SEQ ID NO: 54446 - DNA, 20 bp, Homo sapiens
gatctgggcccaaagactct

SEQ ID NO: 54447 - DNA, 20 bp, Homo sapiens
gatctttaaacctttgtgtc

SEQ ID NO: 54448 - DNA, 20 bp, Homo sapiens
gatccgtatttgtgcaagtc

SEQ ID NO: 54449 - DNA, 20 bp, Homo sapiens
gatcaacataagattgcaaa

SEQ ID NO: 54450 - DNA, 20 bp, Homo sapiens
gatcatagaggaaaccaaag

SEQ ID NO: 54451 - DNA, 20 bp, Homo sapiens
gatccaggaaggaagacata

SEQ ID NO: 54452 - DNA, 20 bp, Homo sapiens
gatccgagaaggaaggctct

SEQ ID NO: 54453 - DNA, 20 bp, Homo sapiens
gatcgatgttaaacgtcaca

SEQ ID NO: 54454 - DNA, 20 bp, Homo sapiens
gatctgagtaatagtgttgt

SEQ ID NO: 54455 - DNA, 20 bp, Homo sapiens
gatcctgcgctccggcaagc

SEQ ID NO: 54456 - DNA, 20 bp, Homo sapiens
gatctgctcacattcgtcca

SEQ ID NO: 54457 - DNA, 20 bp, Homo sapiens
gatccggtcccagaacctca

SEQ ID NO: 54458 - DNA, 20 bp, Homo sapiens
gatctggcttggggtgcccg

SEQ ID NO: 54459 - DNA, 20 bp, Homo sapiens
gatcacgcggctgctcaaga

SEQ ID NO: 54460 - DNA, 20 bp, Homo sapiens
gatcacataatctgccattt

SEQ ID NO: 54461 - DNA, 20 bp, Homo sapiens
gatcagtgaggggcaagggg

SEQ ID NO: 54462 - DNA, 20 bp, Homo sapiens
gatcttgcttttccctggtc

SEQ ID NO: 54463 - DNA, 20 bp, Homo sapiens
gatctgattcctgttttgaa

SEQ ID NO: 54464 - DNA, 20 bp, Homo sapiens
gatcaagatggaaagagaca

SEQ ID NO: 54465 - DNA, 20 bp, Homo sapiens
gatcactttgtcaccagccc

SEQ ID NO: 54466 - DNA, 20 bp, Homo sapiens
gatcatatgaaaaatgtaca

SEQ ID NO: 54467 - DNA, 20 bp, Homo sapiens
gatctgcagccttttgggta

SEQ ID NO: 54468 - DNA, 20 bp, Homo sapiens
gatcacacacacatacacac

SEQ ID NO: 54469 - DNA, 20 bp, Homo sapiens
gatctgtgtcatggttttgt

SEQ ID NO: 54470 - DNA, 20 bp, Homo sapiens
gatcttcccatcttgtggca

SEQ ID NO: 54471 - DNA, 20 bp, Homo sapiens
gatctaaatggaagcatctg

SEQ ID NO: 54472 - DNA, 20 bp, Homo sapiens
gatccattgctaacagcctg

SEQ ID NO: 54473 - DNA, 20 bp, Homo sapiens
gatcaagactgtttaatagt

SEQ ID NO: 54474 - DNA, 20 bp, Homo sapiens
gatcagaaacctttcggcca

SEQ ID NO: 54475 - DNA, 20 bp, Homo sapiens
gatccaaagtcttggggcta

SEQ ID NO: 54476 - DNA, 20 bp, Homo sapiens
gatcgtccagcgggatgtct

SEQ ID NO: 54477 - DNA, 20 bp, Homo sapiens
gatctccgtgtgtgcatgtg

SEQ ID NO: 54478 - DNA, 20 bp, Homo sapiens
gatcttccagcatatctgat

SEQ ID NO: 54479 - DNA, 20 bp, Homo sapiens
gatcttgctcccaggtaacc

SEQ ID NO: 54480 - DNA, 20 bp, Homo sapiens
gatcttagaggaatccagga

SEQ ID NO: 54481 - DNA, 20 bp, Homo sapiens
gatcaagattctgtcaacct

SEQ ID NO: 54482 - DNA, 20 bp, Homo sapiens
gatcagtaacatagcttctc

SEQ ID NO: 54483 - DNA, 20 bp, Homo sapiens
gatcattctgttcatttagg

SEQ ID NO: 54484 - DNA, 20 bp, Homo sapiens
gatcattgttctctcacggt

SEQ ID NO: 54485 - DNA, 20 bp, Homo sapiens
gatccacctgctttttagaa

SEQ ID NO: 54486 - DNA, 20 bp, Homo sapiens
gatccatttaggtaccactt

SEQ ID NO: 54487 - DNA, 20 bp, Homo sapiens
gatctgtgtgagccgatgcc

SEQ ID NO: 54488 - DNA, 20 bp, Homo sapiens
gatctttcccaaaggtgttg

SEQ ID NO: 54489 - DNA, 20 bp, Homo sapiens
gatcattcagagccaaacgc

SEQ ID NO: 54490 - DNA, 20 bp, Homo sapiens
gatcccccagaaacccggac

SEQ ID NO: 54491 - DNA, 20 bp, Homo sapiens
gatcaagtattgttgaaagc

SEQ ID NO: 54492 - DNA, 20 bp, Homo sapiens
gatcctcctttgcatgcgac

SEQ ID NO: 54493 - DNA, 20 bp, Homo sapiens
gatcctggttgtattcaagg

SEQ ID NO: 54494 - DNA, 20 bp, Homo sapiens
gatctgccttatattagagt

SEQ ID NO: 54495 - DNA, 20 bp, Homo sapiens
gatcccagctgcggtggcga

SEQ ID NO: 54496 - DNA, 20 bp, Homo sapiens
gatcagaggaagggtgttac

SEQ ID NO: 54497 - DNA, 20 bp, Homo sapiens
gatcgagcgctgtctggctt

SEQ ID NO: 54498 - DNA, 20 bp, Homo sapiens
gatctgcataaccagttaac

SEQ ID NO: 54499 - DNA, 20 bp, Homo sapiens
gatcaccacatgcaaacaaa

SEQ ID NO: 54500 - DNA, 20 bp, Homo sapiens
gatccacagagaggatgaga

SEQ ID NO: 54501 - DNA, 20 bp, Homo sapiens
gatcgttggctttcacagaa

SEQ ID NO: 54502 - DNA, 20 bp, Homo sapiens
gatctgacagggtataggaa

SEQ ID NO: 54503 - DNA, 20 bp, Homo sapiens
gatccattctctacatgaac

SEQ ID NO: 54504 - DNA, 20 bp, Homo sapiens
gatctgaaggttaaacacat

SEQ ID NO: 54505 - DNA, 20 bp, Homo sapiens
gatcctggcagtcttctaca

SEQ ID NO: 54506 - DNA, 20 bp, Homo sapiens
gatcagaaacactttggaga

SEQ ID NO: 54507 - DNA, 20 bp, Homo sapiens
gatccgcagcaggggccaga

SEQ ID NO: 54508 - DNA, 20 bp, Homo sapiens
gatcaagcttttattttttt

SEQ ID NO: 54509 - DNA, 20 bp, Homo sapiens
gatcatcttgttcccctggc

SEQ ID NO: 54510 - DNA, 20 bp, Homo sapiens
gatcatgggtggcttcaagg

SEQ ID NO: 54511 - DNA, 20 bp, Homo sapiens
gatctgccaaggagcttttg

SEQ ID NO: 54512 - DNA, 20 bp, Homo sapiens
gatctatcctagccaaatat

SEQ ID NO: 54513 - DNA, 20 bp, Homo sapiens
gatcacgcagagcctggctg

SEQ ID NO: 54514 - DNA, 20 bp, Homo sapiens
gatctgtatgttatgtacat

SEQ ID NO: 54515 - DNA, 20 bp, Homo sapiens
gatcctctgcgcagggacaa

SEQ ID NO: 54516 - DNA, 20 bp, Homo sapiens
gatcaacacagactctgcca

SEQ ID NO: 54517 - DNA, 20 bp, Homo sapiens
gatctcagttgcacgtgcaa

SEQ ID NO: 54518 - DNA, 20 bp, Homo sapiens
gatcttattaacattagttg

SEQ ID NO: 54519 - DNA, 20 bp, Homo sapiens
gatccctaccccctggcccc

SEQ ID NO: 54520 - DNA, 20 bp, Homo sapiens
gatcaaggagggagaaaggc

SEQ ID NO: 54521 - DNA, 20 bp, Homo sapiens
gatcaccatccaggagatgc

SEQ ID NO: 54522 - DNA, 20 bp, Homo sapiens
gatctcacttccattggcct

SEQ ID NO: 54523 - DNA, 20 bp, Homo sapiens
gatcaacggaccaaataaac

SEQ ID NO: 54524 - DNA, 20 bp, Homo sapiens
gatcaaatttgttgtgactc

SEQ ID NO: 54525 - DNA, 20 bp, Homo sapiens
gatcctatttggtatgtttt

SEQ ID NO: 54526 - DNA, 20 bp, Homo sapiens
gatcccttccttctataaat

SEQ ID NO: 54527 - DNA, 20 bp, Homo sapiens
gatcgccccacagctctctg

SEQ ID NO: 54528 - DNA, 20 bp, Homo sapiens
gatctttcttagtcccactc

SEQ ID NO: 54529 - DNA, 20 bp, Homo sapiens
gatcagaccgtggtgggcct

SEQ ID NO: 54530 - DNA, 20 bp, Homo sapiens
gatcaggccccagaggagaa

SEQ ID NO: 54531 - DNA, 20 bp, Homo sapiens
gatccacctctacaccagcc

SEQ ID NO: 54532 - DNA, 20 bp, Homo sapiens
gatcccagcctccaccccag

SEQ ID NO: 54533 - DNA, 20 bp, Homo sapiens
gatccctgctacagcgccgg

SEQ ID NO: 54534 - DNA, 20 bp, Homo sapiens
gatcacataacagaatgcac

SEQ ID NO: 54535 - DNA, 20 bp, Homo sapiens
gatcagaaagtaatttcttc

SEQ ID NO: 54536 - DNA, 20 bp, Homo sapiens
gatcagattactcaaattga

SEQ ID NO: 54537 - DNA, 20 bp, Homo sapiens
gatcgttctttctagctaat

SEQ ID NO: 54538 - DNA, 20 bp, Homo sapiens
gatctatatcaggagaaaat

SEQ ID NO: 54539 - DNA, 20 bp, Homo sapiens
gatctttcacccacagaaag

SEQ ID NO: 54540 - DNA, 20 bp, Homo sapiens
gatctttggcgactacaaga

SEQ ID NO: 54541 - DNA, 20 bp, Homo sapiens
gatcagggtagcaaactcaa

SEQ ID NO: 54542 - DNA, 20 bp, Homo sapiens
gatctgagtgctaggtatat

SEQ ID NO: 54543 - DNA, 20 bp, Homo sapiens
gatcttcgtgtctaatatag

SEQ ID NO: 54544 - DNA, 20 bp, Homo sapiens
gatcacaagtgatacctttt

SEQ ID NO: 54545 - DNA, 20 bp, Homo sapiens
gatcacctgagcctgagcct

SEQ ID NO: 54546 - DNA, 20 bp, Homo sapiens
gatcagacctgtgtatcacg

SEQ ID NO: 54547 - DNA, 20 bp, Homo sapiens
gatcagctcctcatctagac

SEQ ID NO: 54548 - DNA, 20 bp, Homo sapiens
gatcatttatctttctaaat

SEQ ID NO: 54549 - DNA, 20 bp, Homo sapiens
gatctacacaaccatgtggt

SEQ ID NO: 54550 - DNA, 20 bp, Homo sapiens
gatctagacaggtaaaaggc

SEQ ID NO: 54551 - DNA, 20 bp, Homo sapiens
gatctaggccagtggctgct

SEQ ID NO: 54552 - DNA, 20 bp, Homo sapiens
gatccttatatatttatgtt

SEQ ID NO: 54553 - DNA, 20 bp, Homo sapiens
gatccttcatattttattaa

SEQ ID NO: 54554 - DNA, 20 bp, Homo sapiens
gatctgcaaatagcttaaat

SEQ ID NO: 54555 - DNA, 20 bp, Homo sapiens
gatccggcgcaggagaccaa

SEQ ID NO: 54556 - DNA, 20 bp, Homo sapiens
gatccttttctacccacttt

SEQ ID NO: 54557 - DNA, 20 bp, Homo sapiens
gatctaagggtacctcaagg

SEQ ID NO: 54558 - DNA, 20 bp, Homo sapiens
gatctggggagtagaattgt

SEQ ID NO: 54559 - DNA, 20 bp, Homo sapiens
gatcttcttgcggtccttgg

SEQ ID NO: 54560 - DNA, 20 bp, Homo sapiens
gatcttgcatacagcttggc

SEQ ID NO: 54561 - DNA, 20 bp, Homo sapiens
gatcaaatgtgtgttaagaa

SEQ ID NO: 54562 - DNA, 20 bp, Homo sapiens
gatcagggctgacaacttga

SEQ ID NO: 54563 - DNA, 20 bp, Homo sapiens
gatcagtttggactctgtaa

SEQ ID NO: 54564 - DNA, 20 bp, Homo sapiens
gatcattgatttttttttaa

SEQ ID NO: 54565 - DNA, 20 bp, Homo sapiens
gatccatttccctgtgtaaa

SEQ ID NO: 54566 - DNA, 20 bp, Homo sapiens
gatcccctctgtccacgaga

SEQ ID NO: 54567 - DNA, 20 bp, Homo sapiens
gatcactagcttcgaggaag

SEQ ID NO: 54568 - DNA, 20 bp, Homo sapiens
gatcacgcagtaccgcagcc

SEQ ID NO: 54569 - DNA, 20 bp, Homo sapiens
gatcccgcctcctttcagac

SEQ ID NO: 54570 - DNA, 20 bp, Homo sapiens
gatcctgcaccccagcattc

SEQ ID NO: 54571 - DNA, 20 bp, Homo sapiens
gatctccaatcgttccagcc

SEQ ID NO: 54572 - DNA, 20 bp, Homo sapiens
gatctgccgtgccgtcccaa

SEQ ID NO: 54573 - DNA, 20 bp, Homo sapiens
gatcagctgaagtgtgtttt

SEQ ID NO: 54574 - DNA, 20 bp, Homo sapiens
gatcagcagaaatatctttt

SEQ ID NO: 54575 - DNA, 20 bp, Homo sapiens
gatcgaattctggtagcaca

SEQ ID NO: 54576 - DNA, 20 bp, Homo sapiens
gatctgaccttttcttcaga

SEQ ID NO: 54577 - DNA, 20 bp, Homo sapiens
gatctgtcattagtcctagg

SEQ ID NO: 54578 - DNA, 20 bp, Homo sapiens
gatcttcacagccctcttcc

SEQ ID NO: 54579 - DNA, 20 bp, Homo sapiens
gatcaggtattgatggaacc

SEQ ID NO: 54580 - DNA, 20 bp, Homo sapiens
gatcctctgggttctccatg

SEQ ID NO: 54581 - DNA, 20 bp, Homo sapiens
gatctacgtgagacattttt

SEQ ID NO: 54582 - DNA, 20 bp, Homo sapiens
gatcacaagactccagacag

SEQ ID NO: 54583 - DNA, 20 bp, Homo sapiens
gatcctcagccttgtgagca

SEQ ID NO: 54584 - DNA, 20 bp, Homo sapiens
gatctctagggttaagaaga

SEQ ID NO: 54585 - DNA, 20 bp, Homo sapiens
gatcaagacctactcatggg

SEQ ID NO: 54586 - DNA, 20 bp, Homo sapiens
gatcagagtctggcctgcca

SEQ ID NO: 54587 - DNA, 20 bp, Homo sapiens
gatcagcctgctttagggtg

SEQ ID NO: 54588 - DNA, 20 bp, Homo sapiens
gatccccatggtccacacag

SEQ ID NO: 54589 - DNA, 20 bp, Homo sapiens
gatcccaaggttttggaaca

SEQ ID NO: 54590 - DNA, 20 bp, Homo sapiens
gatctcaatgtgcaaactcc

SEQ ID NO: 54591 - DNA, 20 bp, Homo sapiens
gatctgtgtgggtgcccatg

SEQ ID NO: 54592 - DNA, 20 bp, Homo sapiens
gatcttaataagcaagttgc

SEQ ID NO: 54593 - DNA, 20 bp, Homo sapiens
gatccggaactgaatgttcc

SEQ ID NO: 54594 - DNA, 20 bp, Homo sapiens
gatcactaaggttccttagg

SEQ ID NO: 54595 - DNA, 20 bp, Homo sapiens
gatcagtctgtgagggtccc

SEQ ID NO: 54596 - DNA, 20 bp, Homo sapiens
gatccatggtggcggggctg

SEQ ID NO: 54597 - DNA, 20 bp, Homo sapiens
gatctccgtgtacactatca

SEQ ID NO: 54598 - DNA, 20 bp, Homo sapiens
gatcatgcggcttctctggg

SEQ ID NO: 54599 - DNA, 20 bp, Homo sapiens
gatcctggtcctaggctgga

SEQ ID NO: 54600 - DNA, 20 bp, Homo sapiens
gatcaactttaatacatttg

SEQ ID NO: 54601 - DNA, 20 bp, Homo sapiens
gatcaagttgtacaggctgt

SEQ ID NO: 54602 - DNA, 20 bp, Homo sapiens
gatcagagtgcaacattctt

SEQ ID NO: 54603 - DNA, 20 bp, Homo sapiens
gatcttgggagttttctttg

SEQ ID NO: 54604 - DNA, 20 bp, Homo sapiens
gatcttctgttagatgacaa

SEQ ID NO: 54605 - DNA, 20 bp, Homo sapiens
gatcatttaatgggtaacaa

SEQ ID NO: 54606 - DNA, 20 bp, Homo sapiens
gatcatttaataacctctca

SEQ ID NO: 54607 - DNA, 20 bp, Homo sapiens
gatctagggtcatccaatac

SEQ ID NO: 54608 - DNA, 20 bp, Homo sapiens
gatcttctttgagacaaggc

SEQ ID NO: 54609 - DNA, 20 bp, Homo sapiens
gatcaggccaacaagctcag

SEQ ID NO: 54610 - DNA, 20 bp, Homo sapiens
gatcttgcgtttggaaagaa

SEQ ID NO: 54611 - DNA, 20 bp, Homo sapiens
gatctagtgataatggttgc

SEQ ID NO: 54612 - DNA, 20 bp, Homo sapiens
gatcaccctttctcaggagc

SEQ ID NO: 54613 - DNA, 20 bp, Homo sapiens
gatctcaagctccaagtagg

SEQ ID NO: 54614 - DNA, 20 bp, Homo sapiens
gatcttgtcagtggtggggg

SEQ ID NO: 54615 - DNA, 20 bp, Homo sapiens
gatcaaataccgaaattgaa

SEQ ID NO: 54616 - DNA, 20 bp, Homo sapiens
gatcttccacttccatgaag

SEQ ID NO: 54617 - DNA, 20 bp, Homo sapiens
gatctggtaggacagggctc

SEQ ID NO: 54618 - DNA, 20 bp, Homo sapiens
gatcactttatattttgcta

SEQ ID NO: 54619 - DNA, 20 bp, Homo sapiens
gatcaattgtttacagcccg

SEQ ID NO: 54620 - DNA, 20 bp, Homo sapiens
gatcaactagccaagtcact

SEQ ID NO: 54621 - DNA, 20 bp, Homo sapiens
gatccatctgcaggtcctca

SEQ ID NO: 54622 - DNA, 20 bp, Homo sapiens
gatccatgtttctctctgcg

SEQ ID NO: 54623 - DNA, 20 bp, Homo sapiens
gatcagcctgggcgacatgg

SEQ ID NO: 54624 - DNA, 20 bp, Homo sapiens
gatcataagtaaatgagcag

SEQ ID NO: 54625 - DNA, 20 bp, Homo sapiens
gatcaaatgatgcaacaaca

SEQ ID NO: 54626 - DNA, 20 bp, Homo sapiens
gatctatagttacataggaa

SEQ ID NO: 54627 - DNA, 20 bp, Homo sapiens
gatcgtgatgaagcctgggt

SEQ ID NO: 54628 - DNA, 20 bp, Homo sapiens
gatcacttgctccaaccagc

SEQ ID NO: 54629 - DNA, 20 bp, Homo sapiens
gatcactttttaaaaaatca

SEQ ID NO: 54630 - DNA, 20 bp, Homo sapiens
gatcatcgaagtggaaaacc

SEQ ID NO: 54631 - DNA, 20 bp, Homo sapiens
gatccctcttattgctgagt

SEQ ID NO: 54632 - DNA, 20 bp, Homo sapiens
gatctcaatgaatctagtaa

SEQ ID NO: 54633 - DNA, 20 bp, Homo sapiens
gatctcttcccacctaccct

SEQ ID NO: 54634 - DNA, 20 bp, Homo sapiens
gatcaagcgtttcctggagg

SEQ ID NO: 54635 - DNA, 20 bp, Homo sapiens
gatctacccagaaagaaatc

SEQ ID NO: 54636 - DNA, 20 bp, Homo sapiens
gatcctaaggggttcagggg

SEQ ID NO: 54637 - DNA, 20 bp, Homo sapiens
gatcatgtggagtgaaaggc

SEQ ID NO: 54638 - DNA, 20 bp, Homo sapiens
gatccactactgcaggtggc

SEQ ID NO: 54639 - DNA, 20 bp, Homo sapiens
gatctgaatgaatttgtctc

SEQ ID NO: 54640 - DNA, 20 bp, Homo sapiens
gatctaggtgtgaccagggt

SEQ ID NO: 54641 - DNA, 20 bp, Homo sapiens
gatcctgcgcgcgcgcgccg

SEQ ID NO: 54642 - DNA, 20 bp, Homo sapiens
gatcgactcgtgtttgttga

SEQ ID NO: 54643 - DNA, 20 bp, Homo sapiens
gatcaatactgaggcaggat

SEQ ID NO: 54644 - DNA, 20 bp, Homo sapiens
gatcatctaaaacaaaagca

SEQ ID NO: 54645 - DNA, 20 bp, Homo sapiens
gatcttgtgttctttgtgcc

SEQ ID NO: 54646 - DNA, 20 bp, Homo sapiens
gatcaaatatccagaataga

SEQ ID NO: 54647 - DNA, 20 bp, Homo sapiens
gatcacagcttttgttgtgt

SEQ ID NO: 54648 - DNA, 20 bp, Homo sapiens
gatcactcagctcccatctc

SEQ ID NO: 54649 - DNA, 20 bp, Homo sapiens
gatcccagattttgagtcat

SEQ ID NO: 54650 - DNA, 20 bp, Homo sapiens
gatccttcccctctcagaca

SEQ ID NO: 54651 - DNA, 20 bp, Homo sapiens
gatcgcggacttcctgcgga

SEQ ID NO: 54652 - DNA, 20 bp, Homo sapiens
gatctcaaaggttagcctga

SEQ ID NO: 54653 - DNA, 20 bp, Homo sapiens
gatcactactgaacagtatt

SEQ ID NO: 54654 - DNA, 20 bp, Homo sapiens
gatcactgagtgccaatcca

SEQ ID NO: 54655 - DNA, 20 bp, Homo sapiens
gatcactgccctgggcaccg

SEQ ID NO: 54656 - DNA, 20 bp, Homo sapiens
gatcagaaagttggctgtct

SEQ ID NO: 54657 - DNA, 20 bp, Homo sapiens
gatcagaatgtttcatacat

SEQ ID NO: 54658 - DNA, 20 bp, Homo sapiens
gatcagattatctggtcact

SEQ ID NO: 54659 - DNA, 20 bp, Homo sapiens
gatcagtattgcaccctaaa

SEQ ID NO: 54660 - DNA, 20 bp, Homo sapiens
gatcggtgttttgcaaacat

SEQ ID NO: 54661 - DNA, 20 bp, Homo sapiens
gatctatatacatgggcatg

SEQ ID NO: 54662 - DNA, 20 bp, Homo sapiens
gatcttcaacataggactct

SEQ ID NO: 54663 - DNA, 20 bp, Homo sapiens
gatctttaaacaacctcttg

SEQ ID NO: 54664 - DNA, 20 bp, Homo sapiens
gatcctctgatatacaatta

SEQ ID NO: 54665 - DNA, 20 bp, Homo sapiens
gatctatgtctagatttttc

SEQ ID NO: 54666 - DNA, 20 bp, Homo sapiens
gatctgtgaatggagtcaat

SEQ ID NO: 54667 - DNA, 20 bp, Homo sapiens
gatcttacaagtttatgtgg

SEQ ID NO: 54668 - DNA, 20 bp, Homo sapiens
gatccatcgcgtctgcgttt

SEQ ID NO: 54669 - DNA, 20 bp, Homo sapiens
gatcttcctgccttcgctgg

SEQ ID NO: 54670 - DNA, 20 bp, Homo sapiens
gatcaagcaatggaaaaatt

SEQ ID NO: 54671 - DNA, 20 bp, Homo sapiens
gatcttcaacatctttcaaa

SEQ ID NO: 54672 - DNA, 20 bp, Homo sapiens
gatcaaaatgcatacgtatt

SEQ ID NO: 54673 - DNA, 20 bp, Homo sapiens
gatcagttacatttttaaaa

SEQ ID NO: 54674 - DNA, 20 bp, Homo sapiens
gatccttcaaataggccctg

SEQ ID NO: 54675 - DNA, 20 bp, Homo sapiens
gatcggacgggacagggtgg

SEQ ID NO: 54676 - DNA, 20 bp, Homo sapiens
gatcaactggactcgctttg

SEQ ID NO: 54677 - DNA, 20 bp, Homo sapiens
gatctgggtgggcattttta

SEQ ID NO: 54678 - DNA, 20 bp, Homo sapiens
gatcttaggatggagcagaa

SEQ ID NO: 54679 - DNA, 20 bp, Homo sapiens
gatcctatggtagcaattct

SEQ ID NO: 54680 - DNA, 20 bp, Homo sapiens
gatcggtaggcagttcagag

SEQ ID NO: 54681 - DNA, 20 bp, Homo sapiens
gatctgccatctagaactca

SEQ ID NO: 54682 - DNA, 20 bp, Homo sapiens
gatcttttgtgactacaact

SEQ ID NO: 54683 - DNA, 20 bp, Homo sapiens
gatcatggagaaggctgatt

SEQ ID NO: 54684 - DNA, 20 bp, Homo sapiens
gatcgagttgttctccttgt

SEQ ID NO: 54685 - DNA, 20 bp, Homo sapiens
gatcgtgtcgaagaaggcat

SEQ ID NO: 54686 - DNA, 20 bp, Homo sapiens
gatctcattgcccatatcca

SEQ ID NO: 54687 - DNA, 20 bp, Homo sapiens
gatcaacagtgacctcattt

SEQ ID NO: 54688 - DNA, 20 bp, Homo sapiens
gatcagtgttgctagtagct

SEQ ID NO: 54689 - DNA, 20 bp, Homo sapiens
gatcttaacatcaaggattt

SEQ ID NO: 54690 - DNA, 20 bp, Homo sapiens
gatcagtagggaattcctcc

SEQ ID NO: 54691 - DNA, 20 bp, Homo sapiens
gatctgaagccagaggaagt

SEQ ID NO: 54692 - DNA, 20 bp, Homo sapiens
gatcatttttgtaccaaggc

SEQ ID NO: 54693 - DNA, 20 bp, Homo sapiens
gatccctccccgcctcccca

SEQ ID NO: 54694 - DNA, 20 bp, Homo sapiens
gatcctgcttttttgtttca

SEQ ID NO: 54695 - DNA, 20 bp, Homo sapiens
gatcagcatgtatctccccg

SEQ ID NO: 54696 - DNA, 20 bp, Homo sapiens
gatcccaactttccattttg

SEQ ID NO: 54697 - DNA, 20 bp, Homo sapiens
gatcagagatgtcacaaggc

SEQ ID NO: 54698 - DNA, 20 bp, Homo sapiens
gatcgatttgataaaattaa

SEQ ID NO: 54699 - DNA, 20 bp, Homo sapiens
gatctcagtcaaatgtgaag

SEQ ID NO: 54700 - DNA, 20 bp, Homo sapiens
gatctgcaatgactgttgat

SEQ ID NO: 54701 - DNA, 20 bp, Homo sapiens
gatcatgcgatatcaggatg

SEQ ID NO: 54702 - DNA, 20 bp, Homo sapiens
gatccattataatataggca

SEQ ID NO: 54703 - DNA, 20 bp, Homo sapiens
gatctgctcttgcttttacc

SEQ ID NO: 54704 - DNA, 20 bp, Homo sapiens
gatcaaaaaatgatggttca

SEQ ID NO: 54705 - DNA, 20 bp, Homo sapiens
gatcatcatgaccaatgaaa

SEQ ID NO: 54706 - DNA, 20 bp, Homo sapiens
gatctgattttcacatctct

SEQ ID NO: 54707 - DNA, 20 bp, Homo sapiens
gatctgcgccgggcagggtt

SEQ ID NO: 54708 - DNA, 20 bp, Homo sapiens
gatcacatgtagtgtcatat

SEQ ID NO: 54709 - DNA, 20 bp, Homo sapiens
gatctgacgactaatctcag

SEQ ID NO: 54710 - DNA, 20 bp, Homo sapiens
gatcagcatcaagggctttg

SEQ ID NO: 54711 - DNA, 20 bp, Homo sapiens
gatcaggttggcacggccgc

SEQ ID NO: 54712 - DNA, 20 bp, Homo sapiens
gatcatgtgtagtgctcagt

SEQ ID NO: 54713 - DNA, 20 bp, Homo sapiens
gatccttctgtgcttgcttg

SEQ ID NO: 54714 - DNA, 20 bp, Homo sapiens
gatcaacatgtatttgaaga

SEQ ID NO: 54715 - DNA, 20 bp, Homo sapiens
gatcaaaaagcacaaagagc

SEQ ID NO: 54716 - DNA, 20 bp, Homo sapiens
gatctccctagactgtggga

SEQ ID NO: 54717 - DNA, 20 bp, Homo sapiens
gatctgctggtttgaccaga

SEQ ID NO: 54718 - DNA, 20 bp, Homo sapiens
gatcaaaaatcagcatcagg

SEQ ID NO: 54719 - DNA, 20 bp, Homo sapiens
gatcttttgttttattaaaa

SEQ ID NO: 54720 - DNA, 20 bp, Homo sapiens
gatcccatcaaaggccagag

SEQ ID NO: 54721 - DNA, 20 bp, Homo sapiens
gatctgccagcttcctccct

SEQ ID NO: 54722 - DNA, 20 bp, Homo sapiens
gatcacatcattgaggtggt

SEQ ID NO: 54723 - DNA, 20 bp, Homo sapiens
gatcaactaccattatcagc

SEQ ID NO: 54724 - DNA, 20 bp, Homo sapiens
gatcagtacaaaaaaagggg

SEQ ID NO: 54725 - DNA, 20 bp, Homo sapiens
gatccaactgggagaacctc

SEQ ID NO: 54726 - DNA, 20 bp, Homo sapiens
gatctgttgtaaatatatac

SEQ ID NO: 54727 - DNA, 20 bp, Homo sapiens
gatctgcagtttcccctttt

SEQ ID NO: 54728 - DNA, 20 bp, Homo sapiens
gatcatggtccagtcttcgg

SEQ ID NO: 54729 - DNA, 20 bp, Homo sapiens
gatcgtagagggcagctgga

SEQ ID NO: 54730 - DNA, 20 bp, Homo sapiens
gatcaagcagtgggtacagt

SEQ ID NO: 54731 - DNA, 20 bp, Homo sapiens
gatcacaggcactactgaca

SEQ ID NO: 54732 - DNA, 20 bp, Homo sapiens
gatccagagagaagcacccc

SEQ ID NO: 54733 - DNA, 20 bp, Homo sapiens
gatcccacgcctcaccctac

SEQ ID NO: 54734 - DNA, 20 bp, Homo sapiens
gatcgtgtgttgccattttg

SEQ ID NO: 54735 - DNA, 20 bp, Homo sapiens
gatctggagtctgaaggaga

SEQ ID NO: 54736 - DNA, 20 bp, Homo sapiens
gatctgtcccctttagaatc

SEQ ID NO: 54737 - DNA, 20 bp, Homo sapiens
gatcttgagcaaggcaagaa

SEQ ID NO: 54738 - DNA, 20 bp, Homo sapiens
gatcacagaagtgaatggga

SEQ ID NO: 54739 - DNA, 20 bp, Homo sapiens
gatccattttaatttccagg

SEQ ID NO: 54740 - DNA, 20 bp, Homo sapiens
gatctgagcagcagcatcca

SEQ ID NO: 54741 - DNA, 20 bp, Homo sapiens
gatcaggcctgaggtaggag

SEQ ID NO: 54742 - DNA, 20 bp, Homo sapiens
gatcatggtgagggcaatgt

SEQ ID NO: 54743 - DNA, 20 bp, Homo sapiens
gatccctctccaaagtggtt

SEQ ID NO: 54744 - DNA, 20 bp, Homo sapiens
gatcggaccaggctccctca

SEQ ID NO: 54745 - DNA, 20 bp, Homo sapiens
gatccatacgtcaaggtcca

SEQ ID NO: 54746 - DNA, 20 bp, Homo sapiens
gatcatcattggctcctatt

SEQ ID NO: 54747 - DNA, 20 bp, Homo sapiens
gatctctcacaaaagacata

SEQ ID NO: 54748 - DNA, 20 bp, Homo sapiens
gatcatgtaggacgcggcat

SEQ ID NO: 54749 - DNA, 20 bp, Homo sapiens
gatctgcctgggcatcccgt

SEQ ID NO: 54750 - DNA, 20 bp, Homo sapiens
gatcttctcctgcacctctc

SEQ ID NO: 54751 - DNA, 20 bp, Homo sapiens
gatctcgccggccgacacgc

SEQ ID NO: 54752 - DNA, 20 bp, Homo sapiens
gatcctgatgtgtccttttt

SEQ ID NO: 54753 - DNA, 20 bp, Homo sapiens
gatcgccttccagtacaggc

SEQ ID NO: 54754 - DNA, 20 bp, Homo sapiens
gatctacacatgttgccttg

SEQ ID NO: 54755 - DNA, 20 bp, Homo sapiens
gatctcttgtcttattcttt

SEQ ID NO: 54756 - DNA, 20 bp, Homo sapiens
gatcacttattttaattcta

SEQ ID NO: 54757 - DNA, 20 bp, Homo sapiens
gatccagaggacttggcaca

SEQ ID NO: 54758 - DNA, 20 bp, Homo sapiens
gatcgtgtcctcatatgaat

SEQ ID NO: 54759 - DNA, 20 bp, Homo sapiens
gatctgactttcatggaagt

SEQ ID NO: 54760 - DNA, 20 bp, Homo sapiens
gatctgatggcttttttgag

SEQ ID NO: 54761 - DNA, 20 bp, Homo sapiens
gatcagctctgtatctggtt

SEQ ID NO: 54762 - DNA, 20 bp, Homo sapiens
gatcatccatccatctgtac

SEQ ID NO: 54763 - DNA, 20 bp, Homo sapiens
gatcatctgaaatgcccatg

SEQ ID NO: 54764 - DNA, 20 bp, Homo sapiens
gatcagcaataggggatgat

SEQ ID NO: 54765 - DNA, 20 bp, Homo sapiens
gatcataaaccatgggttat

SEQ ID NO: 54766 - DNA, 20 bp, Homo sapiens
gatcatgtgtgtgtaaattt

SEQ ID NO: 54767 - DNA, 20 bp, Homo sapiens
gatcaactagaaagaaaaat

SEQ ID NO: 54768 - DNA, 20 bp, Homo sapiens
gatcaatatggttttaaacc

SEQ ID NO: 54769 - DNA, 20 bp, Homo sapiens
gatcattttggaagaatgtg

SEQ ID NO: 54770 - DNA, 20 bp, Homo sapiens
gatccttagcacaatctatt

SEQ ID NO: 54771 - DNA, 20 bp, Homo sapiens
gatctggtcttttatatgtt

SEQ ID NO: 54772 - DNA, 20 bp, Homo sapiens
gatctgtgccacaggggatt

SEQ ID NO: 54773 - DNA, 20 bp, Homo sapiens
gatcattttctttaggaaga

SEQ ID NO: 54774 - DNA, 20 bp, Homo sapiens
gatcgtgtctcagcatcagg

SEQ ID NO: 54775 - DNA, 20 bp, Homo sapiens
gatcttgagttgcagtccac

SEQ ID NO: 54776 - DNA, 20 bp, Homo sapiens
gatccttggtaccacagtca

SEQ ID NO: 54777 - DNA, 20 bp, Homo sapiens
gatcattataaagaaaaaac

SEQ ID NO: 54778 - DNA, 20 bp, Homo sapiens
gatcaaggacaccttcctga

SEQ ID NO: 54779 - DNA, 20 bp, Homo sapiens
gatcagggggtcagagccca

SEQ ID NO: 54780 - DNA, 20 bp, Homo sapiens
gatcgtgatgacagtcatga

SEQ ID NO: 54781 - DNA, 20 bp, Homo sapiens
gatctcaactcgtggcacta

SEQ ID NO: 54782 - DNA, 20 bp, Homo sapiens
gatccccaacaacgtgaaga

SEQ ID NO: 54783 - DNA, 20 bp, Homo sapiens
gatccgggaagagtacccag

SEQ ID NO: 54784 - DNA, 20 bp, Homo sapiens
gatctgagaagtttttaagc

SEQ ID NO: 54785 - DNA, 20 bp, Homo sapiens
gatcaacctgagttttaaaa

SEQ ID NO: 54786 - DNA, 20 bp, Homo sapiens
gatctctcatcttaactgtg

SEQ ID NO: 54787 - DNA, 20 bp, Homo sapiens
gatcaaagagaagttggggt

SEQ ID NO: 54788 - DNA, 20 bp, Homo sapiens
gatcaaaggtcagaagcctc

SEQ ID NO: 54789 - DNA, 20 bp, Homo sapiens
gatccgctaggccccccatc

SEQ ID NO: 54790 - DNA, 20 bp, Homo sapiens
gatctctgaatcccctctga

SEQ ID NO: 54791 - DNA, 20 bp, Homo sapiens
gatcaaccccgagatgctga

SEQ ID NO: 54792 - DNA, 20 bp, Homo sapiens
gatcagttctgaaacagttt

SEQ ID NO: 54793 - DNA, 20 bp, Homo sapiens
gatccatcctcaaatcccag

SEQ ID NO: 54794 - DNA, 20 bp, Homo sapiens
gatcatccccaaccacacag

SEQ ID NO: 54795 - DNA, 20 bp, Homo sapiens
gatcctctggcatatgcttt

SEQ ID NO: 54796 - DNA, 20 bp, Homo sapiens
gatcctcaacctgtgggagg

SEQ ID NO: 54797 - DNA, 20 bp, Homo sapiens
gatcccagagttcagccagc

SEQ ID NO: 54798 - DNA, 20 bp, Homo sapiens
gatcctaattccaggctcta

SEQ ID NO: 54799 - DNA, 20 bp, Homo sapiens
gatcacaatatgtctgggct

SEQ ID NO: 54800 - DNA, 20 bp, Homo sapiens
gatcatgatgaaaatgaatg

SEQ ID NO: 54801 - DNA, 20 bp, Homo sapiens
gatcgataggatgcaaatga

SEQ ID NO: 54802 - DNA, 20 bp, Homo sapiens
gatctggaaagagctgtttt

SEQ ID NO: 54803 - DNA, 20 bp, Homo sapiens
gatcttgccatcaccatcca

SEQ ID NO: 54804 - DNA, 20 bp, Homo sapiens
gatcatcactctccaggagc

SEQ ID NO: 54805 - DNA, 20 bp, Homo sapiens
gatcatttcttgtgatgttt

SEQ ID NO: 54806 - DNA, 20 bp, Homo sapiens
gatctggctggggctgccct

SEQ ID NO: 54807 - DNA, 20 bp, Homo sapiens
gatcacacatataaacttat

SEQ ID NO: 54808 - DNA, 1648 bp, Homo sapiens
gagtacggactgggcctggcctggggcgtccccgcgaagcctgggcctgtcaggcggttccgtccgggtctcggccaccgtcgagttccgtcgagttccgtcccggccctgctcacagcagcgccctcggagcgcccagcacctgcggccggccaggcagcgcgatcctgcggcgtctggccatcccgaatgctatggccgccgtcgccgtcttgcgggccttcggggcaagtgggcccatgtgtctccggcgcggcccctgggcccagctccccgcccgcttctgcagccgggacccggccggggcggggcggcgggagtcggagccgcggcccaccagcgcgcggcagctggacggcataaggaacatcgtcttgagcaatcccaagaagaggaacacgttgtcacttgcaatgctgaaatctctccaaagtgacattcttcatgacgctgacagcaacgatctgaaagtcattatcatctcggctgaggggcctgtgttttcttctgggcatgacttaaaggagctgacagaggagcaaggccgtgattaccatgccgaagtatttcagacctgttccaaggtcatgatgcacatccggaaccaccccgtccccgtcattgccatggtcaatggcctggccacggctgccggctgtcaactggttgccagctgcgacattgccgtggcgagcgacaagtcctcttttgccactcctggggtgaacgtcgggctcttctgttctacccctggggttgccttggcaagagcagtgcctagaaaggtggccttggagatgctctttactggtgagcccatttctgcccaggaggccctgctccacgggctgcttagcaaggtggtgccagaggcggagctgcaggaggagaccatgcggatcgctaggaagatcgcatcgctgagccgtccggtggtatccctgggcaaagccaccttctacaagcagctgccccaggacctggggacagcttactacctcacctcccaggccatggtggacaacctggccctgcgggacgggcaggagggcatcacggccttcctccagaagagaaaacctgtctggtcacacgagccagtgtgagtggaggcagaggagtgaggcccacgggcagcgcccaggagcccaccttcccctctggcccagccaccactgcctctcagcttaaacaggtgacaggctgctttcgtgacttgatattggtgtcatagcatttggcctacattaaaagccacaatttcatggggaaaggacaaaatggagggtgactgaggtgctgacctcaatgcaaggctggtgaaccctgcagcgggccagctatggtgggaagcctggcatttggggtgctccttgcaacgtcttaagcaagcgacccccctgacatagcaaaaggtggcaacccatggaggcagaaagaaggacgccagcctgacccttatctgaaacgtcctaagcagagttaatcctggctgctcaggagaggcgacacatttcaaatctccacgagatattctccacacagaaaatcttcttgattctatagagacttaatcatgcctatggctttgaataatcttatgtgatttaaataaattaaatctttataaaaaaaaaaaaaaaaaaaa

SEQ ID NO: 54809 - DNA, 2398 bp, Homo sapiens
ccgcagaggagcctcggccaggctagccagggcgcccccagcccctccccaggccgcgagcgcccctgccgcggtgcctggcctcccctcccagactgcagggacagcacccggtaactgcgagtggagcggaggacccgagcggctgaggagagaggaggcggcggcttagctgctacggggtccggccggcgccctcccgaggggggctcaggaggaggaaggaggacccgtgcgagaatgcctctgccctggagccttgcgctcccgctgctgctctcctgggtggcaggtggtttcgggaacgcggccagtgcaaggcatcacgggttgttagcatcggcacgtcagcctggggtctgtcactatggaactaaactggcctgctgctacggctggagaagaaacagcaagggagtctgtgaagctacatgcgaacctggatgtaagtttggtgagtgcgtgggaccaaacaaatgcagatgctttccaggatacaccgggaaaacctgcagtcaagatgtgaatgagtgtggaatgaaaccccggccatgccaacacagatgtgtgaatacacacggaagctacaagtgcttttgcctcagtggccacatgctcatgccagatgctacgtgtgtgaactctaggacatgtgccatgataaactgtcagtacagctgtgaagacacagaagaagggccacagtgcctgtgtccatcctcaggactccgcctggccccaaatggaagagactgtctagatattgatgaatgtgcctctggtaaagtcatctgtccctacaatcgaagatgtgtgaacacatttggaagctactactgcaaatgtcacattggtttcgaactgcaatatatcagtggacgatatgactgtatagatataaatgaatgtactatggatagccatacgtgcagccaccatgccaattgcttcaatacccaagggtccttcaagtgtaaatgcaagcagggatataaaggcaatggacttcggtgttctgctatccctgaaaattctgtgaaggaagtcctcagagcacctggtaccatcaaagacagaatcaagaagttgcttgctcacaaaaacagcatgaaaaagaaggcaaaaattaaaaatgttaccccagaacccaccaggactcctacccctaaggtgaacttgcagcccttcaactatgaagagatagtttccagaggcgggaactctcatggaggtaaaaaagggaatgaagagaaaatgaaagaggggcttgaggatgagaaaagagaagagaaagccctgaagaatgacatagaggagcgaagcctgcgaggagatgtgtttttccctaaggtgaatgaagcaggtgaattcggcctgattctggtccaaaggaaagcgctaacttccaaactggaacataaagatttaaatatctcggttgactgcagcttcaatcatgggatctgtgactggaaacaggatagagaagatgattttgactggaatcctgctgatcgagataatgctattggcttctatatggcagttccggccttggcaggtcacaagaaagacattggccgattgaaacttctcctacctgacctgcaaccccaaagcaacttctgtttgctctttgattaccggctggccggagacaaagtcgggaaacttcgagtgtttgtgaaaaacagtaacaatgccctggcatgggagaagaccacgagtgaggatgaaaagtggaagacagggaaaattcagttgtatcaaggaactgatgctaccaaaagcatcatttttgaagcagaacgtggcaagggcaaaaccggcgaaatcgcagtggatggcgtcttgcttgtttcaggcttatgtccagatagccttttatctgtggatgactgaatgttactatctttatatttgactttgtatgtcagttccctggtttttttgatattgcatcataggacctctggcattttagaattactagctgaaaaattgtaatgtaccaacagaaatattattgtaagatgcctttcttgtataagatatgccaatatttgctttaaatatcatatcactgtatcttctcagtcatttctgaatctttccacattatattataaaatatggaaatgtcagtttatctcccctcctcagtatatctgatttgtataagtaagttgatgagcttctctctacaacatttctagaaaatagaaaaaaaagcacagagaaatgtttaactgtttgactcttatgatacttcttggaaactatgacatcaaagatagacttttgcctaagtggcttagctgggtctttcatagccaaacttgtatatttaaattctttgtaataataatatccaaatcatcaaaaaaaaaaaaaaaaa

SEQ ID NO: 54810 - DNA, 6387 bp, Homo sapiens
gactgcagctggcattggccgggactggaagtgcgggcttctgcagcagccgaagctggagctgctagggcagcagcggctcccctgttgtatggacattctgcacccgaaactgatagctgagtcctgaagttttatgttatgaaacagaagaactttcatcccagcacatgatttgggaattacactttgtgacatggatgaatctgcactgacccttggtacaatagatgtttcttatctgccacattcatcagaatacagtgttggtcgatgtaagcacacaagtgaggaatggggtgagtgtggctttagacccaccgtcttcagatctgcaactttaaaatggaaagaaagcctaatgagtcggaaaaggccatttgttggaagatgttgttactcctgcactccccagagctgggacaaatttttcaaccccagtatcccgtctttgggtttgcggaatgttatttatatcaatgaaactcacacaagacaccgcggatggcttgcaagacgcctttcttacgttctttttattcaagagcgagatgtgcataagggcatgtttgccaccaatgtgactgaaaatgtgctgaacagcagtagagtacaagaggcaattgcagaagtggctgctgaattaaaccctgatggttctgcccagcagcaatcaaaagccgttaacaaagtgaaaaagaaagctaaaaggattcttcaagaaatggttgccactgtctcaccggcaatgatcagactgactgggtgggtgctgctaaaactgttcaacagcttcttttggaacattcaaattcacaaaggtcaacttgagatggttaaagctgcaactgagacgaatttgccgcttctgtttctaccagttcatagatcccatattgactatctgctgctcactttcattctcttctgccataacatcaaagcaccatacattgcttcaggcaataatctcaacatcccaatcttcagtaccttgatccataagcttgggggcttcttcatacgacgaaggctcgatgaaacaccagatggacggaaagatgttctctatagagctttgctccatgggcatatagttgaattacttcgacagcagcaattcttggagatcttcctggaaggcacacgttctaggagtggaaaaacctcttgtgctcgggcaggacttttgtcagttgtggtagatactctgtctaccaatgtcatcccagacatcttgataatacctgttggaatctcctatggtcgcattatcgaaggtcactacaatggtgaacaactgggcaaacctaagaagaatgagagcctgtggagtgtagcaagaggtgttattagaatgttacgaaaaaactatggttgtgtccgagtggattttgcacagccattttccttaaaggaatatttagaaagccaaagtcagaaaccggtgtctgctctactttccctggagcaagcgttgttaccagctatacttccttcaagacccagtgatgctgctgatgagggtagagacacgtccattaatgagtccagaaatgcaacagatgaatccctacgaaggaggttgattgcaaatctggctgagcatattctattcactgctagcaagtcctgtgccattatgtccacacacattgtggcttgcctgctcctctacagacacaggcagggaattgatctctccacattggtcgaagacttctttgtgatgaaagaggaagtcctggctcgtgattttgacctggggttctcaggaaattcagaagatgtagtaatgcatgccatacagctgctgggaaattgtgtcacaatcacccacactagcaggaacgatgagttttttatcacccccagcacaactgtcccatcagtcttcgaactcaacttctacagcaatggggtacttcatgtctttatcatggaggccatcatagcttgcagcctttatgcagttctgaacaagaggggactggggggtcccactagcaccccacctaacctgatcagccaggagcagctggtgcggaaggcggccagcctgtgctaccttctctccaatgaagccaccatctcactgccttgccagacattttaccaagtctgccatgaaacagtaggaaagtttatccagtatggcattcttacagtggcagagcacgatgaccaggaagatatcagtcctagtcttgctgagcagcagtgggacaagaagcttcctgaacctttgtcttggagaagtgatgaagaagatgaagacagtgactttggggaggaacagcgagattgctacctgaaggtgagccaatccaaggagcaccagcagtttatcaccttcttacagagactccttgggcctttgctggaggcctacagctctgctgccatctttgttcacaacttcagtggtcctgttccagaacctgagtatctgcaaaagttgcacaaatacctaataaccagaacagaaagaaatgttgcagtatatgctgagagtgccacatattgtcttgtgaagaatgctgtgaaaatgtttaaggatattggggttttcaaggagaccaaacaaaagagagtgtctgttttagaactgagcagcacttttctacctcaatgcaaccgacaaaaacttctagaatatattctgagttttgtggtgctgtaggtaacgtgtggcactgctggcaaatgaaggtcatgagatgagttccttgtaggtaccagcttctggctcaagagttgaaggtgccgtcgcagggtcaggcctgccctgtcccgaggtgatctcctggaagacaagtgccttctccctccatggatctgtgatcttcccagctctgcatcaacacagcagcctgcagataacacttggggggacctcagcctctattcgcaactcataatccgtagactacaagatgaaatctcaataaattatttttgagtttattaaagattgacattttaagtacaacgtttaaggactaattactgtgatggacacagaaatgtagctgtgttctggaactgaatcttacatggtatacttagtgctgctgggtaatttgttggtatattatctggttagtggttaatgcttcctttaaaaataattgagtcatccattcactctttttcagttttatctgtcaatagtagctacatttttaatgggagcaccttttatcccaaagtgctttataaattgagtggactgatatatatcacacccaggtatcactgtgctgtcctttgctgtcagatttagaaatgtttttaagagctatatgaaaacagacaatattagtttaggtcgggaactgagatattgtaatcaaatagttaacatcaggaagttaatttggctggcaaaattctagggaaacttggccagaaaactggtgttgaaggcttttgctcatataaacaagtgccattgagtttcaaatgaccagcaaatatatttagaacccttcctgttttatgtctgtacctcgtccacccctcaggtaatacctgcctctcacaggtacagctgtttcttggaaatcctccaaccaaatagcagttttcctaacttgattagcttgagctgacagactgttagaatacagttctctggccacagctgatgagggctttctgtactgcacacagattgtgtactgcaccccagtccaggtgactggtacccactcgagttgtgccgtgcacaacctgtccagtatatgcatgtggtggccctactgactggtaatggttagaggcatttatggatttttaactttgaggaaaaaccatgacttttaacaaatttttatgggttatatgcctaaacccttatgccacatagtggtaaataattatgaaaaatggtctgttcataattggtaggtgccttttgtgagcagggagcataattattggtttattatggtaattatggtgattttttaaatatcatgtaatgttaaaacgttttctaacagtttactgttgcttatctccaagatattatggaattaagaatttttccagatgagtgttacatagattctttgaatttagtataaaagtactgagaattaagtttgtacttccataagcttggattttaaacactgatagtatctcatgagtaatgtgtgttttgggagagggagggatgctgattgatatttcacattgtatgaaataccatgtttgaaactcatagcaataatgctatgctgttgtgatccctctcaagttctgcatttaaaatatattttttctttataggaattgatgtataccatgaagtcattgtcagttgtagtagctctgatgttgaaagagatatcatgttttagcattccattttactgactagggtagaagaacacttttcttggctacatttggaggatacccagggagtcttgggtgttccttatctggggaagcaaacatttcactagtctctttttttcatcctttaaattgtaaattaaggattactcaagctcaccattattcaagattgggactcgcttcccagtcgacactctgccctgcctgtcattgctgcaaagagctgctgctttgccaacctaagcaaagaaaatacggcttctcttgcattattttcccttttggttggtttgttttctagaagtacgttcagatgctttggggaatgcaatgtatgatttgctagctctctcaccacttaactcactgtgaggataaatatgcatgctttttgtaattaactggtgctttgaaaaccttttttaagggagaaaaatctcaaccaaagttatgctcatccagacaagctgacctttgagttaatttcagcacaactcattcttcagtgcctcatgactgaaaacaaaaaacaaaaaaacgaaagcatcttcacaatgaagcttccagatagcaccgttttgctaaaagatacattctcattgttttccaacagtgatggcttccacataaggttaaacaaactaggtgcttgtaaataatttattacagtttactctatcgcatttctgtaacatgaaatgcatgcccttcttcaggggaagactgtggtcaagttaaaaaaaaaaacaatattaaacaacatgaaactgcagtctgtttttgaaaatgagaatgtcctaagtgattcagaagagaggagggaagttgtgcactctgaaaatgcatgaaaaacaaaggcaaaaactagtgggaaatgtgtagaactgttaactgagacggcttcgagtcttccttctggaatctgttaaatttcacaaagtcatgagggtaaatggagaaaatatttctgggattacaatgaatgtaagcccaaattgtggaattgccagtaacctggatggggaaaagcatttcccatggcactccatgtaatatgagtgctctgtgagatgttcatcagtgttttatagaaatggtgttgctgggaaaccaagtttgcacctggaaacttacaatgcactttagcgcagtaagggcttggcatccggtagtgaaaaactgtctaacccagcattgcccaaactattttgacaccaggacctttttctcctttgggatacttatgaacctctcactaatgtcctgtggagaacattttgggaaacactatgttagatagttctttaaggagacaaaacggtaatgaacagatagcactggggcagaatatgcatgcattttgtaacgtccagtgtggcgttgaatagatgtgtatttcctcccctgcagaaaataagcacagaaaattataatgtaggtgatcggagctctttcctttgatagagagaacagccccaatgatcctggctttttcactgaacgtatcagaatacatggatgaattggggtaaataaggttttaattcagatctagaagaaagtattgtacgtttgaatgcagatttttatccacagatagttgtagtgtttagacatgacaggacctatcgttgaggtttctaagacttactatgggctgtaaacctgttttttaaaactattttagaaacctgagacttgccgtctggcattttagtttaatacaaactaatgattgcatttgaaagagattcttgaccttatttctaaacgtctagagctctgaaatgtcttgatggaaggtattaaactatttgcctgttgtacaaagaaatgttaagactcgtgaaaagaattactataaggtactgtgaaataactgcgattttgtgagcaaaacatacttggaaatgctgattgatttttatgcttgttagtgtattgcaagaaacacagaaaatgtagttttgttttaataaaccaaaaattgaacatacaaaaaaaaaaaaaaaaaaa

SEQ ID NO: 54811 - DNA, 2910 bp, Homo sapiens
ctcactttaccactactcgctatagagccctggtcaagttctctccacctctctatctatgtctcagtttcttcatctgtaacatcaaatgaataataataccaatctcctagacttcataagaggattaacaaagacaaaatatgggaaaaacataacatggcgtcccataattattagatcttattattgacactaaaatggcattaaaattaccaaaaggaagacagcatctgtttcctctttggtcctgagctggttaaaaggaacactggttgcctgaacagtcacacttgcaaccatgatgcctaaacattgctttctaggcttcctcatcagtttcttccttactggtgtagcaggaactcagtcaacgcatgagtctctgaagcctcagagggtacaatttcagtcccgaaattttcacaacattttgcaatggcagcctgggagggcacttactggcaacagcagtgtctattttgtgcagtacaaaatcatgttctcatgcagcatgaaaagctctcaccagaagccaagtggatgctggcagcacatttcttgtaacttcccaggctgcagaacattggctaaatatggacagagacaatggaaaaataaagaagactgttggggtactcaagaactctcttgtgaccttaccagtgaaacctcagacatacaggaaccttattacgggagggtgagggcggcctcggctgggagctactcagaatggagcatgacgccgcggttcactccctggtgggaaacaaaaatagatcctccagtcatgaatataacccaagtcaatggctctttgttggtaattctccatgctccaaatttaccatatagataccaaaaggaaaaaaatgtatctatagaagattactatgaactactataccgagtttttataattaacaattcactagaaaaggagcaaaaggtttatgaaggggctcacagagcggttgaaattgaagctctaacaccacactccagctactgtgtagtggctgaaatatatcagcccatgttagacagaagaagtcagagaagtgaagagagatgtgtggaaattccatgacttgtggaatttggcattcagcaatgtggaaattctaaagctccctgagaacaggatgactcgtgtttgaaggatcttatttaaaattgtttttgtattttcttaaagcaatattcactgttacaccttggggacttctttgtttatccattcttttatcctttatatttcatttgtaaactatatttgaacgacattccccccgaaaaattgaaatgtaaagatgaggcagagaataaagtgttctatgaaattcagaactttatttctgaatgtaacatccctaataacaaccttcattcttctaatacagcaaaataaaaatttaacaaccaaggaatagtatttaagaaaatgttgaaataatttttttaaaatagcattacagactgaggcggtcctgaagcaatggtttttcactctcttattgagccaattaaattgacattgctttgacaatttaaaacttctataaaggtgaatatttttcatacatttctattttatatgaatatactttttatatatttattattattaaatatttctacttaatgaatcaaaattttgttttaaagtctactttatgtaaataagaacaggttttggggaaaaaaatcttatgatttctggattgatatctgaattaaaactatcaacaacaaggaagtctgctctgtacaattgtccctcatttaaaagatatattaagcttttcttttctgtttgtttttgttttgtttagtttttaatcctgtcttagaagaacttatctttattctcaaaattaaatgtaatttttttagtgacaaagaagaaaggaaacctcattactcaatccttctggccaagagtgtcttgcttgtggcgccttcctcatctctatataggaggatcccatgaatgatggtttattgggaactgctggggtcgaccccatacagagaactcagcttgaagctggaagcacacagtgggtagcaggagaaggaccggtgttggtaggtgcctacagagactatagagctagacaaagccctccaaactggcccctcctgctcactgcctctcctgagtagaaatctggtgacctaaggctcagtgtggtcaacagaaagctgccttcttcacttgaggctaagtcttcatatatgtttaaggttgtctttctagtgaggagatacatatcagagaacatttgtacaattccccatgaaaattgctccaaagttgataacaatatagtcggtgcttctagttatatgcaagtactcagtgataaatggattaaaaaatattcagaaatgtattggggggtggaggagaataagaggcagagcaagagctagagaattggtttccttgcttccctgtatgctcagaaaacattgatttgagcatagacgcagagactgaaaaaaaaatttactttgatctctgtttttgaattcttattatttatattttgcttactaccttttttgccttttgtccttttgtggagagggcgatgaattaagagtagtggggtgggtggcgagtaagtaaaatttcaaatagcattttagtgaatgcaattcagtagtcctgaagcctgacttaataaaacaaaattcatttatggttgtttcatgaaagttattagataggatcaagttttgtttgtatattgtttgccttgctctgtttttgcttttgtgcttaggcaagtgcaaaatactctatggaaatcataattgtcatcttcttcatggtgttagggatatattgtcacatgatttcaataaatcctttttttgctttaaaaaaaaaaaaaa

SEQ ID NO: 54812 - DNA, 2814 bp, Homo sapiens
ctcactttaccactactcgctatagagccctggtcaagttctctccacctctctatctatgtctcagtttcttcatctgtaacatcaaatgaataataataccaatctcctagacttcataagaggattaacaaagacaaaatatgggaaaaacataacatggcgtcccataattattagatcttattattgacactaaaatggcattaaaattaccaaaaggaagacagcatctgtttcctctttggtcctgagctggttaaaaggaacactggttgcctgaacagtcacacttgcaaccatgatgcctaaacattgctttctaggcttcctcatcagtttcttccttactggtgtagcaggaactcagtcaacgcatgagtctctgaagcctcagagggtacaatttcagtcccgaaattttcacaacattttgcaatggcagcctgggagggcacttactggcaacagcagtgtctattttgtgcagtacaaaatatatggacagagacaatggaaaaataaagaagactgttggggtactcaagaactctcttgtgaccttaccagtgaaacctcagacatacaggaaccttattacgggagggtgagggcggcctcggctgggagctactcagaatggagcatgacgccgcggttcactccctggtgggaaacaaaaatagatcctccagtcatgaatataacccaagtcaatggctctttgttggtaattctccatgctccaaatttaccatatagataccaaaaggaaaaaaatgtatctatagaagattactatgaactactataccgagtttttataattaacaattcactagaaaaggagcaaaaggtttatgaaggggctcacagagcggttgaaattgaagctctaacaccacactccagctactgtgtagtggctgaaatatatcagcccatgttagacagaagaagtcagagaagtgaagagagatgtgtggaaattccatgacttgtggaatttggcattcagcaatgtggaaattctaaagctccctgagaacaggatgactcgtgtttgaaggatcttatttaaaattgtttttgtattttcttaaagcaatattcactgttacaccttggggacttctttgtttatccattcttttatcctttatatttcatttgtaaactatatttgaacgacattccccccgaaaaattgaaatgtaaagatgaggcagagaataaagtgttctatgaaattcagaactttatttctgaatgtaacatccctaataacaaccttcattcttctaatacagcaaaataaaaatttaacaaccaaggaatagtatttaagaaaatgttgaaataatttttttaaaatagcattacagactgaggcggtcctgaagcaatggtttttcactctcttattgagccaattaaattgacattgctttgacaatttaaaacttctataaaggtgaatatttttcatacatttctattttatatgaatatactttttatatatttattattattaaatatttctacttaatgaatcaaaattttgttttaaagtctactttatgtaaataagaacaggttttggggaaaaaaatcttatgatttctggattgatatctgaattaaaactatcaacaacaaggaagtctgctctgtacaattgtccctcatttaaaagatatattaagcttttcttttctgtttgtttttgttttgtttagtttttaatcctgtcttagaagaacttatctttattctcaaaattaaatgtaatttttttagtgacaaagaagaaaggaaacctcattactcaatccttctggccaagagtgtcttgcttgtggcgccttcctcatctctatataggaggatcccatgaatgatggtttattgggaactgctggggtcgaccccatacagagaactcagcttgaagctggaagcacacagtgggtagcaggagaaggaccggtgttggtaggtgcctacagagactatagagctagacaaagccctccaaactggcccctcctgctcactgcctctcctgagtagaaatctggtgacctaaggctcagtgtggtcaacagaaagctgccttcttcacttgaggctaagtcttcatatatgtttaaggttgtctttctagtgaggagatacatatcagagaacatttgtacaattccccatgaaaattgctccaaagttgataacaatatagtcggtgcttctagttatatgcaagtactcagtgataaatggattaaaaaatattcagaaatgtattggggggtggaggagaataagaggcagagcaagagctagagaattggtttccttgcttccctgtatgctcagaaaacattgatttgagcatagacgcagagactgaaaaaaaaatttactttgatctctgtttttgaattcttattatttatattttgcttactaccttttttgccttttgtccttttgtggagagggcgatgaattaagagtagtggggtgggtggcgagtaagtaaaatttcaaatagcattttagtgaatgcaattcagtagtcctgaagcctgacttaataaaacaaaattcatttatggttgtttcatgaaagttattagataggatcaagttttgtttgtatattgtttgccttgctctgtttttgcttttgtgcttaggcaagtgcaaaatactctatggaaatcataattgtcatcttcttcatggtgttagggatatattgtcacatgatttcaataaatcctttttttgctttaaaaaaaaaaaaaa

SEQ ID NO: 54813 - DNA, 2644 bp, Homo sapiens
ctcactttaccactactcgctatagagccctggtcaagttctctccacctctctatctatgtctcagtttcttcatctgtaacatcaaatgaataataataccaatctcctagacttcataagaggattaacaaagacaaaatatgggaaaaacataacatggcgtcccataattattagatcttattattgacactaaaatggcattaaaattaccaaaaggaagacagcatctgtttcctctttggtcctgagctggttaaaaggaacactggttgcctgaacagtcacacttgcaaccatgatgcctaaacattgctttctaggcttcctcatcagtttcttccttactggtgtagcaggaactcagtcaacgcatgagtctctgaagcctcagagggtacaatttcagtcccgaaattttcacaacattttgcaatggcagcctgggagggcacttactggcaacagcagtgtctattttgtgcagtacaaaatatatggacagagacaatggaaaaataaagaagactgttggggtactcaagaactctcttgtgaccttaccagtgaaacctcagacatacaggaaccttattacgggagggtgagggcggcctcggctgggagctactcagaatggagcatgacgccgcggttcactccctggtgggaaagagcaaaaggtttatgaaggggctcacagagcggttgaaattgaagctctaacaccacactccagctactgtgtagtggctgaaatatatcagcccatgttagacagaagaagtcagagaagtgaagagagatgtgtggaaattccatgacttgtggaatttggcattcagcaatgtggaaattctaaagctccctgagaacaggatgactcgtgtttgaaggatcttatttaaaattgtttttgtattttcttaaagcaatattcactgttacaccttggggacttctttgtttatccattcttttatcctttatatttcatttgtaaactatatttgaacgacattccccccgaaaaattgaaatgtaaagatgaggcagagaataaagtgttctatgaaattcagaactttatttctgaatgtaacatccctaataacaaccttcattcttctaatacagcaaaataaaaatttaacaaccaaggaatagtatttaagaaaatgttgaaataatttttttaaaatagcattacagactgaggcggtcctgaagcaatggtttttcactctcttattgagccaattaaattgacattgctttgacaatttaaaacttctataaaggtgaatatttttcatacatttctattttatatgaatatactttttatatatttattattattaaatatttctacttaatgaatcaaaattttgttttaaagtctactttatgtaaataagaacaggttttggggaaaaaaatcttatgatttctggattgatatctgaattaaaactatcaacaacaaggaagtctgctctgtacaattgtccctcatttaaaagatatattaagcttttcttttctgtttgtttttgttttgtttagtttttaatcctgtcttagaagaacttatctttattctcaaaattaaatgtaatttttttagtgacaaagaagaaaggaaacctcattactcaatccttctggccaagagtgtcttgcttgtggcgccttcctcatctctatataggaggatcccatgaatgatggtttattgggaactgctggggtcgaccccatacagagaactcagcttgaagctggaagcacacagtgggtagcaggagaaggaccggtgttggtaggtgcctacagagactatagagctagacaaagccctccaaactggcccctcctgctcactgcctctcctgagtagaaatctggtgacctaaggctcagtgtggtcaacagaaagctgccttcttcacttgaggctaagtcttcatatatgtttaaggttgtctttctagtgaggagatacatatcagagaacatttgtacaattccccatgaaaattgctccaaagttgataacaatatagtcggtgcttctagttatatgcaagtactcagtgataaatggattaaaaaatattcagaaatgtattggggggtggaggagaataagaggcagagcaagagctagagaattggtttccttgcttccctgtatgctcagaaaacattgatttgagcatagacgcagagactgaaaaaaaaatttactttgatctctgtttttgaattcttattatttatattttgcttactaccttttttgccttttgtccttttgtggagagggcgatgaattaagagtagtggggtgggtggcgagtaagtaaaatttcaaatagcattttagtgaatgcaattcagtagtcctgaagcctgacttaataaaacaaaattcatttatggttgtttcatgaaagttattagataggatcaagttttgtttgtatattgtttgccttgctctgtttttgcttttgtgcttaggcaagtgcaaaatactctatggaaatcataattgtcatcttcttcatggtgttagggatatattgtcacatgatttcaataaatcctttttttgctttaaaaaaaaaaaaaa

SEQ ID NO: 54814 - DNA, 3426 bp, Homo sapiens
gtaggaatcgcagcgccaacggttgcaaggcccaagaagccatcctgggaaggaaaatgcattggggaaccctgtgcggattcttgtggctttggccctatcttttctatgtccaagctgtgcccatccaaaaagtccaagatgacaccaaaaccctcatcaagacaattgtcaccaggatcaatgacatttcacacacgcagtcagtctcctccaaacagaaagtcaccggtttggacttcattcctgggctccaccccatcctgaccttatccaagatggaccagacactggcagtctaccaacagatcctcaccagtatgccttccagaaacgtgatccaaatatccaacgacctggagaacctccgggatcttcttcacgtgctggccttctctaagagctgccacttgccctgggccagtggcctggagaccttggacagcctggggggtgtcctggaagcttcaggctactccacagaggtggtggccctgagcaggctgcaggggtctctgcaggacatgctgtggcagctggacctcagccctgggtgctgaggccttgaaggtcactcttcctgcaaggactacgttaagggaaggaactctggcttccaggtatctccaggattgaagagcattgcatggacaccccttatccaggactctgtcaatttccctgactcctctaagccactcttccaaaggcataagaccctaagcctccttttgcttgaaaccaaagatatatacacaggatcctattctcaccaggaagggggtccacccagcaaagagtgggctgcatctgggattcccaccaaggtcttcagccatcaacaagagttgtcttgtcccctcttgacccatctccccctcactgaatgcctcaatgtgaccaggggtgatttcagagagggcagaggggtaggcagagcctttggatgaccagaacaaggttccctctgagaattccaaggagttccatgaagaccacatccacacacgcaggaactcccagcaacacaagctggaagcacatgtttatttattctgcattttattctggatggatttgaagcaaagcaccagcttctccaggctctttggggtcagccagggccaggggtctccctggagtgcagtttccaatcccatagatgggtctggctgagctgaacccattttgagtgactcgagggttgggttcatctgagcaagagctggcaaaggtggctctccagttagttctctcgtaactggtttcatttctactgtgactgatgttacatcacagtgtttgcaatggtgttgccctgagtggatctccaaggaccaggttattttaaaaagatttgttttgtcaagtgtcatatgtaggtgtctgcacccaggggtggggaatgtttgggcagaagggagaaggatctagaatgtgttttctgaataacatttgtgtggtgggttctttggaaggagtgagatcattttcttatcttctgcaattgcttaggatgtttttcatgaaaatagctctttcaggggggttgtgaggcctggccaggcaccccctggagagaagtttctggccctggctgaccccaaagagcctggagaagctgatgctttgcttcaaatccatccagaataaaacgcaaagggctgaaagccatttgttggggcagtggtaagctctggctttctccgactgctagggagtggtctttcctatcatggagtgacggtcccacactggtgactgcgatcttcagagcaggggtccttggtgtgaccctctgaatgggtccagggttgatcacactctgggtttattacatggcagtgttcctatttggggcttgcatgccaaattgtagttcttgtctgattggctcacccaagcaaggccaaaattaccaaaaatcttggggggtttttactccagtggtgaagaaaactcctttagcaggtggtcctgagacctgacaagcactgctaggcgagtgccaggactccccaggccaggccaccaggatgcccttcccactggaggtcacattcaggaagatgaaagaggaggtttggggtctgccaccatcctgctgctgtgtttttgctatcacacagtgggtggtggatctgtccaaggaaacttgaatcaaagcagttaactttaagactgagcacctgcttcatgctcagccctgactggtgctataggctggagaagctcacccaataaacattaagattgaggcctgccctcagggatcttgcgttcccagtggtcaaaccgcactcacccatgtgccaaggtggggtatttaccacagcagctgaacagccaaatgcatggtgcagttgacagcaggtgggaaatggtatgagctgaggggggccgtgcccaggggcccacagggaaccctgcttgcactttgtaacatgtttacttttcagggcatcttagcttctattatagccacatccctttgaaacaagataactgagaatttaaaaataagaaaatacataagaccataacagccaacaggtggcaggaccaggactatagcccaggtcctctgatacccagagcattacgtgagccaggtaatgagggactggaaccagggagaccgagcgctttctggaaaagaggagtttcgaggtagagtttgaaggaggtgagggatgtgaattgcctgcagagagaagcctgttttgttggaaggtttggtgtgtggagatgcagaggtaaaagtgtgagcagtgagttacagcgagaggcagagaaagaagagacaggagggcaagggccatgctgaagggaccttgaagggtaaagaagtttgatattaaaggagttaagagtagcaagttctagagaagaggctggtgctgtggccagggtgagagctgctctggaaaatgtgacccagatcctcacaaccacctaatcaggctgaggtgtcttaagccttttgctcacaaaacctggcacaatggctaattcccagagtgtgaaacttcctaagtataaatggttgtctgtttttgtaacttaaaaaaaaaaaaaaaagtttggccgggtgcggtggctcacgcctgtaatcccagcactttgggaggccaaggtggggggatcacaaggtcactagatggcgagcatcctggccaacatggtgaaaccccgtctctactaaaaacacaaaagttagctgagcgtggtggcgggcgcctgtagtcccagccactcgggaggctgagacaggagaatcgcttaaacctgggaggcggagagtacagtgagccaagatcgcgccactgcactccggcctgatgacagagcgagattccgtcttaaaaaaaaaaaaaaaaaaagtttgtttttaaaaaaatctaaataaaataactttgccccctg

SEQ ID NO: 54815 - DNA, 2995 bp, Homo sapiens
ggccgcccatgaagcagcggttctcggcgctgcagctgctgaagctgctgctgctgctgcagccgccgctgccacgagcgctgcgcgaggcgctctgccctgagccctgcaactgcgtgcccgacggcgccctgcgctgccccggccccacggccggtctcactcgactatcacttgcctacctccctgtcaaagtgatcccatctcaagctttcagaggacttaatgaggtcataaaaattgaaatctctcagattgattccctggaaaggatagaagctaatgcctttgacaacctcctcaatttgtctgaaatactgatccagaacaccaaaaatctgagatacattgagcccggagcatttataaatcttcccggattaaaatacttgagcatctgtaacacaggcatcagaaagtttccagatgttacgaaggtcttctcctctgaatcaaatttcattctggaaatttgtgataacttacacataaccaccataccaggaaatgcttttcaagggatgaataatgaatctgtaacactcaaactatatggaaatggatttgaagaagtacaaagtcatgcattcaatgggacgacactgacttcactggagctaaaggaaaacgtacatctggagaagatgcacaatggagccttccgtggggccacagggccgaaaaccttggatatttcttccaccaaattgcaggccctgccgagctatggcctagagtccattcagaggctaattgccacgtcatcctattctctaaaaaaattgccatcaagagaaacatttgtcaatctcctggaggccacgttgacttaccccagccactgctgtgcttttagaaacttgccaacaaaagaacagaatttttcacattccatttctgaaaacttttccaaacaatgtgaaagcacagtaaggaaagtgagtaacaaaacactttattcttccatgcttgctgagagtgaactgagtggctgggactatgaatatggtttctgcttacccaagacaccccgatgtgctcctgaaccagatgcttttaatccctgtgaagacattatgggctatgacttccttagggtcctgatttggctgattaatattctagccatcatgggaaacatgactgttctttttgttctcctgacaagtcgttacaaacttacagtgcctcgttttctcatgtgcaatctctcctttgcagacttttgcatggggctctatctgctgctcatagcctcagttgattcccaaaccaagggccagtactataaccatgccatagactggcagacagggagtgggtgcagcactgctggctttttcactgtattcgcaagtgaactttctgtctacaccctcaccgtcatcactctagaaagatggcacaccatcacctatgctattcacctggaccaaaagctgcgattaagacatgccattctgattatgcttggaggatggctcttttcttctctaattgctatgttgccccttgtcggtgtcagcaattacatgaaggtcagtatttgcttccccatggatgtggaaaccactctctcacaagtctatatattaaccatcctgattctcaatgtggtggccttcttcataatttgtgcttgctacattaaaatttattttgcagttcgaaacccagaattaatggctaccaataaagatacaaagattgctaagaaaatggcaatcctcatcttcaccgatttcacctgcatggcacctatctctttttttgccatctcagctgccttcaaagtacctcttatcacagtaaccaactctaaagttttactggttcttttttatcccatcaattcttgtgccaatccatttctgtatgcaatattcactaagacattccaaagagatttctttcttttgctgagcaaatttggctgctgtaaacgtcgggctgaactttatagaaggaaagatttttcagcttacacctccaactgcaaaaatggcttcactggatcaaataagccttctcaatccaccttgaagttgtccacattgcactgtcaaggtacagctctcctagacaagactcgctacacagagtgttaactgttacatcagtaactgcattattgaattgttcttaaacctgtaaaaaaaaattacctgtaccagtaattttaacataaagggttggatttaggaaattatttatttttaggtacattaggcaagagacctctacctagtagaaagtgtagtctatgaccactgccacacgtaaaaactatttgtcattgttacatggcataaatatgaagttgagagtgtttagaaatttttatagaaattttgacacagtaattttgtttgatgaatcttttaaaaaacagaggaggtattttgcatatctttttttcattttcgtaatttgtattgcattctataaaaatattagttcataacagatcagaaatttaaaataaggggctttttcctcaggtagtttgaaaaacacactctagagatgcactgttcaattcggtacgcactagccacatgtggctaaattaaaattaaataaaatgagaaatgtagtttctcagttgcactacgtttcaagttctcaatggctacgtcaagttctcaatggctacgtgtgactagtgcttaccatactggacagcacagacacagaatattttcatcaccacagaaagttctatctgttctattatagagacttttatgtatgccctatctggattctacttatttataatttaaggtaaacatctgaaagcacatttcagcctatttgcttagtgaaacattaagctgtagactgtaaactcctcgtgagtaggaaccctgtctcagtgcattttgttttcctgcttcctacctcaagatcttggcaatggtacactacaaatgtgctgagttagaattactctgaagttatgaaacatataatgaaaacaatttttccggcc

SEQ ID NO: 54816 - DNA, 8329 bp, Homo sapiens
atgtcggcgaggggcgtgggagctgccacccgcttgcctgcgggacaccggagtcaagaggctgcccacgccgctgcctgtccgttccacggttccgaggtctccaccgtctccccgcgcgccgcaggcggcaccaaactctgcgctccccgcggtgcgccctgcccgcgcagtgcgcgtccagaggaaatccgccccgggctttcgaagtgcagggctgggggctgcatggaagtttccccaagatttgaagttgaagatttttcaggtcataatatgatgttgctaattttgttcctcgtgataatttgttcccatatttctgtgaaccaagattccggccctgagtatgcagatgttgtgtttttggtggacagctctgatcgcctgggatccaagtccttcccatttgtgaaaatgttcatcaccaaaatgatcagcagtctccccatagaggccgacaaataccgtgtggccctggcccagtacagtgataaacttcacagtgaattccacctgagcaccttcaaaggcaggagccccatgctgaaccacctaaggaagaactttggattcattggcgggtccctgcagataggaaaggctcttcaggaggctcacaggacttatttctctgcacccgcaaatgggagagacaagaaacagtttcccccaattctagtggtcctggcttcatctgagtctgaggataatgtggaagaggcatcaaaggccctgcggaaagacggagtgaaaatcatctctgtaggggtgcagaaagcttctgaggaaaacctgaaggccatggccacgtctcagtttcatttcaaccttcggacagtcagagacctcagcatgttttcccaaaacatgacacacatcatcaaggatgtaataaagtacaaggagggagcagttgatgacatctttgtagaagcttgccaaggcccttctatggccgatgttgtgttcctattggatatgtcaatcaatggaagtgaggagaactttgactatcttaaaggattcttggaagaaagtgtatctgcccttgacataaaggaaaattgcatgagggttggccttgtggcctatagcaatgagacaaaagtgataaattcactgagcatgggcataaataagtcagaggttctccagcatatacagaacctttctccccgaactgggaaggcctatactggagctgccatcaaaaagctcaggaaggaagtttttagtgcacggaatggcagtcggaagaatcagggggtgccccagattgccgtgctggtgacccaccgagattcagaagacaacgtgacaaaagcagctgttaacctccgacgggagggtgtgaccatcttcaccctgggcatagagggcgccagcgacacccagttggaaaagatagcatcccaccctgctgagcagtatgtctccaaactgaagaccttcgctgacctggctgctcacaaccagacatttctgaagaagctgcggaaccaaataacacacacagtctctgtcttttcagagaggactgaaacgctcaaatctggttgtgtggacactgaggaagcagacatctatctgcttatcgatggctcagggagcacccaggccacagatttccatgaaatgaagacgttcctgtcagaggtggtagggatgttcaacattgctccccataaggtgcgggttggggccgttcagtatgctgacagctgggacttggaatttgagatcaataaatactccaacaagcaggatttgggaaaggccattgagaatatcaggcagatgggtgggaatacaaacacaggcgcagcactgaatttcacactgagtctgttgcaaaaagcaaagaagcagcgaggaaacaaagttccatgccaccttgttgtcctgacaaatggcatgtccaaggatagcatcttggagcctgcaaacagactgagagaagagcacatccgagtttatgctatcgggatcaaggaggccaaccaaacacagctgagagaaattgcaggagaggaaaagagagtgtattacgtgcatgactttgatgcattgaaagacataagaaaccaagttgttcaagaaatctgtactgaagaagctgacttgaataaacatcacagtttttcctatgcagcttgcaaagagatgaaagctgacatcatgtttctggtggacagttctggaagtataggacctgaaaacttcagcaaaatgaaaacatttatgaaaaacctggtgagcaagtctcagattggaccagatcgggtgcaaattggtgtagtccagttcagcgacatcaataaggaagagtttcagctcaacagattcatgtcccaaagcgacatttcaaatgcaatagaccaaatggctcacattggacaaaccaccctgactggtagtgccctgagctttgtgtctcagtacttcagccccaccaagggcgcccggcccaacatcagaaagtttctcatcctcatcacggatggtgaagctcaggacatagtaaaggaaccagcagtagtgcttcggcaagaaggtgtaatcatctattctgtgggagtgtttggctccaatgtcacccagcttgaggagatcagtgggaggcccgagatggttttttatgttgagaattttgacattctgcagcgcattgaagatgatcttgtttttggaatatgcagcccccgtgaagaatgcaagcggattgaagttttagacgttgtgtttgtcattgatagctctggcagtattgactatgatgagtataatatcatgaaggattttatgattggcttagtgaaaaaagctgatgtgggcaagaatcaggtccggtttggggctctgaagtatgctgatgacccagaggtgctgttttatctggatgactttggcacaaaactggaggtaatttcagtgctccagaatgaccaagccatgggtggcagtacttatactgctgaggcactgggcttctcagaccacatgttcactgaagcccggggcagccgcctgaacaagggggtcccccaagtcctcattgtgatcaccgatggggaatcccatgatgctgataaactcaatgccacggcaaaggccttgcgggacaaaggcattcttgtcctggctgtggggattgatggtgccaatcccgtggagctgttagccatggcaggatcaagcgacaagtacttcttcgtggagacttttggaggtctgaagggaatattttcagatgtgacagccagtgtctgcaactcttcaaaagtagattgtgaaattgacaaagtagatcttgttttccttatggatggttcaactagcattcagccaaatgacttcaagaaaatgaaggaatttctggcatctgttgttcaagactttgatgtcagcctcaacagagtgcgaataggagcggcccagtttagcgatacctatcacccggagtttccactgggaactttcataggtgaaaaagagatatcatttcagattgaaaacatcaagcagatctttggaaacacacacatcggtgctgcactcagggaggtggaacattacttcaggccagacatgggcagcaggataaatacaggtaccccacaggtgctgctggtccttacagatggccagtcccaagacgaggtggcccaggccgcggaagccctgagacacagaggtatcgacatctactccgtgggcattggggatgtggatgaccagcagctcattcagatcaccgggactgcagagaaaaaactgacagtgcacaacttcgatgaactgaagaaggtcaataaaaggatcgttcgcaacatctgtaccacagcgggtgaaagcaactgtttcgtggatgttgtggtgggatttgatgtctcaactcaggagaaagggcagactttgcttgaaggtcagccttggatggaaacctaccttcaagacatcttacgtgccatcagctccctcaatggagtaagctgtgaggtgggcacagagactcaggtcagtgtggcttttcaagtgaccaatgccatggaaaaatattctcccaagtttgagatctacagtgaaaacatactgaatagcttgaaggatataacagttaaaggaccatctcttctcaatgcaaacctcttggattctctatgggatacatttcagaataaatcagctgctcgaggaaaggtggtccttttattttcagatggattggatgatgatgttgagaaacttgaacaaaaatctgatgaacttagaaaagaaggcctgaatgccctcataactgttgctctggatggacctgctgattcaagtgacttggctgatcttccctatattgaatttgggaaaggatttgagtacaggacacagctctctattggcatgagagaacttggaagccggctgtcaaagcagctggtcaatgttgctgaaaggacatgctgctgtttgttctgcaagtgcattggaggagatggcacaatgggagatcctggaccaccagggaaaaggggacctccaggttttaaaggcagtgaaggctacctgggagaggagggaatcgctggagaaagaggagcccctggaccagtgggagagcaaggtactaagggatgctatggcaccaaaggtcctaagggaaacagaggactaaatggacaggagggagaagttggggaaaatggaattgacggattaaacggagaacagggtgataatggtcttcctggaagaaaaggagaaaagggagatgagggatctcagggaagcccagggaagagagggactcctggtgaccgtggagcaaagggcctgcgaggggatcccgtaagtgcacgggctgcaaactggagttagggcttgattcccatccgtacttctgatagggagtctcgatttcaagggagctcctggagttgacagtagcatagaaggacccacaggcttgaaaggagaacgtggaagacaaggcagaagaggctggccaggcccccccgggacaccaggctccagaagaaagacagcagctcatggcagaaggggacatacaggcccacagggaacagcaggcatcccaggaccagatggacttgaaggctccctgggacttaagggccctcagggcccaagaggagaggctggtgtgaaaggagaaaaaggaggtgtgggaagtaaaggtccccaggggcctccaggacccggaggagaggcagggaatcaaggccgtttgggaagccaaggaaataaaggagaacctggagatctgggagaaaaaggagctgttggctttcctggtcctcgtggcttgcagggcaatgatggcagtccaggttatggtagtgtcggacgcaagggagcaaagggacaagaaggattccctggagaaagtggacctaagggtgagattggggaccctggtggtccaggagagactgggctgaagggagctagaggcaaaatgatatctgctgggcttccaggagagatgggatcccctggggaaccaggacctcctggacgtaagggtgtgaaaggagccaaaggcttggcttcattttctacatgtgagctcattcagtatgtgcgagaccgcagtcctggcaggcatgattgacgacactggcacatttcaagtaatagtggttccctccggggccgactacataccagcattagagagactccagcggtgcactttctgctatgatgtgtgcaagccagatgcttcttgtgaccaagccagaccaccccctgtgcagtcttacatggatgctgctttccttctggatgcctcccggaacatgggaagtgctgaatttgaagacataagagccttccttggagcactattagatcactttgaaatcaccccagagccggagacttctgtcactggagaccgggtggccctattgagccatgctccccccgacttcctacccaacactcagaagagtccagttagagctgagttcaatcttaccacctacagaagtaagcgcctcatgaagaggcatgtgcacgagtcagttaaacaactaaatggagatgcttttattggtcatgccttacagtggactctggacaatgtatttttaagtacacccaatctgagaagaaacaaagtcatatttgtgatatctgctggggaaaccagccacttagatggggaaatcttaaagaaggaatccttgcgagccaaatgtcagggatatgccttatttgtgttttcccttggccctatttgggatgacaaggaactggaggatctcgccagccaccctttggatcaccacctggtccagcttggccgaattcataaacctgaccacagttatggtgtgaagtttgtgaagtcctttataaactcaatcaggcgtgcaatcaacaaatatccaccaataaacttaaaaataaagtgcaacagacttaactctatagatccaaagcagcccccacgaccattccgaagctttgttcctggaccacttaaagctaccctcaaagaagatgtattacagaaggcaaaattctttcaagataaaaaatatctttcaagagtagcaagaagtggcagagatgatgctattcaaaattttatgagaagcacctcccatacctttaagaatggaaggatgatagaaagtgctcccaaacaacatgattaaaaaaatgcttgaacaacttagccttaggaagcatggtaagactctggacttaaatagtaactaaatctgctgccagaactcaagcaacagtttgtaggttatcaggtgacttgaccccctgcattcattggtattaagatatatcttgttcatttatttgaccactcctgacaattccagcactctacgactgatatgtcgaagaactgtttcattagaagacagaagaatgaaagaagtgttttgaaaagtctaatggagatataatttgaaggtaaaatttatatgatgtatgcatatgtgtacatgggtcaatgttaattcttttatctctgtccagttcattttctgcaaacccatcctcctttcctaatttagtaatgtctaatgctcatctatttagtcaaagttattttttaatgttttaagctactccaaaatttatcctagaaatggatgctgtttatatgtcgtatttttttaaaacgtgaccttctattccacttaaacacaccactgtgggagttgtttgcttggactgatgagaagagggtaattttctccatctctaaatcctcctgaactcactgaaaaactcattaattcccgcagaacataaattattgcttttgagctggaagttttctcttcattaggaagcttactgccattttgatggagcttgaagcccccattttgatggacttctagtctgtctttcctgttatggtcatttattaattttcactaatccatatattctttagacaaggagagtcaagaaactacttgtcatagatgaagctctgagttacttttacccatcaggtagctgtttagtcaataataaacagcaccaaaacaggattagcagagctcttaaaaacagccttaaatacacactgagtttagaaaaatgtaagaaaatcattgttttaatctacaaattcatatgcagttgcagagatgcaaaagagatcagagtaagttaaagtaggaaaggttttataaaagtattgatggctgtgtcctcatctgcatttttgtttttatgatagggctgatattttcaacaacgaaacacccaatgttcagaccttacctcagtctaagagctggctccacagttggtagcaatggccctgttaggcagactgtccccctctttgggaatggaaagaagccctgcctggatgcatggagcagatggatactgacaccaaggacattcagattttctttcctatacctattttcataaaatttggaaagaaaaactatctgcagtatttttttaaaacgacttctgctattcttacttagagaaatccagtgatagcacctcatgtcttcagaggagcaagaagttcaaggagttaaatgtcacattcatactcaggtaatagagaagaataaaacacatcaggtttgcttcatctatcctaagtggtgcttaggggttcagaaaaaatgtttcaagtacaggaaattaatgagcaatatttacaatgtattttaataaaagggatttttctagttaactctgagttaagcacgaactcctttcttttgttaattgttggaaataccattaagatgtatttgtctgtttttctgcattggcaagtaaagaacataaaaca

SEQ ID NO: 54817 - DNA, 8329 bp, Homo sapiens
atgtcggcgaggggcgtgggagctgccacccgcttgcctgcgggacaccggagtcaagaggctgcccacgccgctgcctgtccgttccacggttccgaggtctccaccgtctccccgcgcgcggcaggcggcaccaaactctgcgctccccgcggtgcgccctgcccgcgcagtgcgcgtccagaggaaatccgccccgggctttcgaagtgcagggctgggggctgcatggaagtttccccaagatttgaagttgaagatttttcaggtcataatatgatgttgctaattttgttcctcgtgataatttgttcccatatttctgtgaaccaagattccggccctgagtatgcagatgttgtgtttttggtggacagctctgatcgcctgggatccaagtccttcccatttgtgaaaatgttcatcaccaaaatgatcagcagtctccccatagaggccgacaaataccgtgtggccctggcccagtacagtgataaacttcacagtgaattccacctgagcaccttcaaaggcaggagccccatgctgaaccacctaaggaagaactttggattcattggcgggtccctgcagataggaaaggctcttcaggaggctcacaggacttatttctctgcacccgcaaatgggagagacaagaaacagtttcccccaattctagtggtcctggcttcatctgagtctgaggataatgtggaagaggcatcaaaggccctgcggaaagacggagtgaaaatcatctctgtaggggtgcagaaagcttctgaggaaaacctgaaggccatggccacgtctcagtttcatttcaaccttcggacagtcagagacctcagcatgttttcccaaaacatgacacacatcatcaaggatgtaataaagtacaaggagggagcagttgatgacatctttgtagaagcttgccaaggcccttctatggccgatgttgtgttcctattggatatgtcaatcaatggaagtgaggagaactttgactatcttaaaggattcttggaagaaagtgtatctgcccttgacataaaggaaaattgcatgagggttggccttgtggcctatagcaatgagacaaaagtgataaattcactgagcatgggcataaataagtcagaggttctccagcatatacagaacctttctccccgaactgggaaggcctatactggagctgccatcaaaaagctcaggaaggaagtttttagtgcacggaatggcagtcggaagaatcagggggtgccccagattgccgtgctggtgacccaccgagattcagaagacaacgtgacaaaagcagctgttaacctccgacgggagggtgtgaccatcttcaccctgggcatagagggcaccagcgacacccagttggaaaagatagcatcccaccctgctgagcagtatgtctccaaactgaagaccttcgctgacctggctgctcacaaccagacatttctgaagaagctgcggaaccaaataacacacacagtctctgtcttttcagagaggactgaaacgctcaaatctggttgtgtggacactgaggaagcagacatctatctgcttatcgatggctcagggagcacccaggccacagatttccatgaaatgaagacgttcctgtcagaggtggtagggatgttcaacattgctccccataaggtgcgggttggggccgttcagtatgctgacagctgggacttggaatttgagatcaataaatactccaacaagcaggatttgggaaaggccattgagaatatcaggcagatgggtgggaatacaaacacaggcgcagcactgaatttcacactgagtctgttgcaaaaagcaaagaagcagcgaggaaacaaagttccatgccaccttgttgtcctgacaaatggcatgtccaaggatagcatcttggagcctgcaaacagactgagagaagagcacatccgagtttatgctatcgggatcaaggaggccaaccaaacacagctgagagaaattgcaggagaggaaaagagagtgtattacgtgcatgactttgatgcattgaaagacataagaaaccaagttgttcaagaaatctgtactgaagaagctgacttgaataaacatcacagtttttcctatgcagcttgcaaagagatgaaagctgacatcatgtttctggtggacagttctggaagtataggacctgaaaacttcagcaaaatgaaaacatttatgaaaaacctggtgagcaagtctcagattggaccagatcgggtgcaaattggtgtagtccagttcagcgacatcaataaggaagagtttcagctcaacagattcatgtcccaaagcgacatttcaaatgcaatagaccaaatggctcacattggacaaaccaccctgactggtagtgccctgagctttgtgtctcagtacttcagccccaccaagggcgcccggcccaacatcagaaagtttctcatcctcatcacggatggtgaagctcaggacatagtaaaggaaccagcagtagtgcttcggcaagaaggtgtaatcatctattctgtgggagtgtttggctccaatgtcacccagcttgaggagatcagtgggaggcccgagatggttttttatgttgagaattttgacattctgcagcgcattgaagatgatcttgtttttggaatatgcagcccccgtgaagaatgcaagcggattgaagttttagacgttgtgtttgtcattgatagctctggcagtattgactatgatgagtataatatcatgaaggattttatgattggcttagtgaaaaaagctgatgtgggcaagaatcaggtccggtttggggctctgaagtatgctgatgacccagaggtgctgttttatctggatgactttggcacaaaactggaggtaatttcagtgctccagaatgaccaagccatgggtggcagtacttatactgctgaggcactgggcttctcagaccacatgttcactgaagcccggggcagccgcctgaacaagggggtcccccaagtcctcattgtgatcaccgatggggaatcccatgatgctgataaactcaatgccacggcaaaggccttgcgggacaaaggcattcttgtcctggctgtggggattgatggtgccaatcccgtggagctgttagccatggcaggatcaagcgacaagtacttcttcgtggagacttttggaggtctgaagggaatattttcagatgtgacagccagtgtctgcaactcttcaaaagtagattgtgaaattgacaaagtagatcttgttttccttatggatggttcaactagcattcagccaaatgacttcaagaaaatgaaggaatttctggcatctgttgttcaagactttgatgtcagcctcaacagagtgcgaataggagcggcccagtttagcgatacctatcacccggagtttccactgggaactttcataggtgaaaaagagatatcatttcagattgaaaacatcaagcagatctttggaaacacacacatcggtgctgcactcagggaggtggaacattacttcaggccagacatgggcagcaggataaatacaggtaccccacaggtgctgctggtccttacagatggccagtcccaagacgaggtggcccaggccgcggaagccctgagacacagaggtatcgacatctactccgtgggcattggggatgtggatgaccagcagctcattcagatcaccgggactgcagagaaaaaactgacagtgcacaacttcgatgaactgaagaaggtcaataaaaggatcgttcgcaacatctgtaccacagcgggtgaaagcaactgtttcgtggatgttgtggtgggatttgatgtctcaactcaggagaaagggcagactttgcttgaaggtcagccttggatggaaacctaccttcaagacatcttacgtgccatcagctccctcaatggagtaagctgtgaggtgggcacagagactcaggtcagtgtggcttttcaagtgaccaatgccatggaaaaatattctcccaagtttgagatctacagtgaaaacatactgaatagcttgaaggatataacagttaaaggaccatctcttctcaatgcaaacctcttggattctctatgggatacatttcagaataaatcagctgctcgaggaaaggtggtccttttattttcagatggattggatgatgatgttgagaaacttgaacaaaaatctgatgaacttagaaaagaaggcctgaatgccctcataactgttgctctggatggacctgctgattcaagtgacttggctgatcttccctatattgaatttgggaaaggatttgagtacaggacacagctctctattggcatgagagaacttggaagccggctgtcaaagcagctggtcaatgttgctgaaaggacatgctgctgtttgttctgcaagtgcattggaggagatggcacaatgggagatcctggaccaccagggaaaaggggacctccaggttttaaaggcagtgaaggctacctgggagaggagggaatcgctggagaaagaggagcccctggaccagtgggagagcaaggtactaagggatgctatggcaccaaaggtcctaagggaaacagaggactaaatggacaggagggagaagttggggaaaatggaattgacggattaaacggagaacagggtgataatggtcttcctggaagaaaaggagaaaagggagatgagggatctcagggaagcccagggaagagagggactcctggtgaccgtggagcaaagggcctgcgaggggatcccgtaagtgcacgggctgcaaactggagttagggcttgattcccatccgtacttctgatagggagtctcgatttcaagggagctcctggagttgacagtagcatagaaggacccacaggcttgaaaggagaacgtggaagacaaggcagaagaggctggccaggcccccccgggacaccaggctccagaagaaagacagcagctcatggcagaaggggacatacaggcccacagggaacagcaggcatcccaggaccagatggacttgaaggctccctgggacttaagggccctcagggcccaagaggagaggctggtgtgaaaggagaaaaaggaggtgtgggaagtaaaggtccccaggggcctccaggacccggaggagaggcagggaatcaaggccgtttgggaagccaaggaaataaaggagaacctggagatctgggagaaaaaggagctgttggctttcctggtcctcgtggcttgcagggcaatgatggcagtccaggttatggtagtgtcggacgcaagggagcaaagggacaagaaggattccctggagaaagtggacctaagggtgagattggggaccctggtggtccaggagagactgggctgaagggagctagaggcaaaatgatatctgctgggcttccaggagagatgggatcccctggggaaccaggacctcctggacgtaagggtgtgaaaggagccaaaggcttggcttcattttctacatgtgagctcattcagtatgtgcgagaccgcagtcctggcaggcatgattgacgacactggcacatttcaagtaatagtggttccctccggggccgactacataccagcattagagagactccagcggtgcactttctgctatgatgtgtgcaagccagatgcttcttgtgaccaagccagaccaccccctgtgcagtcttacatggatgctgctttccttctggatgcctcccggaacatgggaagtgctgaatttgaagacataagagccttccttggagcactattagatcactttgaaatcaccccagagccggagacttctgtcactggagaccgggtggccctattgagccatgctccccccgacttcctacccaacactcagaagagtccagttagagctgagttcaatcttaccacctacagaagtaagcgcctcatgaagaggcatgtgcacgagtcagttaaacaactaaatggagatgcttttattggtcatgccttacagtggactctggacaatgtatttttaagtacacccaatctgagaagaaacaaagtcatatttgtgatatctgctggggaaaccagccacttagatggggaaatcttaaagaaggaatccttgcgagccaaatgtcagggatatgccttatttgtgttttcccttggccctatttgggatgacaaggaactggaggatctcgccagccaccctttggatcaccacctggtccagcttggccgaattcataaacctgaccacagttatggtgtgaagtttgtgaagtcctttataaactcaatcaggcgtgcaatcaacaaatatccaccaataaacttaaaaataaagtgcaacagacttaactctatagatccaaagcagcccccacgaccattccgaagctttgttcctggaccacttaaagctaccctcaaagaagatgtattacagaaggcaaaattctttcaagataaaaaatatctttcaagagtagcaagaagtggcagagatgatgctattcaaaattttatgagaagcacctcccatacctttaagaatggaaggatgatagaaagtgctcccaaacaacatgattaaaaaaatgcttgaacaacttagccttaggaagcatggtaagactctggacttaaatagtaactaaatctgctgccagaactcaagcaacagtttgtaggttatcaggtgacttgaccccctgcattcattggtattaagatatatcttgttcatttatttgaccactcctgacaattccagcactctacgactgatatgtcgaagaactgtttcattagaagacagaagaatgaaagaagtgttttgaaaagtctaatggagatataatttgaaggtaaaatttatatgatgtatgcatatgtgtacatgggtcaatgttaattcttttatctctgtccagttcattttctgcaaacccatcctcctttcctaatttagtaatgtctaatgctcatctatttagtcaaagttattttttaatgttttaagctactccaaaatttatcctagaaatggatgctgtttatatgtcgtatttttttaaaacgtgaccttctattccacttaaacacaccactgtgggagttgtttgcttggactgatgagaagagggtaattttctccatctctaaatcctcctgaactcactgaaaaactcattaattcccgcagaacataaattattgcttttgagctggaagttttctcttcattaggaagcttactgccattttgatggagcttgaagcccccattttgatggacttctagtctgtctttcctgttatggtcatttattaattttcactaatccatatattctttagacaaggagagtcaagaaactacttgtcatagatgaagctctgagttacttttacccatcaggtagctgtttagtcaataataaacagcaccaaaacaggattagcagagctcttaaaaacagccttaaatacacactgagtttagaaaaatgtaagaaaatcattgttttaatctacaaattcatatgcagttgcagagatgcaaaagagatcagagtaagttaaagtaggaaaggttttataaaagtattgatggctgtgtcctcatctgcatttttgtttttatgatagggctgatattttcaacaacgaaacacccaatgttcagaccttacctcagtctaagagctggctccacagttggtagcaatggccctgttaggcagactgtccccctctttgggaatggaaagaagccctgcctggatgcatggagcagatggatactgacaccaaggacattcagattttctttcctatacctattttcataaaatttggaaagaaaaactatctgcagtatttttttaaaacgacttctgctattcttacttagagaaatccagtgatagcacctcatgtcttcagaggagcaagaagttcaaggagttaaatgtcacattcatactcaggtaatagagaagaataaaacacatcaggtttgcttcatctatcctaagtggtgcttaggggttcagaaaaaatgtttcaagtacaggaaattaatgagcaatatttacaatgtattttaataaaagggatttttctagttaactctgagttaagcacgaactcctttcttttgttaattgttggaaataccattaagatgtatttgtctgtttttctgcattggcaagtaaagaacataaaaca

SEQ ID NO: 54818 - DNA, 1911 bp, Homo sapiens
atggtagcgctgcataaggggaggatcccgccggcagggcccagcgtcctagcgggttgggacgcggctgacagcgagcgatggctgcgcgcagcgttccgtccggcgagtgacccccctccgccgcgagtcagctctccgcccgctcccttgccgagtcgcgaccggtgcggacgacggcgtttgcgtggcacgtggtcgggccgcctggccctgggaaagcgtcccacggtgggggcgcgccggtctcccggagcgggaccgggtcggaggatggacgagaatcacgagcgatgtggccctggcgttgagtttgtggctgtggtcgcttcggggccccggtggcgggaccaggggctcgtgaggcaggtcttggtgggtgccgagggccttccggcgtcccaggcggggcgccgcgggaccgccctcgtgtctgtggcggtgggatcccgcggccgtgttttcctggtggcccggccatgcctgaggtttctccctcagccgcccctctgcgggctcccaggtgcccttgccctcgcggtccccggcccttgcctgtctgcgcccccttccccgcccgccgcccgccgatcctctctcctccccgagcggctcaccggctttacgtcggttggtggccgcgtctgggaccgaaccgggcaccgccttgtggaaaaaaaagaatagaatataccctgttaaatcagacatgatacttgcttttgtggagcttatgctttagtgcagaaacagaaagtcaagcaaaaactcaaactatgtaactttaaattggatatgtgctaatgaaggaaaatgtggcactgtaagaaaaaataatagggagttaaaggataaataggagtttgctggatgaaatttatgaagagctgaagatttcaaacaaaagaaactgatgcaggagggtgcagctttggagtcaagaatgaagttctaggagatagagagcaaagaaatggtgggagaggaggtcaaacaagacaaatctctcctctgccttctccttatcagactactcaacatgaaggcaataagaatgaagacctctatgtataataattgacttccacttaataaataaggttacttggtacactggtcgacaaaaccttgaaatgttgatgtttaagggctgttgattgctggcagcaaagaagtccaactgtgctggtacccgagatagcgtctccacattttcttccaggatcatcacctttgttctaaatagctcccacatagtgtgaacagaagtcatatgttttagattttctgccttggcacccaggaaaccagtatgattgagtaaacatattaaacttcctctgcatttccagcctgaacagatgttgagtacaagctgatccacctacgttcaacctgagagagtccacatccacagactgtttcatttccctttttcaatttacatagaagcatagattcttgctggcatatacaaatgcgccatttaaggcaatcaaaaatggttccacatctcatctgatttccacaattgttgctgtaacgatggactactgaggagagagacaatttctctggcacatcttcccacattttagcaacatgttcatggagagccaatattcagtaattacagcccaattcctcacaatttcacaattcgctaacaatatgcattttcacaatgtaaagctgattttcctttaaccaaatcaaacatgaaaagatagctgcatgcaatgggcaatctagatcattagaagattgatgtaaaattagaggacactgagactggaatagattgcaaacttcagggagctcagaaaacttgtaaactctacattttgaggaaatatgttgtcgatgcttttgcaactctatgcagtaacttaacaaataaagccttaaagt

SEQ ID NO: 54819 - DNA, 1911 bp, Homo sapiens
atggtagcgctgcataaggggaggatcccgccggcagggcccagcgtcctagcgggttgggacgcggctgacagcgagcgatggctgcgcgcagcgttccgtccggcgagtgacccccctccgccgcgagtcagctctccgcccgctcccttgccgagtcgcgaccggtgcggacgacggcgtttgcgtggcacgtggtcgggccgcctggccctgggaaagcgtcccacggtgggggcgcgccggtctcccggagcgggaccgggtcggaggatggacgagaatcacgagcgatgtggccctggcgttgagtttgtggctgtggtcgcttcggggccccggtggcgggaccaggggctcgtgaggcaggtcttggtgggtgccgagggccttccggcgtcccaggcggggcgccgcgggaccgccctcgtgtctgtggcggtgggatcccgcggccgtgttttcctggtggcccggccatgcctgaggtttctccctcagccgcccctctgcgggctcccaggtgcccttgccctcgcggtccccggcccttgcctgtctgcgcccccttccccgcccgccgcccgccgatcctctctcctccccgagcggctcaccggctttacgtcggttggtggccgcgtctgggaccgaaccgggcaccgccttgtggaaaaaaaagaatagaatataccctgttaaatcagacatgatacttgcttttgtggagcttatgctttagtgcagaaacagaaagtcaagcaaaaactcaaactatgtaactttaaattggatatgtgctaatgaaggaaaatgtggcactgtaagaaaaaataatagggagttaaaggataaataggagtttgctggatgaaatttatgaagagctgaagatttcaaacaaaagaaactgatgcaggagggtgcagctttggagtcaagaatgaagttctaggagatagagagcaaagaaatggtgggagaggaggtcaaacaagacaaatctctcctctgccttctccttatcagactactcaacatgaaggcaataagaatgaagacctctatgtataataattgacttccacttaataaataaggttacttggtacactggtcgacaaaaccttgaaatgttgatgtttaagggctgttgattgctggcagcaaagaagtccaactgtgctggtacccgagatagcgtctccacattttcttccaggatcatcacctttgttctaaatagctcccacatagtgtgaacagaagtcatatgttttagattttctgccttggcacccaggaaaccagtatgattgagtaaacatattaaacttcctctgcatttccagcctgaacagatgttgagtacaagctgatccacctacgttcaacctgagagagtccacatccacagactgtttcatttccctttttcaatttacatagaagcatagattcttgctggcatatacaaatgcgccatttaaggcaatcaaaaatggttccacatctcatctgatttccacaattgttgctgtaacgatggactactgaggagagagacaatttctctggcacatcttcccacgttttagcaacatgttcatggagagccaatattcagtaattacagcccaattcctcacaatttcacaattcgctaacaatatgcattttcacaatgtaaagctgattttcctttaaccaaatcaaacatgaaaagatagctgcatgcaatgggcaatctagatcattagaagattgatgtaaaattagaggacactgagactggaatagattgcaaacttcagggagctcagaaaacttgtaaactctacattttgaggaaatatgttgtcgatgcttttgcaactctatgcagtaacttaacaaataaagccttaaagt

SEQ ID NO: 54820 - DNA, 3221 bp, Homo sapiens
atgtcctgcatgttgacaacatcagggggaggcacaggacctttggaggggctacaagaggaagcctccatttcccttataacagccctcacagtgtcccttaaaaccactagaccctgctgtttgttcattggaagagttagcccagcttttgaccagcttctgtggaacatctctaccctgccctgcagactaccctgtgactcctggaagtctaggtcctttgttgcatggagaggatgcaaaccacgtgctgcagctcccgatgccttttccgagcagattcctcagagggggtgcctgacatcagagatgaatttcagccaatgcctccgaagaggcagatgcagaaacctcactcctctcagtaaccctgagcaaagcactcaacctctctgagcctcgggtttccatctgtaaaatgggctcaagctaagttgtctctccagtccatcccaggcctacccatgtacgactaattggatgaagccaattctccccctttctccaagaaaaactggtctgcttgaagccccattgctgagcttccatgagctcccacagggagacatacacactcacacacacactcgcacatacagtcacatactcacacagacacactcacacacagtgacacacatgcactcacacatggatacatatactcacacacataaacacacacacaaacttacacacatatacatatacattcatatacacatgcaatcacacatacacaaatacacacatacacgcccttacacaggcttgcaaactcatgctcactgtttttcacacacacattctccccagtatagctagtattgctcctaggtacagcagcttgcttgtgtcatctttctggttctgctgcacccggcaccacctctgcaggtccccccctgggctgccttcatggctgagacaaagtttgccaaccacagccatgtggccctgaacaggagaactgtccagcgtgccctgagttaggatgtggcaacctcttctcagcactaaaaacggggacacgaggtctcacagcaggacagaacatttgctatcaggatgcttcatggtataagattaagacttatcatttattgactacataagtgtctgcatgacagatgctcctacaccttattttatttaattttcacaacaaccacatgaggtcttgatccaagtgaatttatcttcaatctgccaaatgtcatcctgataaactcagggcagtatcccagcttttagagaccatcgtggatttggacactgccaactgctgacttagataccccacccagcttcccactccaatgctaacatccagatcttaataagaagaatgaggaggaggaggagggagcaaaggagaagatgaatacataatgatgagaaagagagggaagacgaaaaaaggagggggagacaataatagcaacgaggaagaaaaggaggagagaaaattaggaactatctggggacctttcatcccacccgggacccctgagggttactgctgttgcatgcatcagcactgcatggagtaaggtcagagatgtcctccagaaccccaacagaacaagggccagaccgaagctcctcaaggtggaaaatgacatgagtctggcttcgcttctccacagggagcccccgccagctcctcgtgcccgtctctcccttgcctacagactcacagccttccgcttactttaggatcattcccagggtgaacatcagatttgagtctcatccacctccaggcttcatccctaatgcctctcccacagcaccttagatgggggatctcattccaggtcatgccatgccctggccagggtgttctctgggtcggggccctgagcacacacacagcagcccagcgctgcctggctcatgctttcctcgggggacccacctgcggcctttgcacctgcagatcctcctctgtccagactgctgtgggcacagcgcagttgcaccttcctccccttcacagacaccagctgctctagacggtgatggatctatgaagcccttgttctccttgctccgaagatgatatgaaaagttgctttgtggttgtcagctctcctcagtaggctcagttcatgcccgggctctcaccccctgacactctttactggccctcgtcactctgtcattatgagtgtcctgggaagggctcctcttggctctcgtccctctgacctcagcaagacctccctctgaaccacacagacatctctcattatcaccccacatccttcctacttggaagaaccagatttagttccaggactcccccactgctttcagagcccccagatcacaggaaatcaagtgatgatctttgaaactttctgaaactgagctccccaagtctacaggggatctaaccatgcctggccttccccaccaacacagagcacatctccccaaggctcccaacccacgtgggccacaaatcagggtctgctattacccaactcagcaggtgttgcagcctgagagatgaagcctcaccaaccccaccatgttaaaagctcatggttcttggtttatcacccgtcccctgggccctgactgtacactgatcattcactcatctgggaaccactggccacattctcccacattatctgtctctctataccttacccaggtaaccgagactccaatccagctctgctgtatccaacctgtgaccttgggcaaagtgtggatcctctccatgcctctgctttctcacccgtaaagagggtcaccttggatctgtcttcactggattgttggaaagattagattgattagtacagtcaaagtgctaaggagcctggctcagtaaatgttagggggatcagttcttatcacactgagtgcaaagggatagagtccactccatggaggccttcccatcactcctgagctctcagggaccagcgacctacaatgtttaaagaatgaccaaacagcttgggcatttttctccttcccgctccaactacagaagaaagaactcttggcaaacagctggataaactctttttcctgagatgtctgaaggcacctgccccaagccaactggccagcctcctgctgttctgagctgcaggtcaggcaccagatcttattcagagacaccatgtacccccgaccctccatgcagtgctttgctgctctacctttctcttcagctaaaacatacaaaagca

SEQ ID NO: 54821 - DNA, 719 bp, Homo sapiens
cagccttataagctgagggagtggagaggcccggggccaggaaagcagagacagacaaagcgttaggagaagaagagaggcagggaagacaagccaggcacgatggccaccttcccaccagcaaccagcgccccccagcagcccccaggcccggaggacgaggactccagcctggatgaatctgacctctatagcctggcccattcctacctcggaggtggaggccggaaaggtcgcaccaagagagaagctgctgccaacaccaaccgccccagccctggcgggcacgagaggaaactggtgaccaagctgcagaattcagagaggaagaagcgaggggcacggcgctgagacagagctggagatgaggccagaccatggacactacacccagcaatagagacgggactgcggaggaaggaggacccaggacaggatccaggccggcttgccacaccccccacccctaggacttattcccgctgactgagtctctgaggggctaccaggaaagcgcctccaaccctagcaaaagtgcaagatggggagtgagaggctgggaatggaggggcagagccaggaagatcccccagaaaagaaagctacagaagaaactggggctcctccagggtggcagcaacaataaatagacacgcacggcagccacagcttgggtgtgtgttcatccttgttaaaaaaaaaaaaaaaaaaaaaaaaaa

SEQ ID NO: 54822 - DNA, 2119 bp, Homo sapiens
ctccattaaaccaccaccagctccccaagccaccccttcagccatgaagttcctgctcctggtcttggcagccctcggattcctgacccaggtgatcccagccagtgcaggtgggtcaaaatgtgtgagtaacaccccaggatactgcaggacatgttgccactggggggagacagcattgttcatgtgcaacgcttccagaaaatgctgcatcagctactccttcctgccgaagcctgacctaccacagctcatcggtaaccactggcaatcaaggagaagaaacacacaaaggaaagacaagaagcaacaaacgaccgtaacatcataataaccactgctatcgcctccaccaactcagagaaatatcatttccacagttccaattcctcctacattgctgagtactagccaaggctcctctttatggggcagatatctatagccaaccccaaaacttctgtcttctatcattctgtcattcatctagtaactaatttggagtttgtatctatcttacgagaacaatcatcatgcagattcgtccacaggggatctgtcagtttgggtcctccaaatgaaaaatgtcaagacagaattggacatgcaaaagattgactgggagaacacacctctgatggacaaaggtgagacagagcagccacaggcagggagagccttcagactgcaacgctggcctgatacgtgtcaaaggagagagggatagaggaggattgaatagaaggagactaagactgcagctctaagaaagtctcagccaaacagatggggaggcccaaagcaaggcttgcccctcagaggagctcacgcagggcaggaatagccaggttctcatatcccaggggttcagacttggctgagaacagcccctggagaacatggggtgactgctaccataggtctggaagtatgaggctgtccaccaactatccccttgaagcaagttctcttgaaaggaaatctaaacagtgcacccccatggctgccacggagtataaggagggagagaaaggagctgaaagtctaggtttggccagctaggtagactgacttgtgaggtatttatttattcatttgagtaacaaagcagacagaatacatagccaccattggtagtacaccccaaaagcaaggatggcatgatgctggtgactcaaacgtgcctactcatggtgtcaaattggcataatcctcttgggaagctgtgtggaaataagcacagagaagcagaactctaattgcttaatccactaaacattacttctgggaattggctcatcataaattatccaagagaaagcacaaagttatgggcacaaaggttttccatataatattatttaaaatgctgagaaaatgaaaaaatctaaatggtgaaatatatactaatgccatctataaatacaaacaaatagaatgtttatagaataatggaacataataacattattcaaaattgcatttatgctatagttgtcaaaattgtctccttatatgatacaaaactcatgaaaattatgacttttttgtttggttggaaagcagaattatgcataaatttcctcttacagttcgatgcccattagttttatataacatttatttgacacgtactgacttctatctgagaagaacaaaccaaaacactcaggcctaaataattaaaaacggtcctaaaaactagcaaaccagataagaaaagatgttaatgcccattccctaacttatgtcttagaccaaaattaattctagatggttttaaaatgacagtgtaaaagtaaagtattaaaagattgtgtggtcaaatattcaatttaagagcaaggaaattcttataaatataacaatagaggcagaactcatgtaagaataaattgattaggtggtattaaatattaagttcttatgtatgtcaaaagatatcattttgaaattcatccatcttattgggtattgcaggagttcattcctttttgtttataaatactcttccgtcatatgaatagtattcatttgtatactggtttgttgatggacatttgggttgttcccagtttatggctattacaaataaagcttctatgaacatttatgtaca

SEQ ID NO: 54823 - protein, 303 aa, Homo sapiens
MAAVAVLRAFGASGPMCLRRGPWAQLPARFCSRDPAGAGRRESEPRPTSARQLDGIRNIVLSNPKKRNTLSLAMLKSLQSDILHDADSNDLKVIIISAEGPVFSSGHDLKELTEEQGRDYHAEVFQTCSKVMMHIRNHPVPVIAMVNGLATAAGCQLVASCDIAVASDKSSFATPGVNVGLFCSTPGVALARAVPRKVALEMLFTGEPISAQEALLHGLLSKVVPEAELQEETMRIARKIASLSRPVVSLGKATFYKQLPQDLGTAYYLTSQAMVDNLALRDGQEGITAFLQKRKPVWSHEPV

SEQ ID NO: 54824 - protein, 553 aa, Homo sapiens
MPLPWSLALPLLLSWVAGGFGNAASARHHGLLASARQPGVCHYGTKLACCYGWRRNSKGVCEATCEPGCKFGECVGPNKCRCFPGYTGKTCSQDVNECGMKPRPCQHRCVNTHGSYKCFCLSGHMLMPDATCVNSRTCAMINCQYSCEDTEEGPQCLCPSSGLRLAPNGRDCLDIDECASGKVICPYNRRCVNTFGSYYCKCHIGFELQYISGRYDCIDINECTMDSHTCSHHANCFNTQGSFKCKCKQGYKGNGLRCSAIPENSVKEVLRAPGTIKDRIKKLLAHKNSMKKKAKIKNVTPEPTRTPTPKVNLQPFNYEEIVSRGGNSHGGKKGNEEKMKEGLEDEKREEKALKNDIEERSLRGDVFFPKVNEAGEFGLILVQRKALTSKLEHKDLNISVDCSFNHGICDWKQDREDDFDWNPADRDNAIGFYMAVPALAGHKKDIGRLKLLLPDLQPQSNFCLLFDYRLAGDKVGKLRVFVKNSNNALAWEKTTSEDEKWKTGKIQLYQGTDATKSIIFEAERGKGKTGEIAVDGVLLVSGLCPDSLLSVDD

SEQ ID NO: 54825 - protein, 828 aa, Homo sapiens
MDESALTLGTIDVSYLPHSSEYSVGRCKHTSEEWGECGFRPTVFRSATLKWKESLMSRKRPFVGRCCYSCTPQSWDKFFNPSIPSLGLRNVIYINETHTRHRGWLARRLSYVLFIQERDVHKGMFATNVTENVLNSSRVQEAIAEVAAELNPDGSAQQQSKAVNKVKKKAKRILQEMVATVSPAMIRLTGWVLLKLFNSFFWNIQIHKGQLEMVKAATETNLPLLFLPVHRSHIDYLLLTFILFCHNIKAPYIASGNNLNIPIFSTLIHKLGGFFIRRRLDETPDGRKDVLYRALLHGHIVELLRQQQFLEIFLEGTRSRSGKTSCARAGLLSVVVDTLSTNVIPDILIIPVGISYGRIIEGHYNGEQLGKPKKNESLWSVARGVIRMLRKNYGCVRVDFAQPFSLKEYLESQSQKPVSALLSLEQALLPAILPSRPSDAADEGRDTSINESRNATDESLRRRLIANLAEHILFTASKSCAIMSTHIVACLLLYRHRQGIDLSTLVEDFFVMKEEVLARDFDLGFSGNSEDVVMHAIQLLGNCVTITHTSRNDEFFITPSTTVPSVFELNFYSNGVLHVFIMEAIIACSLYAVLNKRGLGGPTSTPPNLISQEQLVRKAASLCYLLSNEATISLPCQTFYQVCHETVGKFIQYGILTVAEHDDQEDISPSLAEQQWDKKLPEPLSWRSDEEDEDSDFGEEQRDCYLKVSQSKEHQQFITFLQRLLGPLLEAYSSAAIFVHNFSGPVPEPEYLQKLHKYLITRTERNVAVYAESATYCLVKNAVKMFKDIGVFKETKQKRVSVLELSSTFLPQCNRQKLLEYILSFVVL

SEQ ID NO: 54826 - protein, 263 aa, Homo sapiens
MMPKHCFLGFLISFFLTGVAGTQSTHESLKPQRVQFQSRNFHNILQWQPGRALTGNSSVYFVQYKIMFSCSMKSSHQKPSGCWQHISCNFPGCRTLAKYGQRQWKNKEDCWGTQELSCDLTSETSDIQEPYYGRVRAASAGSYSEWSMTPRFTPWWETKIDPPVMNITQVNGSLLVILHAPNLPYRYQKEKNVSIEDYYELLYRVFIINNSLEKEQKVYEGAHRAVEIEALTPHSSYCVVAEIYQPMLDRRSQRSEERCVEIP

SEQ ID NO: 54827 - protein, 231 aa, Homo sapiens
MMPKHCFLGFLISFFLTGVAGTQSTHESLKPQRVQFQSRNFHNILQWQPGRALTGNSSVYFVQYKIYGQRQWKNKEDCWGTQELSCDLTSETSDIQEPYYGRVRAASAGSYSEWSMTPRFTPWWETKIDPPVMNITQVNGSLLVILHAPNLPYRYQKEKNVSIEDYYELLYRVFIINNSLEKEQKVYEGAHRAVEIEALTPHSSYCVVAEIYQPMLDRRSQRSEERCVEIP

SEQ ID NO: 54828 - protein, 130 aa, Homo sapiens
MMPKHCFLGFLISFFLTGVAGTQSTHESLKPQRVQFQSRNFHNILQWQPGRALTGNSSVYFVQYKIYGQRQWKNKEDCWGTQELSCDLTSETSDIQEPYYGRVRAASAGSYSEWSMTPRFTPWWERAKGL

SEQ ID NO: 54829 - protein, 167 aa, Homo sapiens
MHWGTLCGFLWLWPYLFYVQAVPIQKVQDDTKTLIKTIVTRINDISHTQSVSSKQKVTGLDFIPGLHPILTLSKMDQTLAVYQQILTSMPSRNVIQISNDLENLRDLLHVLAFSKSCHLPWASGLETLDSLGGVLEASGYSTEVVALSRLQGSLQDMLWQLDLSPGC

SEQ ID NO: 54830 - protein, 699 aa, Homo sapiens
MKQRFSALQLLKLLLLLQPPLPRALREALCPEPCNCVPDGALRCPGPTAGLTRLSLAYLPVKVIPSQAFRGLNEVIKIEISQIDSLERIEANAFDNLLNLSEILIQNTKNLRYIEPGAFINLPGLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTLDISSTKLQALPSYGLESIQRLIATSSYSLKKLPSRETFVNLLEATLTYPSHCCAFRNLPTKEQNFSHSISENFSKQCESTVRKVSNKTLYSSMLAESELSGWDYEYGFCLPKTPRCAPEPDAFNPCEDIMGYDFLRVLIWLINILAIMGNMTVLFVLLTSRYKLTVPRFLMCNLSFADFCMGLYLLLIASVDSQTKGQYYNHAIDWQTGSGCSTAGFFTVFASELSVYTLTVITLERWHTITYAIHLDQKLRLRHAILIMLGGWLFSSLIAMLPLVGVSNYMKVSICFPMDVETTLSQVYILTILILNVVAFFIICACYIKIYFAVRNPELMATNKDTKIAKKMAILIFTDFTCMAPISFFAISAAFKVPLITVTNSKVLLVLFYPINSCANPFLYAIFTKTFQRDFFLLLSKFGCCKRRAELYRRKDFSAYTSNCKNGFTGSNKPSQSTLKLSTLHCQGTALLDKTRYTEC

SEQ ID NO: 54831 - protein, 1624 aa, Homo sapiens
MSARGVGAATRLPAGHRSQEAAHAAACPFHGSEVSTVSPRAAGGTKLCAPRGAPCPRSARPEEIRPGLSKCRAGGCMEVSPRFEVEDFSGHNMMLLILFLVIICSHISVNQDSGPEYADVVFLVDSSDRLGSKSFPFVKMFITKMISSLPIEADKYRVALAQYSDKLHSEFHLSTFKGRSPMLNHLRKNFGFIGGSLQIGKALQEAHRTYFSAPANGRDKKQFPPILVVLASSESEDNVEEASKALRKDGVKIISVGVQKASEENLKAMATSQFHFNLRTVRDLSMFSQNMTHIIKDVIKYKEGAVDDIFVEACQGPSMADVVFLLDMSINGSEENFDYLKGFLEESVSALDIKENCMRVGLVAYSNETKVINSLSMGINKSEVLQHIQNLSPRTGKAYTGAAIKKLRKEVFSARNGSRKNQGVPQIAVLVTHRDSEDNVTKAAVNLRREGVTIFTLGIEGASDTQLEKIASHPAEQYVSKLKTFADLAAHNQTFLKKLRNQITHTVSVFSERTETLKSGCVDTEEADIYLLIDGSGSTQATDFHEMKTFLSEVVGMFNIAPHKVRVGAVQYADSWDLEFEINKYSNKQDLGKAIENIRQMGGNTNTGAALNFTLSLLQKAKKQRGNKVPCHLVVLTNGMSKDSILEPANRLREEHIRVYAIGIKEANQTQLREIAGEEKRVYYVHDFDALKDIRNQVVQEICTEEADLNKHHSFSYAACKEMKADIMFLVDSSGSIGPENFSKMKTFMKNLVSKSQIGPDRVQIGVVQFSDINKEEFQLNRFMSQSDISNAIDQMAHIGQTTLTGSALSFVSQYFSPTKGARPNIRKFLILITDGEAQDIVKEPAVVLRQEGVIIYSVGVFGSNVTQLEEISGRPEMVFYVENFDILQRIEDDLVFGICSPREECKRIEVLDVVFVIDSSGSIDYDEYNIMKDFMIGLVKKADVGKNQVRFGALKYADDPEVLFYLDDFGTKLEVISVLQNDQAMGGSTYTAEALGFSDHMFTEARGSRLNKGVPQVLIVITDGESHDADKLNATAKALRDKGILVLAVGIDGANPVELLAMAGSSDKYFFVETFGGLKGIFSDVTASVCNSSKVDCEIDKVDLVFLMDGSTSIQPNDFKKMKEFLASVVQDFDVSLNRVRIGAAQFSDTYHPEFPLGTFIGEKEISFQIENIKQIFGNTHIGAALREVEHYFRPDMGSRINTGTPQVLLVLTDGQSQDEVAQAAEALRHRGIDIYSVGIGDVDDQQLIQITGTAEKKLTVHNFDELKKVNKRIVRNICTTAGESNCFVDVVVGFDVSTQEKGQTLLEGQPWMETYLQDILRAISSLNGVSCEVGTETQVSVAFQVTNAMEKYSPKFEIYSENILNSLKDITVKGPSLLNANLLDSLWDTFQNKSAARGKVVLLFSDGLDDDVEKLEQKSDELRKEGLNALITVALDGPADSSDLADLPYIEFGKGFEYRTQLSIGMRELGSRLSKQLVNVAERTCCCLFCKCIGGDGTMGDPGPPGKRGPPGFKGSEGYLGEEGIAGERGAPGPVGEQGTKGCYGTKGPKGNRGLNGQEGEVGENGIDGLNGEQGDNGLPGRKGEKGDEGSQGSPGKRGTPGDRGAKGLRGDPVSARAANWS

SEQ ID NO: 54832 - protein, 1624 aa, Homo sapiens
MSARGVGAATRLPAGHRSQEAAHAAACPFHGSEVSTVSPRAAGGTKLCAPRGAPCPRSARPEEIRPGLSKCRAGGCMEVSPRFEVEDFSGHNMMLLILFLVIICSHISVNQDSGPEYADVVFLVDSSDRLGSKSFPFVKMFITKMISSLPIEADKYRVALAQYSDKLHSEFHLSTFKGRSPMLNHLRKNFGFIGGSLQIGKALQEAHRTYFSAPANGRDKKQFPPILVVLASSESEDNVEEASKALRKDGVKIISVGVQKASEENLKAMATSQFHFNLRTVRDLSMFSQNMTHIIKDVIKYKEGAVDDIFVEACQGPSMADVVFLLDMSINGSEENFDYLKGFLEESVSALDIKENCMRVGLVAYSNETKVINSLSMGINKSEVLQHIQNLSPRTGKAYTGAAIKKLRKEVFSARNGSRKNQGVPQIAVLVTHRDSEDNVTKAAVNLRREGVTIFTLGIEGTSDTQLEKIASHPAEQYVSKLKTFADLAAHNQTFLKKLRNQITHTVSVFSERTETLKSGCVDTEEADIYLLIDGSGSTQATDFHEMKTFLSEVVGMFNIAPHKVRVGAVQYADSWDLEFEINKYSNKQDLGKAIENIRQMGGNTNTGAALNFTLSLLQKAKKQRGNKVPCHLVVLTNGMSKDSILEPANRLREEHIRVYAIGIKEANQTQLREIAGEEKRVYYVHDFDALKDIRNQVVQEICTEEADLNKHHSFSYAACKEMKADIMFLVDSSGSIGPENFSKMKTFMKNLVSKSQIGPDRVQIGVVQFSDINKEEFQLNRFMSQSDISNAIDQMAHIGQTTLTGSALSFVSQYFSPTKGARPNIRKFLILITDGEAQDIVKEPAVVLRQEGVIIYSVGVFGSNVTQLEEISGRPEMVFYVENFDILQRIEDDLVFGICSPREECKRIEVLDVVFVIDSSGSIDYDEYNIMKDFMIGLVKKADVGKNQVRFGALKYADDPEVLFYLDDFGTKLEVISVLQNDQAMGGSTYTAEALGFSDHMFTEARGSRLNKGVPQVLIVITDGESHDADKLNATAKALRDKGILVLAVGIDGANPVELLAMAGSSDKYFFVETFGGLKGIFSDVTASVCNSSKVDCEIDKVDLVFLMDGSTSIQPNDFKKMKEFLASVVQDFDVSLNRVRIGAAQFSDTYHPEFPLGTFIGEKEISFQIENIKQIFGNTHIGAALREVEHYFRPDMGSRINTGTPQVLLVLTDGQSQDEVAQAAEALRHRGIDIYSVGIGDVDDQQLIQITGTAEKKLTVHNFDELKKVNKRIVRNICTTAGESNCFVDVVVGFDVSTQEKGQTLLEGQPWMETYLQDILRAISSLNGVSCEVGTETQVSVAFQVTNAMEKYSPKFEIYSENILNSLKDITVKGPSLLNANLLDSLWDTFQNKSAARGKVVLLFSDGLDDDVEKLEQKSDELRKEGLNALITVALDGPADSSDLADLPYIEFGKGFEYRTQLSIGMRELGSRLSKQLVNVAERTCCCLFCKCIGGDGTMGDPGPPGKRGPPGFKGSEGYLGEEGIAGERGAPGPVGEQGTKGCYGTKGPKGNRGLNGQEGEVGENGIDGLNGEQGDNGLPGRKGEKGDEGSQGSPGKRGTPGDRGAKGLRGDPVSARAANWS

SEQ ID NO: 54833 - protein, 228 aa, Homo sapiens [sequence omitted]

SEQ ID NO: 54834 - protein, 228 aa, Homo sapiens [sequence omitted]

SEQ ID NO: 54835 - protein, 132 aa, Homo sapiens
MSCMLTTSGGGTGPLEGLQEEASISLITALTVSLKTTRPCCLFIGRVSPAFDQLLWNISTLPCRLPCDSWKSRSFVAWRGCKPRAAAPDAFSEQIPQRGCLTSEMNFSQCLRRGRCRNLTPLSNPEQSTQPL

SEQ ID NO: 54836 - protein, 82 aa, Homo sapiens
MATFPPATSAPQQPPGPEDEDSSLDESDLYSLAHSYLGGGGRKGRTKREAAANTNRPSPGGHERKLVTKLQNSERKKRGARR

SEQ ID NO: 54837 - protein, 95 aa, Homo sapiens
MKFLLLVLAALGFLTQVIPASAGGSKCVSNTPGYCRTCCHWGETALFMCNASRKCCISYSFLPKPDLPQLIGNHWQSRRRNTQRKDKKQQTTVTS

SEQ ID NO: 54838 - DNA, 20 bp, Homo sapiens
gatctgcccgcctccatttt

SEQ ID NO: 54839 - DNA, 20 bp, Homo sapiens
gatcatgaagaggcgctgag

SEQ ID NO: 54840 - DNA, 20 bp, Homo sapiens
gatctgggctcttgcagcca

SEQ ID NO: 54841 - DNA, 20 bp, Homo sapiens
gatcgcgctgcctggccggc

SEQ ID NO: 54842 - DNA, 20 bp, Homo sapiens
gatcgagataatgctattgg

SEQ ID NO: 54843 - DNA, 20 bp, Homo sapiens
gatcagagaaaaactattca

SEQ ID NO: 54844 - DNA, 20 bp, Homo sapiens
gatcacctgatttttttaac

SEQ ID NO: 54845 - DNA, 20 bp, Homo sapiens
gatccttccagctggtctgc

SEQ ID NO: 54846 - DNA, 20 bp, Homo sapiens
gatctgccactgggagagtg

SEQ ID NO: 54847 - DNA, 20 bp, Homo sapiens
gatcggagctctttcctttg

SEQ ID NO: 54848 - DNA, 20 bp, Homo sapiens
gatcaagttttgtttgtata

SEQ ID NO: 54849 - DNA, 20 bp, Homo sapiens
gatcacaaggtcactagatg

SEQ ID NO: 54850 - DNA, 20 bp, Homo sapiens
gatcctcacaaccacctaat

SEQ ID NO: 54851 - DNA, 20 bp, Homo sapiens
gatcgcgccactgcactccg

SEQ ID NO: 54852 - DNA, 20 bp, Homo sapiens
gatctgggtcacattttcca

SEQ ID NO: 54853 - DNA, 20 bp, Homo sapiens
gatctgtccaaggaaacttg

SEQ ID NO: 54854 - DNA, 20 bp, Homo sapiens
gatcttgcgttcccagtggt

SEQ ID NO: 54855 - DNA, 20 bp, Homo sapiens
gatcttggctcactgtactc

SEQ ID NO: 54856 - DNA, 20 bp, Homo sapiens
gatcttggcaatggtacact

SEQ ID NO: 54857 - DNA, 20 bp, Homo sapiens
gatcagagtaagttaaagta

SEQ ID NO: 54858 - DNA, 20 bp, Homo sapiens
gatctcttttgcatctctgc

SEQ ID NO: 54859 - DNA, 20 bp, Homo sapiens
gatcccgcggccgtgttttc

SEQ ID NO: 54860 - DNA, 20 bp, Homo sapiens
gatcaagacctcatgtggtt

SEQ ID NO: 54861 - DNA, 20 bp, Homo sapiens
gatccaggccggcttgccac

SEQ ID NO: 54862 - DNA, 20 bp, Homo sapiens
gatccccgccctccagtacc

SEQ ID NO: 54863 - DNA, 20 bp, Homo sapiens
gatctgtcagtttgggtcct

SEQ ID NO: 54864 - DNA, 20 bp, Homo sapiens
gatcagccagcgagtcctcc

SEQ ID NO: 54865 - DNA, 20 bp, Homo sapiens
gatccccaacccatttgggt

SEQ ID NO: 54866 - DNA, 20 bp, Homo sapiens
gatcccatgctggatgagag

SEQ ID NO: 54867 - DNA, 20 bp, Homo sapiens
gatcctttttgcttattttc

SEQ ID NO: 54868 - DNA, 3775 bp, Homo sapiens
cattcataagactcagagctacggccacggcagggacacgcggaaccaagacttggaaacttgattgttgtggttcttcttgggggttatgaaatttcattaatcttttttttttccggggagaaagtttttggaaagattcttccagatatttcttcattttcttttggaggaccgacttactttttttggtcttctttattactcccctccccccgtgggacccgccggacgcgtggaggagaccgtagctgaagctgattctgtacagcgggacagcgctttctgcccctgggggagcaacccctccctcgcccctgggtcctacggagcctgcactttcaagaggtacagcggcatcctgtgggggcctgggcaccgcaggaagactgcacagaaactttgccattgttggaacgggacgttgctccttccccgagcttccccggacagcgtactttgaggactcgctcagctcaccggggactcccacggctcaccccggacttgcaccttacttccccaacccggccatagccttggcttcccggcgacctcagcgtggtcacaggggcccccctgtgcccagggaaatgtttcaggctttccccggagactacgactccggctcccggtgcagctcctcaccctctgccgagtctcaatatctgtcttcggtggactccttcggcagtccacccaccgccgcggcctcccaggagtgcgccggtctcggggaaatgcccggttccttcgtgcccacggtcaccgcgatcacaaccagccaggacctccagtggcttgtgcaacccaccctcatctcttccatggcccagtcccaggggcagccactggcctcccagcccccggtcgtcgacccctacgacatgccgggaaccagctactccacaccaggcatgagtggctacagcagtggcggagcgagtggcagtggtgggccttccaccagcggaactaccagtgggcctgggcctgcccgcccagcccgagcccggcctaggagaccccgagaggagacgctcaccccagaggaagaggagaagcgaagggtgcgccgggaacgaaataaactagcagcagctaaatgcaggaaccggcggagggagctgaccgaccgactccaggcggagacagatcagttggaggaagaaaaagcagagctggagtcggagatcgccgagctccaaaaggagaaggaacgtctggagtttgtgctggtggcccacaaaccgggctgcaagatcccctacgaagaggggcccgggccgggcccgctggcggaggtgagagatttgccgggctcagcaccggctaaggaagatggcttcagctggctgctgccgcccccgccaccaccgcccctgcccttccagaccagccaagacgcaccccccaacctgacggcttctctctttacacacagtgaagttcaagtcctcggcgaccccttccccgttgttaacccttcgtacacttcttcgtttgtcctcacctgcccggaggtctccgcgttcgccggcgcccaacgcaccagcggcagtgaccagccttccgatcccctgaactcgccctccctcctcgctcggtgaactctttagacacacaaaacaaacaaacacatgggggagagagacttggaagaggaggaggaggaggagaaggaggagagagaggggaagagacaaagtgggtgtgtggcctccctggctcctccgtctgaccctctgcggccactgcgccactgccatcggacaggaggattccttgtgttttgtcctgcctcttgtttctgtgccccggcgaggccggagagctggtgactttggggacagggggtgggaaggggatggacacccccagctgactgttggctctctgacgtcaacccaagctctggggatgggtggggaggggggcgggtgacgcccaccttcgggcagtcctgtgtgaggatgaagggacgggggtgggaggtaggctgtggggtgggctggagtcctctccagagaggctcaacaaggaaaaatgccactccctacccaatgtctcccacacccaccctttttttggggtgcccaggttggtttcccctgcactcccgaccttagcttattgatcccacatttccatggtgtgagatcctctttactctgggcagaagtgagcccccccttaaagggaattcgatgcccccctagaataatctcatccccccacccgacttcttttgaaatgtgaacgtccttccttgactgtctagccactccctcccagaaaaactggctctgattggaatttctggcctcctaaggctccccaccccgaaatcagcccccagccttgtttctgatgacagtgttatcccaagaccctgccccctgccagccgaccctcctggccttcctcgttgggccgctctgatttcaggcagcaggggctgctgtgatgccgtcctgctggagtgatttatactgtgaaatgagttggccagattgtggggtgcagctgggtggggcagcacacctctggggggataatgtccccactcccgaaagcctttcctcggtctcccttccgtccatcccccttcttcctcccctcaacagtgagttagactcaagggggtgacagaaccgagaagggggtgacagtcctccatccacgtggcctctctctctctcctcaggaccctcagccctggcctttttctttaaggtcccccgaccaatccccagcctaggacgccaacttctcccaccccttggcccctcacatcctctccaggaaggcagtgaggggctgtgacatttttccggagaagatttcagagctgaggctttggtacccccaaacccccaatatttttggactggcagactcaaggggctggaatctcatgattccatgcccgagtccgcccatccctgaccatggttttggctctcccaccccgccgttccctgcgcttcatctcatgaggatttctttatgaggcaaatttatattttttaatatcggggggtggaccacgccgccctccatccgtgctgcatgaaaaacattccacgtgccccttgtcgcgcgtctcccatcctgatcccagacccattccttagctatttatccctttcctggtttccgaaaggcaattatatctattatgtataagtaaatatattatatatggatgtgtgtgtgtgcgtgcgcgtgagtgtgtgagcgcttctgcagcctcggcctaggtcacgttggccctcaaagcgagccgttgaattggaaactgcttctagaaactctggctcagcctgtctcgggctgacccttttctgatcgtctcggcccctctgattgttcccgatggtctctctccctctgtcttttctcctccgcctgtgtccatctgaccgttttcacttgtctcctttctgactgtccctgccaatgctccagctgtcgtctgactctgggttcgttggggacatgagattttattttttgtgagtgagactgagggatcgtagatttttacaatctgtatctttgacaattctgggtgcgagtgtgagagtgtgagcagggcttgctcctgccaaccacaattcaatgaatccccgacccccctaccccatgctgtacttgtggttctctttttgtattttgcatctgaccccggggggctgggacagattggcaatgggccgtcccctctccccttggttctgcactgttgccaataaaaagctcttaaaaacgc

SEQ ID NO: 54869 - DNA, 2092 bp, Homo sapiens
ccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgccattgatctgtgtgctgaagggacccatggatgtgagcaccactgcgtcaattccccaggctcctatttctgtcactgccaagttggctttgtactccagcaggaccagaggagctgcagggccattgactactgcagctttgggaaccatagctgtcagcatgagtgtgttagcacccctggtgggccacggtgccactgcagagagggccatgacttgcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttcttaaaaaaataaaaaaaactgatttccacggaaaaaaaaaaaaaaaaa

SEQ ID NO: 54870 - DNA, 1969 bp, Homo sapiens
ccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgccattgactactgcagctttgggaaccatagctgtcagcatgagtgtgttagcacccctggtgggccacggtgccactgcagagagggccatgacttgcagcctgatgggaggagctgtcaggtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttcttaaaaaaataaaaaaaactgatttccacggaaaaaaaaaaaaaaaaa

SEQ ID NO: 54871 - DNA, 1846 bp, Homo sapiens
ccaagcgccatgagaggccttctttgctggcccgtgttgctgctccttcttcagccctgggaaacccagctccagttgacaggtcccaggtgtcacactgggcccctggatctggtgttcgtgattgacagctcccgcagcgtgcgccctttcgagttcgagaccatgcggcagttcctcatgggcctcctccgaggcctgaacgtgggtcccaacgccacgcgcgttggcgtgatccagtattcgagtcaagtgcagagcgtcttccctctccgcgcgttctctcgccgcgaggacatggagcgcgccatccgcgacctggtgcctctggcgcaaggcaccatgacgggactggcaatccagtacgccatgaacgtggccttcagtgtggccgagggcgcgcgaccgccagaggagcgcgtgccgcgtgtcgctgtcatcgtgacagacgggcggccccaggaccgcgtggccgaggtggcggcacaggcgcgcgcccgcggcattgaaatttacgcggtgggggtgcagcgcgcggacgtgggctccctgcgcgccatggcatcgcccccgctagacgagcacgtcttcctcgtagagtccttcgacctcatccaggagttcggcctgcagttccagagccggctgtgtgtccgggacctttgcaatggcgtggaccatggctgtgagttccagtgtgtgagcgagggcctctcctaccgctgcctgtgccccgaggggcggcaacttcaggcagatggcaagagctgcaaccggtgccgggaaggccacgtggaccttgttctgctggttgatggctccaagagcgtgcgtccacaaaacttcgagctagtgaagcgcttcgtgaaccagattgtggacttcctagatgtgtcccccgagggcacgcgggtggggctggtgcagttctcgagccgcgtgcgcaccgagttccctctgggtcgctacggcaccgcagccgaggtgaagcaggcggtcctggccgtggagtacatggaacgcggcaccatgacagggctggcgttgcggcacatggtggagcacagcttctccgaggcgcagggtgcacggccccgtgcccttaacgtgcctcgtgttggcctggtcttcacggatggccgctcccaggatgacatctcggtgtgggcagcgcgcgccaaggaggaaggcatcgtcatgtacgccgtgggcgtgggcaaggcggtggaggcggagctgcgcgagatcgcctcggagccagcggaactgcacgtgtcctatgccccggacttcggcaccatgacgcacctgctggagaacctcagaggcagcatctgtccagaggagggcatcagcgcagggacagagcttcggagcccatgcgaatgcgaaagcctcgtggagttccagggccgcacgctgggggcgctcgagagcctgacgctgaacctggcccagctgacggcgcgcctggaggatctggagaaccagctggccaaccagaagtgagggccacggacggcccagacccgggctggggcgcggcaccacggacggtgccccttgcgcgccatcggtgcgccggggccaggcagaacctgggcccgtccggcttgggctgtcggggcggaggcgctggcgggcttccggcattgagctgagttggcctcgcccggaccattaggcggactgcggcgtcagggggatagcgggtggtgagggaaggggcacgtgctagaccggcacgccctcgccgcgtgctgcgctcagttctttgttggatttcttgtttgtgttcttaaaaaaataaaaaaaactgatttccacggaaaaaaaaaaaaaaaaa

SEQ ID NO: 54872 - DNA, 3834 bp, Homo sapiens
cctgagacagaggcagcagtgatacccacctgagagatcctgtgtttgaacaactgcttcccaaaacggaaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaattgtgaactgtacagccctggaatcccctgagcatggaagcctggtttgcagtcacccactgggaaacttcagctacaattcttcctgctctatcagctgtgataggggttacctgccaagcagcatggagaccatgcagtgtatgtcctctggagaatggagtgctcctattccagcctgcaatgtggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaagctttccagtgcacagccttgtccaaccccgagcgaggctacatgaattgtcttcctagtgcttctggcagtttccgttatgggtccagctgtgagttctcctgtgagcagggttttgtgttgaagggatccaaaaggctccaatgtggccccacaggggagtgggacaacgagaagcccacatgtgaagctgtgagatgcgatgctgtccaccagcccccgaagggtttggtgaggtgtgctcattcccctattggagaattcacctacaagtcctcttgtgccttcagctgtgaggagggatttgaattatatggatcaactcaacttgagtgcacatctcagggacaatggacagaagaggttccttcctgccaagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaagctcccactgagtccaacattcccttggtagctggactttctgctgctggactctccctcctgacattagcaccatttctcctctggcttcggaaatgcttacggaaagcaaagaaatttgttcctgccagcagctgccaaagccttgaatcagacggaagctaccaaaagccttcttacatcctttaagttcaaaagaatcagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatgtgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaaagtttcagagaagttctggctgaacactggcaacgacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgttt

SEQ ID NO: 54873 - DNA, 2820 bp, Homo sapiens
ggcgggttcgcgccccgaaggctgagagctggcgctgctcgtgccctgtgtgccagacggcggagctccgcggccggaccccgcggccccgctttgctgccgactggagtttgggggaagaaactctcctgcgccccagaagatttcttcctcggcgaagggacagcgaaagatgagggtggcaggaagagaaggcgctttctgtctgccggggtcgcagcgcgagagggcagtgccatgttcctctccatcctagtggcgctgtgcctgtggctgcacctggcgctgggcgtgcgcggcgcgccctgcgaggcggtgcgcatccctatgtgccggcacatgccctggaacatcacgcggatgcccaaccacctgcaccacagcacgcaggagaacgccatcctggccatcgagcagtacgaggagctggtggacgtgaactgcagcgccgtgctgcgcttcttcttctgtgccatgtacgcgcccatttgcaccctggagttcctgcacgaccctatcaagccgtgcaagtcggtgtgccaacgcgcgcgcgacgactgcgagcccctcatgaagatgtacaaccacagctggcccgaaagcctggcctgcgacgagctgcctgtctatgaccgtggcgtgtgcatttcgcctgaagccatcgtcacggacctcccggaggatgttaagtggatagacatcacaccagacatgatggtacaggaaaggcctcttgatgttgactgtaaacgcctaagccccgatcggtgcaagtgtaaaaaggtgaagccaactttggcaacgtatctcagcaaaaactacagctatgttattcatgccaaaataaaagctgtgcagaggagtggctgcaatgaggtcacaacggtggtggatgtaaaagagatcttcaagtcctcatcacccatccctcgaactcaagtcccgctcattacaaattcttcttgccagtgtccacacatcctgccccatcaagatgttctcatcatgtgttacgagtggcgttcaaggatgatgcttcttgaaaattgcttagttgaaaaatggagagatcagcttagtaaaagatccatacagtgggaagagaggctgcaggaacagcggagaacagttcaggacaagaagaaaacagccgggcgcaccagtcgtagtaatccccccaaaccaaagggaaagcctcctgctcccaaaccagccagtcccaagaagaacattaaaactaggagtgcccagaagagaacaaacccgaaaagagtgtgagctaactagtttccaaagcggagacttccgacttccttacaggatgaggctgggcattgcctgggacagcctatgtaaggccatgtgccccttgccctaacaactcactgcagtgctcttcatagacacatcttgcagcatttttcttaaggctatgcttcagtttttctttgtaagccatcacaagccatagtggtaggtttgccctttggtacagaaggtgagttaaagctggtggaaaaggcttattgcattgcattcagagtaacctgtgtgcatactctagaagagtagggaaaataatgcttgttacaattcgacctaatatgtgcattgtaaaataaatgccatatttcaaacaaaacacgtaatttttttacagtatgttttattaccttttgatatctgttgttgcaatgttagtgatgttttaaaatgtgatgaaaatataatgtttttaagaaggaacagtagtggaatgaatgttaaaagatctttatgtgtttatggtctgcagaaggatttttgtgatgaaaggggattttttgaaaaattagagaagtagcatatggaaaattataatgtgtttttttaccaatgacttcagtttctgtttttagctagaaacttaaaaacaaaaataataataaagaaaaataaataaaaaggagaggcagacaatgtctggattcctgttttttggttacctgatttccatgatcatgatgcttcttgtcaacaccctcttaagcagcaccagaaacagtgagtttgtctgtaccattaggagttaggtactaattagttggctaatgctcaagtattttatacccacaagagaggtatgtcactcatcttacttcccaggacatccaccctgagaataatttgacaagcttaaaaatggccttcatgtgagtgccaaattttgtttttcttcatttaaatattttctttgcctaaatacatgtgagaggagttaaatataaatgtacagagaggaaagttgagttccacctctgaaatgagaattacttgacagttgggatactttaatcagaaaaaaagaacttatttgcagcattttatcaacaaatttcataattgtggacaattggaggcatttattttaaaaaacaattttattggccttttgctaacacagtaagcatgtattttataaggcattcaataaatgcacaacgcccaaaggaaataaaatcctatctaatcctactctccactacacagaggtaatcactattagtattttggcatattattctccaggtgtttgcttatgcacttataaaatgatttgaacaaataaaactaggaacctgtatacatgtgtttcataacctgcctcctttgcttggccctttattgagataagttttcctgtcaagaaagcagaaaccatctcatttctaacagctgtgttatattccatagtatgcattactcaacaaactgttgtgctattggatacttaggtggtttcttcactgacaatactgaataaacatctcaccggaattc

SEQ ID NO: 54874 - DNA, 1561 bp, Homo sapiens
cggcaggcgcccggggtcctcagcgctgcagactcctgacctgccgactgcggatcccgagtccccggatcccggacccatcctgtggagcccactcctggcagacgccgcgatgcccggcccttggttgctgctcgctctggctttgaccctgaacctgaccggtgtccccggcggccgtgctcagccagaggcggcccagcaggaggcagtgacggccgcggagcatccgggcctggatgacttcctgcgccaggtggagcgcctcctcttcctccgggaaaacatccagcggctgcaaggggaccagggtgagcactccgcgtcccagatctttcaatctgactggctctccaaacgtcagcatccaggcaaaagagaggaggaggaggaagagggagttgaagaagaggaagaggaagaagggggggctgtgggaccccacaaacggcagcaccctggccgacgagaagatgaggcttcatggtcagtcgatgtaacccagcacaagcggcagcatcctggccggcgctccccctggcttgcatatgctgtcccgaagcggcagcacccaggcagaaggctggcagatcccaaggctcaaaggagctgggaagaagaggaggaggaggaagagagagaggaagacctgatgcctgaaaaacgccagcatccgggcaagagggccctgggaggcccctgtgggccccagggagcctatggtcaagcgggcctcctgctggggctcctggatgacctgagtaggagccagggagctgaggaaaagcggcagcaccctggtcggcgggcagcctgggtcagggagcccctggaggagtgaacccagttttccctgaagtcgagtttgtggtctaaggatgtcttgagccctgtgtgccccaccattcatgacctctgtattctctagttagatccctgaccataagcctgagcccctccctcccagccccatattcacacacatcccagcccctggccttgccctcttcctttaggcatgtgagaaaatcagcctagcagtttaaaccccactttcctccacttagcaccataggcaagggggcagatcccagagcccctctcaccccccccaccacaggcctgctccttccttagccttggctaagatggtccttctgtgtcttgcaaagactccccaagtggacagggagcccctgggagggcagccagtgagggtggggtgggactgaagcgttgtgtgcaaatccagcttccatcccctccccaacctggcaggattctccatgtgtaaacttcacccccaggacccaggatcttctcctttctgggcatccctttgtgggtgggcagagccctgacccacagctgtgttactgcttggagaagcatatgtaggggcataccctgtggtgttgtgctgtgtctggctgtgggataaatgtgtgtgggaatattgaaacatcgcctaggaattgtggtttgtatataaccctctaagcccctatcccttgtcgatgacagtcatcctaatgataataaaacctgcatccagataatc

SEQ ID NO: 54875 - protein, 338 aa, Homo sapiens
MFQAFPGDYDSGSRCSSSPSAESQYLSSVDSFGSPPTAAASQECAGLGEMPGSFVPTVTAITTSQDLQWLVQPTLISSMAQSQGQPLASQPPVVDPYDMPGTSYSTPGMSGYSSGGASGSGGPSTSGTTSGPGPARPARARPRRPREETLTPEEEEKRRVRRERNKLAAAKCRNRRRELTDRLQAETDQLEEEKAELESEIAELQKEKERLEFVLVAHKPGCKIPYEEGPGPGPLAEVRDLPGSAPAKEDGFSWLLPPPPPPPLPFQTSQDAPPNLTASLFTHSEVQVLGDPFPVVNPSYTSSFVLTCPEVSAFAGAQRTSGSDQPSDPLNSPSLLAR

SEQ ID NO: 54876 - protein, 581 aa, Homo sapiens
MRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCAIDLCAEGTHGCEHHCVNSPGSYFCHCQVGFVLQQDQRSCRAIDYCSFGNHSCQHECVSTPGGPRCHCREGHDLQPDGRSCQVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 54877 - protein, 540 aa, Homo sapiens
MRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCAIDYCSFGNHSCQHECVSTPGGPRCHCREGHDLQPDGRSCQVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 54878 - protein, 499 aa, Homo sapiens
MRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 54879 - protein, 610 aa, Homo sapiens
MIASQFLSALTLVLLIKESGAWSYNTSTEAMTYDEASAYCQQRYTHLVAIQNKEEIEYLNSILSYSPSYYWIGIRKVNNVWVWVGTQKPLTEEAKNWAPGEPNNRQKDEDCVEIYIKREKDVGMWNDERCSKKKLALCYTAACTNTSCSGHGECVETINNYTCKCDPGFSGLKCEQIVNCTALESPEHGSLVCSHPLGNFSYNSSCSISCDRGYLPSSMETMQCMSSGEWSAPIPACNVVECDAVTNPANGFVECFQNPGSFPWNTTCTFDCEEGFELMGAQSLQCTSSGNWDNEKPTCKAVTCRAVRQPQNGSVRCSHSPAGEFTFKSSCNFTCEEGFMLQGPAQVECTTQGQWTQQIPVCEAFQCTALSNPERGYMNCLPSASGSFRYGSSCEFSCEQGFVLKGSKRLQCGPTGEWDNEKPTCEAVRCDAVHQPPKGLVRCAHSPIGEFTYKSSCAFSCEEGFELYGSTQLECTSQGQWTEEVPSCQVVKCSSLAVPGKINMSCSGEPVFGTVCKFACPEGWTLNGSAARTCGATGHWSGLLPTCEAPTESNIPLVAGLSAAGLSLLTLAPFLLWLRKCLRKAKKFVPASSCQSLESDGSYQKPSYIL

SEQ ID NO: 54880 - protein, 346 aa, Homo sapiens
MFLSILVALCLWLHLALGVRGAPCEAVRIPMCRHMPWNITRMPNHLHHSTQENAILAIEQYEELVDVNCSAVLRFFFCAMYAPICTLEFLHDPIKPCKSVCQRARDDCEPLMKMYNHSWPESLACDELPVYDRGVCISPEAIVTDLPEDVKWIDITPDMMVQERPLDVDCKRLSPDRCKCKKVKPTLATYLSKNYSYVIHAKIKAVQRSGCNEVTTVVDVKEIFKSSSPIPRTQVPLITNSSCQCPHILPHQDVLIMCYEWRSRMMLLENCLVEKWRDQLSKRSIQWEERLQEQRRTVQDKKKTAGRTSRSNPPKPKGKPPAPKPASPKKNIKTRSAQKRTNPKRV

SEQ ID NO: 54881 - protein, 242 aa, Homo sapiens
MPGPWLLLALALTLNLTGVPGGRAQPEAAQQEAVTAAEHPGLDDFLRQVERLLFLRENIQRLQGDQGEHSASQIFQSDWLSKRQHPGKREEEEEEGVEEEEEEEGGAVGPHKRQHPGRREDEASWSVDVTQHKRQHPGRRSPWLAYAVPKRQHPGRRLADPKAQRSWEEEEEEEEREEDLMPEKRQHPGKRALGGPCGPQGAYGQAGLLLGLLDDLSRSQGAEEKRQHPGRRAAWVREPLEE

SEQ ID NO: 54882 - DNA, 20 bp, Homo sapiens
gatccacttgcggcagaagg

SEQ ID NO: 54883 - DNA, 20 bp, Homo sapiens
gatcaaaagtaaattatcag

SEQ ID NO: 54884 - DNA, 20 bp, Homo sapiens
gatcaccaaaggactgagaa

SEQ ID NO: 54885 - DNA, 20 bp, Homo sapiens
gatctagattacactgcacc

SEQ ID NO: 54886 - DNA, 20 bp, Homo sapiens
gatcaggatgggagacgcgc

SEQ ID NO: 54887 - DNA, 20 bp, Homo sapiens
gatcccagacccattcctta

SEQ ID NO: 54888 - DNA, 20 bp, Homo sapiens
gatcatcagcagtggcacac

SEQ ID NO: 54889 - DNA, 20 bp, Homo sapiens
gatctggagaaccagctggc

SEQ ID NO: 54890 - DNA, 20 bp, Homo sapiens
gatcaactgaaaactggaga

SEQ ID NO: 54891 - DNA, 20 bp, Homo sapiens
gatcaagaaagtgttggcta

SEQ ID NO: 54892 - DNA, 20 bp, Homo sapiens
gatcaggctatgtatggaat

SEQ ID NO: 54893 - DNA, 20 bp, Homo sapiens
gatccatacagtgggaagag

SEQ ID NO: 54894 - DNA, 20 bp, Homo sapiens
gatctttatgtgtttatggt

SEQ ID NO: 54895 - DNA, 20 bp, Homo sapiens
gatcttctcctttctgggca

SEQ ID NO: 54896 - DNA, 1917 bp, Homo sapiens
ggcacgagagcagactctgaaccaggaagtagccgtgtctagcgctctacaagacacataggagaggtggcatccatggccctgaaacgacaagcccatgttgccagcgcattatcaccaagtcacttggcaagcgtttagcagactactggtgcctggatgatctgtaccgggagatggtgagatgctatgtggaaatcgttgagaagcttccagaacgccggccagacccagctaccattgaaggctgtgctcagctaaagcccaataactaccttctcgcctggcacacaccgttcaatgaaaaaggctcagggtttggagcggccaccaaggccatgtgcatcggcctgcggtactggaagcctgagcggctggagaccctcatcgaggtcagcgtggagtgcggccggatgacccacaaccatcccacaggcttcctgggctccctgtgcacggccctgtttgtgtcgttcgccgcacaaggaaagcccctggtccagtgggggagagacatgctgcgggcggtgcctctggcagaagagtactgcaggaagaccatccggcacacggcagaataccaggagcactggttttactttgaagctaaatggcaattttatttggaggagaggaaaatcagtaaagactcagaaaataaagccatcttccccgacaattatgatgcagaagagagggaaaagacctacaggaagtggagctcggaaggtcgagggggaagacgaggccacgatgcccccatgatagcctatgacgccctccttgcagcaggaaacagctggactgagctgtgtcaccgggccatgtttcatggaggggagagcgcggccacgggcaccattgcaggctgcctgttcgggttgctgtacggcctggacctcgttcccaaaggcttgtaccaggacctggaggacaaggagaagctggaggacctgggcgcggctctctaccgcctgtccacagaggagaagtaaagccatttctgccactttccccctagagagccgattccaccccggggcccgtagggccctctcgcagcccctgggtgagggtgtctctgtgaggctccactgcggtctgtgcctgactggccacatctaactctctgtttccaatttcagaatcctaactgttgcataaaatacattgtttgtcctgcgagaatattttccgtcctccaccatcaacattgacactgcgtagatttgccgcacttggacctccatgcgtggcactcacccgcagtctcctggacaggcgctgtattttattctgtcgcagagctaatgctgtttactcactcacttcaacaacactaactgcggtggtggcctccagcaggcccccccgctgcagaccctctgtcctgcctctgcctccaggcatgcgtttccccgtgagggccaatgcacctccccccaccccccaccctcccatgtccacagtgggtcgtgtgttcctggacagagaaacagtccacactggggcctgcgggacacatatagcagcatattttgctcttaaccccacccacctttttaatcacactagattttaagatcaatccctttttgaaacaactcacggagaaaaccagaacataaatggcctcctgccagctccggcgtctctctgtggtctgccttagtgggccaagtccaaatgcagagaaggcctttcccttccgcgcctgccccatcgggctcgctgacgaggaagcgctgtccctgtgatgaggttctctctcagagagtcttggaaaagagaccacttgctcttgtttaaaataaatttggacgtgatttttccatgcagcatctggtgtgaataaaacagcagttgactgataaaaaaaaaaaaaaaaaaaaaaaaaaaaaaaaaaaaaaaaaaaaa

SEQ ID NO: 54897 - DNA, 1462 bp, Homo sapiens
aaccagtcccaagtgctcaggacagaggctggacgggctccttcctgcacccctgctcttgggacacagtgccctccggctctaataggccaggagttgggggggcaactggctctgctccctggccctggctccccctgctccctggggctgcccgaggtgaaggtgacaggtgggggaggcaggtggagaattgggccagtgagctcatggcaaaggcgcccagctgggcaggggtgggtgctctggcctataaagcccccgaggccctgtggcctgcagaggcggttatggacggcaccatggaggactccgaggcggtgcagagggccacagcgctcatcgagcagcggctggcacaggaggaggagaatgagaaactccgaggagacgcacgccagaagctgcccatggacttgctggtgctggaggatgagaagcaccacggggctcagagtgcagccctgcagaaggtgaagggccaagagcgcgtgcgcaagacgtccctggacctgcggcgggagatcatcgatgtgggcgggatccagaacctcatcgagctgcggaagaaacgcaagcagaagaagcgggacgctctggccgcctcgcatgagccgcccccagagcccgaggagatcactggccctgtggatgaggagaccttcctgaaagctgcggtggaggggaaaatgaaggtcattgagaagttcctggctgacggggggtcagccgacacgtgcgaccagttccgtcggacagcactgcaccgagcttccctggaaggccacatggaaatcctggagaagcttctagataatggggccactgtggacttccaggatcggctggactgcacagccatgcattgggcctgccgcgggggccacttagaggtggtgaaacttctgcaaagccatggagcagacaccaatgtgagggataagctgctgagcaccccgctgcacgtggcagtccggacagggcaggtggagattgtggagcactttctatccctgggcctggaaatcaatgccagagacagggaaggggatactgccctgcatgacgctgtgaggctcaaccgctacaaaatcatcaaactgctgctcctgcatggggctgacatgatgaccaagaacctggcaggaaagaccccgacggacctggtgcagctctggcaggctgatacccggcacgccctggagcatcctgagccgggggctgagcataacgggctggaggggcctaatgatagtgggcgagagacccctcagcctgtgccagcccagtgaatgcgtgccccagcccagccagctacccagcccctctctgtgtgcagccggagggtcctaagaatggctcccggagctaactgagggcccagccttttttctgcatgatccaggagcacataccacaaactaccacaataaaaaagctgtttttgctaaaaaaaaaaaaa

SEQ ID NO: 54898 - DNA, 1526 bp, Homo sapiens
gctgcatttgtccagtcctgctactggatgccatcattggcccccgactgcccactgcttgccatgcctgaggagacccaagaagactccgtggcgccaatgatgcccagccagaggagcagggggccattggcccccaaccacgtgcatgaggtatgcctgcaccaggtggagtccatcagcgacctacatagtggagcaggcacactgcgcccctatctaactgaagaggcacgaccgtgggatgagctgctgggcgttttgccgccgtcactgtgtgcccaggctggctgcagccctgtgtacagacgaggagggttcctgctgctgctcgcgctgctggtgctcacttgcctagtgctcgcactcctggctgtctacctgagcgtgctgcagagtgaatccctgcgcatcctggcacacacgctccgcacgcaggaggagacactactcaaactccgcttggccagcctcagccagcttcggaggctcaactccagtgaggcccaagcacccagctgagatgccatttggatctggggcctgggggtgtgtgttggggggggaataaagtggctatgggcaggtctctccttccctactgctggctgccacatctacactatttccttggtgagatttttgtacaagaacctgttgttaacttaatggctgcctccctctcctgatctcttcaagccaggcctagccaagcctctggtgccaaagcctcgctttgggtggcccaaggtcaggggaaggggcaccagcctcctggctcctcctgtggcctgtcaacactctctggccaccccagatggcaggttctgaagtctagaaatagctgcccccatagcaatcacccaaactctgccagggctcccagtgagggtccagcctcagctcttaaagacaggctgggctctgagtagggggagaggcaccacctggggaagactgccttggagggcaaaggtgacatcgtggaagaccagttgggcccaagcctgggatagtagatggggagggagaacagaaaaatacccaggggttaagaccacagaaggctgaccgttctgtttaattatctgtaataatccttaaaaatcagcacacaaatccattccaggtagctttgccaccccacctgctgtggtggcatttgtccagatgccaccacccccctaagagtgggtcatcctgggggagcaaggcctgagaaaggaaaggaagggaaaggccccctagtgcctgccccacagccctgaggaaggcacatatttagcctggcctgagacaggacaggaaggggccacagggctgagtgcagggacaaaggggtcagggtcccaagtgtccgggcccccagctacccaccccatgtctgtttttggttttgtcattaaaaaaaataaagtgacaaatactggtggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 54899 - DNA, 6451 bp, Homo sapiens
tggagccagggcagcaagaaggtgtctgttggagccagcagaacagaaccaatttgaacaagaacctccagaggaacgacgaaccctgagaccacagctgctacagaccacaaacaccccatcagccaagagagacccttgcatccagcctctaccctgctgaacatctagatctaaggctcccaatcccatcctcatctctgccccttcttctcagaaggatggccgacacccagacacaggtggcccccacaccaaccatgaggatggcaactgcagaggacctgcccctccctccacccccagccctggaggacctgccactgccgccacccaaggaatccttctccaagttccatcagcagcggcaagctagtgagctccgccgcctctacaggcacatccaccctgagctccgcaagaatctggctgaggctgtggccgaggatctggctgaggtcctgggctctgaggaacccaccgagggtgacgttcagtgcatgcgctggatctttgagaactggagactggatgccattggagaacacgagaggccagctgccaaggagcccgtgctgtgtggtgacgtccaggccacctcccgcaagtttgaggaaggctcctttgccaacagcacagaccaggagccaaccaggccccagccaggtggaggagacgttcgtgcagcccgctggctatttgagacaaagccactggacgagctgacagggcaagccaaggaactggaggccactgtgagggagcctgcagccagcggagatgtgcagggtaccaggatgctctttgagacgcggccgctggaccgcctgggctcccgcccctccctgcaggagcagagccccttggaactgcgctcagagatccaggagctgaagggtgatgtgaaaaagacagtgaagctcttccaaacggagcccctgtgtgccatccaggatgcagagggcgccatccatgaggtcaaggccgcatgccgggaggagatccaaagcaacgcggtgaggtctgcccgctggctctttgagacccggcctctggacgccatcaaccaggaccccagccaggtgcgggtgatccgggggatttccctggaggagggggcccggcccgacgtcagtgcaactcgctggatctttgagacacagcccctggatgccatccgggagatcttggtagatgagaaggacttccagccatccccagaccttatcccacctggtccagatgttcagcagcagcagcatctgtttgagacccgagcgctggacactctgaagggggacgaagaggctggagcagaggccccacccaaggaggaagtggtccctggtgatgtccgctccaccctgtggctatttgaaacaaagcccctggatgctttcagagacaaggtccaagtgggtcacctacagcgagtggatccccaggacggtgaggggcatctatccagtgacagctcctcagcactgcccttctctcagagtgccccccagagggatgagctaaagggggatgtgaagacttttaagaacctttttgagacccttcccttggacagcattggacagggtgaggttctggcccatgggagtccaagcagagaagaaggaactgattctgctgggcaggcccagggcatagggtccccagtgtatgccatgcaggacagcaagggccgcctccatgccctgacctctgttagcagagagcagatagtcggaggtgatgtgcagggctacaggtggatgtttgagacacagcccctagaccagctcggccgaagccccagtaccatcgacgtggtgcggggcatcacccggcaggaagtggtggctggggacgttggcacagctcggtggctttttgagacccagcccctggagatgatccaccaacgggagcagcaggaacgacagaaagaagaagggaagagtcagggagacccccagcctgaggcacccccaaagggcgatgtgcagaccatccggtggttgttcgagacttgcccaatgagtgagttggccgaaaagcaggggtcagaggtcacagatcccacagccaaggctgaggcacagtcctgcacctggatgttcaagccccaacctgtggacaggccagtgggctccagggagcagcacctgcaggttagccaggtcccggctggggaaagacagacagacagacacgtctttgagaccgagcctcttcaggcctcaggccgtccctgtggaagacggcctgtgagatactgcagccgcgtggagatcccttcagggcaggtgtctcgtcagaaagaggtttttcaggccctggaggcaggcaagaaggaagaacaggagccccgggtaatcgctgggtccatccccgcgggttctgtccacaagttcacttggctttttgagaattgtcccatgggctccctggcagctgagagcatccaagggggcaacctcctggaagagcagcccatgagcccctcaggcaacaggatgcaagagagccaggagactgcagctgaggggaccctgcggactctgcatgccacacctggcatcctgcaccatggaggcatcctcatggaggcccgagggccaggggagctctgtcttgccaagtatgtgctctcgggcacagggcaggggcacccttatatacgaaaggaggagctggtgtcaggtgaacttcccaggatcatctgccaagtcctgcgccggccagatgtggaccagcaggggctgctggtgcaggaagacccaactggccagctccaactcaagccgctgaggctgccaactccaggcagcagtgggaatattgaagacatggaccctgagctccagcagctgctggcttgcggtcttgggacctccgtggcaaggactgggctggtgatgcaggagacagagcagggcctggtcgcactgactgcctactctctgcagccccggctaactagcaaggcctctgagaggagcagcgtgcagctgttggccagctgcatagataaaggagacctgagtggcctgcacagtctgcggtgggagcccccggctgacccgagtccagtgccagccagcgagggggcccagagcctgcacccaactgagagcatcatccatgttcccccactggaccccagcatggggatggggcatctgagagcctcaggggccaccccttgccctcctcaggccattggaaaggcagtccctctggctggggaagctgcagcaccagcccaattgcaaaacacagaaaagcaggaagacagtcactctggacagaaagggatggcagtcttgggaaagtcagaaggagccacgactacccctccggggcctggggccccagacctcctggccgccatgcagagtctgcggatggcaacagctgaagcccagagcctgcaccagcaagttctgaacaagcacaagcagggccccaccccaacagccacttccaaccccatccaggacggtcttcggaaagctggggctacccaaagcaacataaggcctgggggtggaagtgatccccggatcccagcagcccccagaaaggtcagtagggaagagcaagcactacccagagggctgcctggggggtgggtgacaattcaggatggcatctacaccgctcatcccgtgaggacctttgacccacctgggggtgtccagctttctcagagggaaccccagtcaaggcacagggagactgccctctcagtccaggctccccgcccactccagggaggcccaggtcagagtactgggccagggcgggaggagcctgggggctgcacacagatggcctgggggccaccagggaaggcgatggcagaagtctgcccagggggcctccaagctgcagagaccaccctgaagactgcccctctaggccgccacattctggcctctgggccccaagctgcaggtgccagcccgcacccccataatgcctttgttcctcctcctcctactctcccagctgctgtgacaggacctgactttccagctggagcccaccgtgctgaggactccatccagcaagcctctgagcccctgaaggacccccttcttcactcccacagcagccctgctggccagagaacccctggagggtcacagacaaagaccccaaaactggaccccaccatgcccccaaagaagaagccgcagctgccccctaaacctgcacacctaacccagagccaccctcctcagaggctgcccaagcccttgcctctatctcccagcttttcctcggaggtggggcaaagagaacaccaacgaggtgagagagatacagccatccctcagccagccaaggttcccactactgtagaccagggccacatacctctggccagatgtcccagtggacatagccagcccagcttacaacatggcctcagcaccacggcccccaggcccaccaagaatcaggctacaggcagcaatgcccagagctctgagccccccaagctcaatgccctcaaccatgatcccacctcaccacagtggggccccggcccctcaggagagcagcccatggaaggttcccaccaaggggcccctgagagccctgacagtctgcaaagaaaccagaaagagctccagggcctcctgaaccaggtgcaagccctggagaaggaggccgcaagcagtgtggacgtgcaggccctgcggaggctctttgaggccgtgccccagctgggaggggctgctcctcaggctcctgctgcccaccaaaagcccgaggcctcagtggagcaggcctttggggagctgacacgggtcagcacggaagttgctcaactgaaggaacagaccttggcaaggctgctggacattgaagaggctgtgcacaaggcactcagctccatgtctagcctccagcctgaggccagtgccagaggccatttccagggacctccaaaagaccacagtgcccacaagatcagtgtcacagtcagcagtagcgccaggcccagtggctcaggccaggaggtcggaggtcaaactgcagtcaagaaccaagccaaggttgaatgccacactgaggcccagagtcaagtcaagatcagaaatcacacagaggccagaggtcacacagcctcaactgccccttccaccaggaggcaggagacatcaagagagtatttgtgccctcctcgggttttaccttccagccgagattctccctcctccccaacatttatctccatccagtcggccacaaggaagcctctagagactcccagctttaagggcaaccctgatgtctcagtgaaaagcacacaactggctcaggacataggccaggccctgctccaccagaaaggtgtccaagacaaaactgggaagaaggacatcacccagtgctctgtgcaacctgaacctgcccctccctcagccagtcccctgcccagagggtggcaaaagagtgttctggagctacagacggggccagggagctcacaacactatggagccatgagaaccgtgactgaacagtatgaggaggtggaccagtttgggaacacagtcctcatgtcttccaccacagtcaccgagcaggcagagccacccaggaacccaggctcccacctcgggctccacgcctcccccttgctgaggcagttcctgcacagcccagctgggttcagcagtgacctgacagaagctgagacggtgcaggtgtcctgcagctactcccagccagctgcccagtgaggcccaccgcctcccaccacacctgccacctgttcctggcctccactgccccaggactgaagtgggtacctgcctcctgtacactggagcaaggaccaagaggaaatggcatcttcagaggattactgtgggccatttccctttcgcagttctttcaataggcccagttcttccaaatggaaaaagaaaggtctggaagaggcccacagagttgcacaggcgtgggggtaggatgggggctcccagctgcttgtggaggatgtaatatatacagacacacacatgtttttcacacaggcctggcccacgcatcgacatgtgtgaatttgcacaccactgcctgaattggagccccccagagtgtccctctacccagagtttttatttctttaattagtctgagtgttcccagccatctgctccttaatccctggagaggaacagagccaactggacacagcgttggtctctgtttggaatcactgtgaggtctccagaaggacctggccgccagccccttcatcaccatctccatcattcagctggtcatctggtggcccaaaggtcacccaaagagtcagcaatcagcatgtccctagaagccaaatgcactgcctttctctgtccccatgactgtcccccactctgcaccccaaatgggaagcatacggtctgaataaatccaagttttattctct

SEQ ID NO: 54900 - DNA, 5371 bp, Homo sapiens
tacggctgcgagaagacgacagaaggggacatacagcagctgtaggaggcagaaaggatgtggctgtggaaggaaaccttttgggtttcagcacagagtctggaattcctgcttctgatcatcctaggccacaggcaaggagcgtggcagagtcccccagctatggccctggcctcccgccgtcgcctcctgagaacccacaggcaaagggcagggagggcgtcaggtttccccgtggggcggagcctgaccatctgcttcccgcagtgcctcccgcggaggtggacatggggtgggtaggtggcacccaccagcggggccctccccatctacaggcacacctgccccctactgctggtgacacacaggcaaagctccgggccagtgtccccgagcctaggacgcaggcaggtgaatcccaggagcgtcccctgacacaggcggacctggggaggcaacagagtcaccaggcacaggaggagaccccccagcccggggatgcggggaagagggtggcgccgtcgggctcgaaggttgtgctgaacccagcaaaagagcctcagacatggtgggcacaggatctggccggggacaaagggatggccattggggttgggggcgcctgccagcgcagtgaccaaggtcagcagcatctgcagggaccctgggaggagcgggggcggagcacggcgtggggagagggcaccagggctgccaggaacccagctgtgcctccaggggagcccgaggggccgggaagcccggcagcccaaggacaggcccagaaacaggttcaggaatgggaccggggacaggttcagggacacgctcaagaacaggcccagtggcagacccagatagaggcccaggggcaggcacaggaacaggctcagggtgggacccagggacacagtcagggacaggcccagaaacagtttcagaattgggcccagggacaggctcagggacacgctcaagaacaggcccagtggcagatccagatagaggcccaggggcaggcacaggaaccggctcagggtggggcccagggacaggttcagggacaggcccagaaatgggctcaggggcagattcagggacaggcccagaaacaggttcaaggagaggttcagaaatgggcccaggaagaggctcagggacaggcccagtggcagacccagataaaggcccagaaatgggctcaggaacagacccagaaaggggctcaggaacgggttcagggtcaggcccagaaaggggctcaggaacgggcccaggaacaggctcaggagcagacccagatagaggctcagggtcaggcccagaagggggctcaggaacgggctcgggaacaggcccagaaaggggctcaggaacgggctcgggaacgggcccagaaaggggctcaggaacgggctcgggaacaggcccagaaaggggctcaggaacgggctcgggaacaggcccagaaaggggctcaggaacgggctcgggaacaggcccagaaaggggctcaggaacgggctcaggaacagggtcgggagcagacccacatagaggctcagggtcaggcccagaaaggggctcaggaatgggctcgggatcgggctcgggatcagggctgggagcagacccagatagagactcagaggcagacccagaaaggggctcaggaacgggcttgggaacagggttgggagcagacccacatagaggctcagggtcaggcccagaaaggggctcaggaacgggctcgggaacaggcccagaaaggggctcaggaacgggctcaggaacagggtcgggagcagacccacatagaggctcagggtcaggcccagaaaggggctcaggaatgggctcgggatcgggctcgggatcagggctgggagcagacccagatagagactcagaggcagacccagaaaggggctcaggaacgggcttgggaacagggtcgggaacaggccttgacaagtgggatggcgcctcgggcctgggagcagcccattagtggcatagctgagggagtggatgctgctggcaggagtggggggtccagaagcccagcccccagggatggtggacagtcagggggcagtggcctgggggagcccagcgccgggtacccacccccaggaagccgccccctcaggggcaagagcattgccacctctcccctggggctgggaaagagcccaactgagcccaagcctgaggctgggggctgcgggactccccaggccccggcccaggaggggtccccagaccaccctggggctgagagggccctgcaggacaggatggaggcatcggagcctgagcgtcgcgggaggtccaggcacctggccaagtacaaagcccagagcttccgtgaccagagggccttcgatttgtccttcagaccaatgagcgtcagggccagcgacatgtctgagctcccaaagtgaggccccgagtacacaccgtggctcgcccagcactgtgacatccgcccattgagggacttcaggcattttcctgcctccaaatgcgtcttggagcatcccctacagagacgcctgtttccataattttctttcccttcttcacaagctgaccttgggaggattgagctacatgtgggtcgggttcctgtcaccccacagagccacgaggccatgggggtgggaggtgcgggcctgtggcctcaccaggccctcgggattgtgtcttcactcgggggcgccggctcacccctctctcacacagcctgcagcgtggagctcacacctcccgcagtggcacggtgtgtgcgtccccttcaatctgcaggatgctggcactttgggacacctccccagctctcacagggccacctcccactgctccctgcccacaccccaccatgccctgctctgatgtggccacatggcacccaccatccatgggcccaaagtgacgcacaccgccccacccccatgactcgaaagaaagggcagagcttcctccagcctcagacgcccaggtgggtgccgggtgctgtgtggctgctgggccatgtggtggtcaccagagggtgtggggacgctgggatcccaggccgaaaccagctcatccggaggaagaggcctcaggaaatgcccacgttaagttctgagaaagggacagtgcagagccgtgggaagccaggatcccagggaggcttcgtctggaaactgggtgctgggagaacgaacgggagcctgcccgcccttccctgcagtccctgtgggtggtgccactggtgccggtgacctgagagcctcgctgtctgtcctccgtccccccgaacagcatagaagtgtttcctgccctggcccgagacggcccacgactccggccctgttcaggtactgaggtaatgcatgttcaggctggaatatttgaatgctgtctagaggcacaagaaggaaatcaaagccacctgtggtcacattgcctcgagatggtttttgttgctactctggactattttttaggctcttcctccatgcacctattttaaagcacattcttccccatgatggagccatgcacctccgtgtcgcgatccatcgtcccaggccactcggtggcctctgaaacccggacccatgaggccacacggctgcctgagtggccccggagcagctggattttcagcgtgaaccgatgcagcctgtcgccctacagccccgcacccttgtttttggtggtgccctccctgtggaaagttaattcctgctttttgaaggtgtcttggcatcttctgcctttgctactgagcggtttcctgaaacagccctaagcgttcgcaaaggcgctttggtgcctgctgcgagcacctgttttctgactcggatgttcctttagaggaaggtgttttccagtgtcggccctgagagggcgttcagcaggcgcgtcctacccacgcggggctgaggtctctccttccagggaaggtccatcccggcagacgccagtggctttggctctgcagcgccaaggaggcggcgtggcgtcatgctccggggagcgcacaggtttccttccagtcggacaattaacttcagatccagcaggtttgacccaccctcacctgctgggacatgcgagtgctggtgtctggaaggagggccgggctgtgctgagctctggggggccggtccccacagctcccccgacagggcccccggggcctcctctataaatcaggggtccgtgctcccagcctgcttcgaggggtttctgcttggcgtgtgggttctaagtgcgagctgctgtgtgtggaggctcctgagcaccgggtgcccctcgcgcgtgtgggtcccggggcagcccagctgcacacaggatggtccgggggtgcgggtgggggcagagctgagcatggcgtgtacttggccacagaagtcttgctgtggtgccgctggacccctgctaggaggacagggtcccctctctcacgaagcacacggacctccagagtccctgcccctgcagtcctgggagcctgcagttggggctggagttggcctctcggagccacccaaacggagaggcccatgagaggggagctcaggggtccagcagaggctgacagagtggcctctttgtcctgttggcggcccctgctcatgcctggggcgtcctccctggagctgggggagctcagggacccccaggtctgtgtggctgcccctgccactccaggcacagcggcacggccctcactctttacctatttggaattggaggcaatgagtggcaagaacatgatgacagacacgggaggtaaaaatatgttcactggctgttccctttataaataagaagtggtgggacttgcgctgctatttttaaatagaccagagagtacactggagaaggcattgagtggttttattttaagtggtggaaaaaatgatgagaatctcctccagatgacagctccggaagtgtcgtgcctgaacccctctcacagtctggcgggcgcagagtctgtgagcggccaggaggccacctgctcgactggcccgtcctctccatgtgccagatgcagcccagcatgacactgccctcagctcaaaaacagcacagctactctgtgtgcaggaaaaaactgccagtgacttcaccaggatttgagaacggtccgtacgttcacactaagctgagacagcgcaggttagaagatagcgcggggaagtattcacacttcagatacgaccatcacggccacatggctaaggcccacaccctcccggggtgaaataactacagcagaagaatggggcgctaaccacctccacgggcattttaaataaaacccaaagttgttttgtttttttaagaaaaaaaaaaaaaaaaa

SEQ ID NO: 54901 - DNA, 4122 bp, Homo sapiens
acattgtagcaaaatggcgactgtcattcacaaccccctgaaagcgctcggggaccagttctacaaggaagccattgagcactgccggagttacaactcacggctgagtgcagagcgcagcgtgcgtcttcccttcctggactcacagactggggtggcccagaacaactgctacatctggatggagaagaggcaccgaggcccaggccttgccccgggccagctgtatacataccctgcccgctgctggcgcaagaagagacgattgcacccacctgaagatccaaaactgcggctgctggagataaaacctgaagtggagcttcccctgaagaaggatgggttcacctcagagagcaccacgctggaagccttgctccgtggcgagggggttgagaagaaggtggatgccagggaggaggaaagcatccaggaaatacagagggttttggaaaatgatgaaaatgtagaagaagggaatgaagaagaggatttggaagaggatattcccaagcgaaaggacaggactagaggacgggctcgctgccctctcccttccctgcactgtttttcctcccttccctctgccgtgatagatgctaaggagtggggtggaggtgggaagtgggaagcaacagtggcgtataggaaaaagaaaatataccccgtgcacattttcaacatgtagttgaagaagcctaaattaggtactagaaaaaaaaaaaggacagaaacactgcctgatatgtgagcaagagcatgaaaatatagaatgattatctcagagcagaggaggtggggagcaggtggctggagagaggcggggtaggtaggcagggcgtccctggctcaccaatgcgtctggtccacatggcatttgggaaagcagatgggtcatgcttttgcaatgaatggtcagatgcttagggggcatttgtgctcctctggccaggaaagggaacagagtccatccaagctgccccccactcatctgccatggttgtccaccctgggggtttttcctctgaaggaaaatgaacccatcttttgcctgccatgaatcattgcagggcaggctgttactggctaaattaaaacccttggcagggcatcgactgtgtgcgaggcaatgctctaggtcctgtaggggctggaaaataaaccgcatgctggcctagccttcaagttgcttttcagccatgaaactaagctctgccaagcaatcgtgattgtaggtcaagtatcgcgccatcacggaaggtgtaagtatatgtaggtttctctgttgaggatgcgtgttcctcagtagaagacaagcaggtggaggcatccagtgatttctaccctgtggaggctgaggggtcgggggaagaaaacagatgacctcagcctagttgctttaatctgcttttccaagcactggatgcccttggatgacagcatcctcagcattaaaactggtgaactgatgaagtcacctggcctggagtgtgttgggcagccagtgtccccagagctgcttgtgggtttctggggtggaaggcagggaggtgcaactggcagggcctgatcagaggcagaaaatgacccccacagtggtcttttccctgctagagaaagcagagagcgggactgggggggtgggggcttcaagtacagattgggcacactccaccagaccccagcaaggtcagctgccccacgcctgtatctggcactgctggtgtgtgcagggatgaaacccagcatcagagaggttttcagcaaaccttccatgctcacctttggccaggtgcttgtcagatcctagcttcgtgctggcttagactctcagttgtttgtgttgacagcattaggaataaaccgtttgtttcatctttccttttctccacacgtgtcacagccagatttcagctttgagttattccctgaagaagccacaccaaccttgctttcaagcaaaatgcctgggcttgggggaaggtgtgtatctgtccatgtgtggatgtcggctcagagctatagcttctctgtggggggtggcccaagggaaggctcctctggggccctggatggcacatgactcccagtgaggagaattcaggtgatctctgtggaggtagtcagggacacaaggcttggctgtgagtctggttttaaagtgcgtgacagcctgaaaagcatgcaggggtttggtccactcacctacttgaaagcctgtgggcaacgttcttttgagccaagacttctctgaatggccctgctggtggaaggggtgaggcaaaggcctctgacttggaccctttccacaccagactggcagcacttcccccaggcagccagtggtgggccctgagccctcaggtccccagctccttgagggatgaacctgggagcccaagagccagtggctgagctctgagaaggctccatctcccacctgcccttgagcgcgctctcaggctgagaacacggtctcatcaggcgccttcctggcctgatgctgtgctgtctacgtcacacggtcgattcacaaaagccagaactagacctcaaccaggtcatctccccgttgccaagtgggttcagggtgagggcaatttgtaagctcaatttctctgacagccaagacatggagcatctctgctaagaagccaaaagaaattggttttcttcttctcattgctgaagcccctctgtgtctcttctcagggacaggctggtccagtggctttggtgagggcgcctccatttgtgaacgctgggattcctctgggtgggctttggcaggtggctcctatggtaggaaggatgaccaggtccctgggaatgagctgcctacctgctgctccacgaggaagctcaggcctgcacaggctccaccaggccttggatgccctctagttgagtcagagaccctggaaacacactgagatctccaattgctgcctccattgatgtctctagacctgcagatacgaagcaaacctgggattgcttcttccaggtatgggcaccagagagggaggccactgcaacattttatccccatcattccaaaatgcttgcttgtctcttttacctcacactcacaactccttctgagactctcagtcataaaggaatgaccaagagagtgggtctccagtgagagaaatgcctatgaaagagggtttccctttttgctcttttgaacaccctccccactgatccttgggacccaacgccgcattgcctcttgcagatgaggttttgccttgggctgcttgggtacttcagaccaggactgagtctgacacagctttcatgaggttacagaaaagggctacagatttgggaagctgtgtgtaatggtcttgagacaatatctccatttggcccaccctggcttctctaaaaagcaacgacagcaacagacaaacaaaaagctcccacctcccaccccgttagctgtcctcctccttcactgtgatgtggttgcggtctctgtaggtgtgtgtgccacccttgtcctctgtcctctggggatgtgcccttcccacgtgtgtcaggttcccactctttcgtggttcctaacgtgaagtgctgtgatgtttctgccctgcctaaggaacgtatcaagctctctcagtgtttcagtgttggagattgaggctgtgccacatcttctgccatcctaaggggacatgatggttctgtgattcccagagagctggcagattgtgacaatctccaggagaacctacagattggaagcagcccacacctgatgtggactcctgtcccgggactcactcttcattcagaagactggtggcccacgtgccaggaccaccccacctctcttgctgccttttctcctgtcctgatggggttctgggagggagacctgtcgctgatgagatgaagaatgtggggatcgagcagccttcttctttgggacccctcgatatcccatggaatgctcgcacgttctcaaagactgagtcacaagcccctaccccttccttgctgtggttagtatcttgttctgtgattggttagcaatgttgactacccacgtagtgaatcttttgtctgcaatttagagaatgtgtaaacaaataaaaggctttaaaactc

SEQ ID NO: 54902 - DNA, 1789 bp, Homo sapiens
aggggctgaatacacagagcgctgagagagtggggcagtgtggtcacggacacaggtcatgggggccttggcaggagcggttttggcagagggtggggccggtgcctctggaaggtatgaagatgtaaatgaagccctgtccaggctatgggcatcaagacagcattgccggcggctgagctgggcctctactctctggtgctgagtggggccctggcctatgctggccggggcctccttgaggcttcacaagatggggcccacaggaaggccttccgggagtctgtgcgacctggctgggagtacattggccggaagatggatgtggctgacttcgagtgggtgatgtggttcacctcctttcgcaacgtcatcatctttgccctctccggacatgtgctgtttgctaaactctgcacgatggttgccccaaagctccgctcctggatgtatgctgtgtacggggccttggctgtgatgggcacaatgggcccttggtacctgctgctgctgcttggtcactgtgtgggcctctatgtggcctcgcttttgggccagccctggctctgtcttggccttggcttggccagcctggcctccttcaagatggaccccctaatctcttggcagagcgggtttgtaacaggcacttttgatcttcaagaggtgctgtttcatgggggcagcagcttcacagtgctgcgttgcgccagctttgcactggagagctgtgcccaccctgaccgccactactccttagctgacctgctcaagtacaacttctacctgcccttcttcttcttcgggccaatcatgacctttgatcgcttccatgctcaggtgagccaggtggagccagtgagacgcgagggtgagctgtggcacatccgagcccaggcaggcctaagcgtggtggccatcatggccgtcgacatcttctttcacttcttctacatcctcactatccccagcgacctcaagttcgccaaccgcctcccagacagtgccctcgctggcctagcctattcaaacctggtgtatgactgggtgaaggcggccgtcctctttggtgttgtcaacactgtggcatgcctcgaccacctggacccaccccagcctcccaagtgcatcaccgcactctacgtctttacggaaacgcactttgaccgtggcatcaacgactggctttgcaaatatgtgtataaccacattggtggggagcattccgctgtgatcccagagctggcagccacagtggccacatttgccatcaccacactgtggcttgggccttgtgacattgtctacctgtggtcattccttaactgctttggcctcaactttgagctctggatgcaaaaactggcagagtgggggcccctagcacgaattgaggcctctctgtcagtgcagatgtcccgtagggtccgggccctgtttggagccatgaacttctgggccatcatcatgtacaaccttgtgagcctgaacagcctcaaattcacagagctggttgcccggcgcctgctactcacagggtttccccagaccacgctgtccatcctgtttgtcacctactgtggcgtccagctggtaaaggagcgtgagcgaaccttggcactggaggaggagcagaagcaggacaaagagaagccggagtaggagggagcgggtagagggatgggctctgctcagctattcttgggccagatggggcctgaccgatagaataaaagacttttctacaacaaaaaaaaaaaaaaaaaaaaaaacaaaaaaaaaaaaaaaa

SEQ ID NO: 54903 - DNA, 2430 bp, Homo sapiens
ctccggagacagcctcagaggggtgtccagagccaggcagcaaggaccagaggaaggtggacagagaccgaaaggacaaaggagagacacagagaaaaaaagagaccaaccccaaagggacaaagaccccaacgtttgtccacattgccgcagaggcagctggagccagtgctgcctgtccgtccccatgggccaccataggccatggctgcacgcttctgtcctctgggctggggtggccagcctgctcctccccccggccatgacccagcagctcagaggggatgggctaggcttcagaaaccggaacaacagcactggagtcgccgggctctccgaggaggcatcagcagagcttcgccaccacctccacagccctagagaccatccagatgagaacaaggatgtttccacagagaatgggcatcatttctggagccacccagaccgtgaaaaggaggatgaagatgtctccaaggaatatgggcacctactcccaggccacaggtcccaagaccacaaagtcggagatgagggtgtctcaggtgaggaggtctttgcagagcatggtgggcaggcccgtgggcacagaggccacgggagtgaagacacggaagactcagctgagcacaggcaccacctccccagccacaggagccacagccatcaagacgaggatgaggatgaagttgtgtccagtgagcatcaccatcatatcctcaggcatggacaccgaggccatgatggggaagatgatgaaggagaagaggaggaggaggaggaggaggaggaagaggaggcctccactgagtatggacaccaggcccacaggcaccgaggccatgggagtgaagaggatgaggatgtctcagatggacaccatcatcatggccccagccacaggcaccaaggccatgaagaagatgacgatgatgatgatgatgatgatgatgatgatgatgatgatgatgtctccattgaatatagacaccaggctcacaggcaccaaggccacgggattgaagaggatgaagatgtctcagatggacaccatcatcgcgaccccagccacaggcaccgaagccatgaagaagatgacaatgatgatgatgatgtctccactgagtatggacaccaggcccacaggcaccaagaccacagaaaggaagaggttgaggctgtctcaggtgaacaccaccatcatgtccctgaccacaggcaccaaggccacagagacgaggaagaagatgaggatgtgtccactgaacgttggcaccagggtccccaacatgtccaccatggccttgtagatgaggaagaggaagaagaggagatcacagtccagttcggccactatgttgcaagccaccaacctcgaggccacaagagtgatgaagaggacttccaagatgagtataaaacagaagtccctcaccatcaccaccacagagtccccagggaggaagatgaggaggtctctgctgagcttggccaccaggcccccagccacaggcaaagccaccaagatgaagaaactggccatggtcaaagagggtccatcaaagagatgagccatcaccccccaggacacacagtggtcaaggatagaagccatttgaggaaggatgattctgaggaggaaaaggagaaggaagaggaccccggctcccatgaggaagacgatgaaagttcagagcagggagagaaaggcacccatcatggcagccgggaccaggaagatgaggaggatgaggaggaaggtcatggcctcagcctgaaccaggaggaggaagaagaggaagacaaggaggaggaggaggaggaagaagacgaggagaggagggaagagagggctgaggttggggccccactgagcccagaccacagcgaggaggaagaggaggaggaggaggggctggaggaagatgagccccgcttcaccatcatccccaacccactggacaggagagaggaggctggaggtgcctccagcgaggaggaaagcggtgaggacacaggtccacaggatgctcaggagtatgggaactaccagccagggtccctgtgtggctactgctccttctgcaatcgatgcactgaatgtgagagctgtcactgtgatgaggagaacatgggtgagcactgcgaccagtgccagcactgtcagttctgctatctctgcccgctggtctgcgaaacggtctgcgctccaggaagctacgttgactatttctcctcgtccctttatcaggccctggcagacatgctggaaacgccggaaccctgacccagtcgctcgactgcgacgcaggtgtacctccccctgccttccaacccctttccacgagctatatttatttctccgaataaacgtgctccccgaaaaaaaaaaaaaaaaaaaaaaaaaaaaaaaaaaaaaaaaaaaaaaaa

SEQ ID NO: 54904 - DNA, 2589 bp, Homo sapiens
caaggagcctgcacactgatggaggaggtacagccgtggaggagaaccagagtctggaggggaggcacagtcctcaggagcccccaggctgacaggggaaacaaaacacacaataaaccccaaacttgcaaggttctggggcaggcaccgaggtccgagtggcaaggagacaggatccagccctgtgcagtggtgaggaggcccctggggctgctgtgatcggcctggaatgtcaggctgtgagctcagccctctcggcctgcgtgtcgggctgtcagcagggccggtgcacgggagaagatttccagccccctctgggccatggacaggcctaaatttagctagtagacaaggggctggccccaagcccagggacagtcggccttataaagcggccgcagtcggagcctggcacgctcgcccagaggcctgcgcccacaccctctcctgtccagccttcgcccgcctgggcagggcccggcgccgtccgtggatgagccacagaacctcttccaccttccgagcggagagaagtttccattcctcttcttcttcctcctcctcttccacctcctcctcggcctcccgtgccctcccggcccaggacccgcccatggagaaggccctgagcatgttttccgatgactttggcagcttcatgcggccccactcggagcccctggccttcccagcccgccccggtggggcaggcaacatcaagaccctaggagacgcctatgagtttgcggtggacgtgagagacttctcacctgaagacatcattgtcaccacctccaacaaccacatcgaggtgcgggctgagaagctggcggctgacggcaccgtcatgaacaccttcgctcacaagtgccagctgccggaggacgtggacccgacgtcggtgacctcggctctgcgggaggacggcagcctcactatccgggcacggcgtcacccgcatacagaacacgtccagcagaccttccggacggagatcaaaatctgagtgcctctcccttccctttccctgtccccccgccccacgcctgccagcaaagcctcgctaaccccattacaacagctccaggacatctcagcccaggttctagcccccacgcaccccagaccccaggtggaccatcctcccaaactagggccctccactctatccagggcaggccagggactccctggcctgacacatgatgcccagatttcagatttggcctccgtcacttaatccagagtacaggggctggggtcagggaaggaagatctaaagaacccactgtgggtcaggggaatgggaccagcaggacatatgggcaagctctgcaggacagacaggcagacaaaccctctgatctatgaagtctctgcagggcaaggggaccagggacctggaaccctcttggccaaggggagtgggaacgacagagggaaggtcacaggcaagggtgcctatctaagtggaactaattgcccgagggctcagcaaggccaagaggagacagccgtgacggtaaacttcccctctaccagcctccaagccccacgccagcgagcaggctgcctgcccaccccgtgcccccagccagctggctgtgccagggcagagccatgccacatctgtatatagatggggtttttccaatacagctggttcgtgataaactgcatgaaactcctgccgtcctgcgcctgctggggcctccaggcaaggccacgtggggttgggggtggggctggtccttctccctcccacaggcctgtgttcttggggctgctcccatgcagacaggatcacctaacagagatggaagccagggcatggatggggctttgggtcctcgaggttggaccccagcttcttgccaccttcccctccgggcagtcagctctccatccatccccctctttaatctatgaatctataggctcggtgtgtgtaacacacacacccctatcgttgtccttcaaatactcagcattaccattggttgaggccaaattcagagctttctcaaatcagatttacaatctccattttcattaacggggaaacatccccgagccactgagtgctgtgctttgtcactgaaggttagatctgaacccagggtgtcaacagctgctctcaactccccacctctgggcactgaggagtatttcccctcattctacctctctaaggctatgcacccctccccacgtcttccagctgggggatggggggagtcataggaaaagcccccatctcccatctgggatagggaccttccatcagccttaaccctgggaaatgcctgctgcccccagtgactcttggtttcgtctcccacatacagaagcagggtggaggggaagggtgggtctcagttagcaggggtccccagggcaagtcagcctcctccctccatgcctctctggtcagtgtgccttagggtggcctctcactcccaccactctgggccccttgggggaggactggggagggggccgtgggagagccctgacgctggaacctgtatacacaataaaggacagtctcacagaaaaaaaaaaaaaaaaaaaaaaaaaaaaaaaaaa

SEQ ID NO: 54905 - DNA, 2628 bp, Homo sapiens
agacctcccgcaccagggctctggtgaacagcaaatgctccacgctgggacgggccattgcctgatgcctgtacatggtgggcactgagagacaagattcctgggccctgccttccatacactccccacgatctcggaggaagctctgaggaccccgctgagaacccacagacaggaggacaactgcgctatgacagcaataaaggccaagaaggagaaagttgaggaccgctgacagccccgtgtgctgttgggagctgccctttctacttcaaaccttcctctagcagactgtgcagggaccccccaccaccaccatctgccgccatggttgtgcaaaacagcgcagacgccggggacatgagggcaggcgtgcagctggagcccttcctgcaccaggtcggggggcacatgagcgtgatgaagtatgacgagcatacggtgtgcaagcccctcgtctcccgggagcagaggttctatgaatccctgccgctggccatgaagcggttcaccccacagtacaaaggtaccgtcacagtgcacctctggaaagacagcacaggccatctcagcttggttgccaacccagtgaaggagagccaggagcccttcaaggtctccacagagtcggcggcggtggccatatggcagacgctccagcagaccaccggcagcaatggcagcgactgcacccttgcccagtggccgcatgcccagctggcacgctcacccaaggagagcccggccaaggctcttctgaggtccgagccccacctcaacactccagccttctcgctggtggaagacaccaacggaaaccaggttgagaggaagagcttcaacccgtggggcctgcaatgccaccaggcccacctgacccgcctgtgctccgagtacccagagaacaagcggcatcggttcttgttgctggaaaatgtagtgtcacagtacacgcatccctgtgtcctggatctgaagatggggacccggcagcacggcgatgatgcatcggaggagaagaaggcccgccacatgaggaagtgtgcgcagagcacctcagcctgcctgggtgtgcgcatctgcggcatgcaggtttatcaaacagataagaagtactttctctgcaaagacaagtactatggaagaaaactctcagtggaggggttcagacaagccctctatcagttcctacataatggaagccacctccggagggagctcctggagcccatcctgcaccagctccgggccctcctctctgtcattaggagccagagttcataccgcttctattccagctctctccttgtcatctatgatgggcaggaaccaccagaaagagccccaggcagcccgcatcctcacgaggctccccaggcagcccacggtagctctcccggtggtctcaccaaggttgacatccgcatgattgactttgctcataccacatacaagggctactggaatgagcacaccacctacgatggaccagaccctggctatatttttggcctggaaaacctcatcaggatcctgcaggatatccaagagggagaatgaaacttcctgggcttatctggattcttctgggctatagatctcaaatagagacctgttggttgctagggtagtccagacaccccttagatgtcttcataatagtcctatctaccttcaaaaaccatctctatatatggcagactatattaacagctgctgaacaaatcagctctggaggtgattccacatcccctggcattatgctctaatgctgctcatcggagaacagacagccaggataaagtggcaccttctggagtacactggagggggcagcccaagttagaggccagcattgctgacattctggaatatttgcatctaaaaatgtttactcgttgccatgctgcagtccgcacaagctgtgaggcagaaaacttgacttgaagcagccttgaagagtgagttcatgagctcatggtttttctccttgtatggactgctcgctccaagggcaggcagagctcatgaatgcctcttatcttcctaagcggagttttaggtgacacaggatgaagcagaagagatctacccatctcatctgctctgcacccagcttctaagtggacaaagccaagcccaggcatgagctctggcaaagcaagaccccagattctccatttttgcctgtggaaaggagggtccctttacaggcttttttttcctttttttcccccaaaatctcttaaaatgaggaatctcttagcagactttggagttccccattctgccacattctgaccatgagacgcggcttgcagtgggggtgaacgcacataaaaagggaccactgacgtcctgctctactctctgctttctatttatttattttgggggtgggttggggagtcagaagaacctggaggacggaggaaaccaggggcaatgtttacaagactggtggacaagtgtaaatatggaataagaacaaacagttctaattaattccttcttctgcagtatggaaacctattacgatgcccttgagtcaagcactgagatacgttacccaattagggaaataaatttgttaataaaattgctgaggtcaccaaaaaaaaaaaaaaa

SEQ ID NO: 54906 - DNA, 775 bp, Homo sapiens
ccggagcgcactgcgtggtcgcaccctacccgggctgccttggaagtcgtccccgccgcccctccgcaccggcatgaagctcatcgtgggcatcggaggcatgaccaacggcggcaagaccacgctgaccaacagcctgctcagagccctgcccaactgctgcgtgatccatcaggatgacttcttcaagccccaagaccaaatagcagttggggaagacggcttcaaacagtgggacgtgctggagtctctggacatggaggccatgctggacaccgtgcaggcctggctgagcagcccgcagaagtttgcccgtgcccacggggtcagcgtccagccagaggcctcggacacccacatcctcctcctggaaggcttcctgctctacagctacaagccccagaagtataggcaggagatggaggccaacggtgtggaagtggtctacctggacggcatgaagtcccgagaggagctcttccgtgaagtcctggaagacattcagaactcgctgctgaaccgctcccaggaatcagccccctccccggctcgcccagccaggacacagggacccggacgcggatgcggccacagaacggccaggcctgcagcgtcccagcaggacagcatgtgagcgtttccctatgggggtgtctgtacgtaggagagtggaggccccactcccagttgggcgtcccggagctcagggactgagccccgggcggcctctgtaacctcgctgcagcttcagtagcaaactgggtcctattttttt

SEQ ID NO: 54907 - DNA, 1134 bp, Homo sapiens
aatcatcttgttggccctgacctcgttggaaaacgaagctccccgcagggtcccggcctctagggctgctgtgcgggcgggggtggcctggagctatttccattcggcggcgggaacaggtgccggcgcctccgccccatccccaggggccgcctcccccggggcggcctccaggctgccgagacctataaaggcgccaggttttctcaatgaagccgggacgcactccggagcgcactgcgtggtcgcaccctacccgggctgccttggaagtcgtccccgccgcccctccgcaccggcatgaagctcatcgtgggcatcggaggcatgaccaacggcggcaagaccacgctgaccaacagcctgctcagagccctgcccaactgctgcgtgatccatcaggatgacttcttcaagccccaagaccaaatagcagttggggaagacggcttcaaacagtgggacgtgctggagtctctggacatggaggccatgctggacaccgtgcaggcctggctgagcagcccgcagaagtttgcccgtgcccacggggtcagcgtccagccagaggcctcggacacccacatcctcctcctggaaggcttcctgctctacagctacaagcccctggtggacttgtacagccgccggtacttcctgaccgtcccgtatgaagagtgcaagtggaggagaagtacccgcaactacacagtccctgatccccccggcctcttcgatggccacgtgtggcccatgtaccagaagtataggcaggagatggaggccaacggtgtggaagtggtctacctggacggcatgaagtcccgagaggagctcttccgtgaagtcctggaagacattcagaactcgctgctgaaccgctcccaggaatcagccccctccccggctcgcccagccaggacacagggacccggacgcggatgcggccacagaacggccaggcctgcagcgtcccagcaggacagcatgtgagcgtttccctatgggggtgtctgtacgtaggagagtggaggccccactcccagttgggcgtcccggagctcagggactgagccccaagacgcctctgtaacctcgctgcagcttcagtagtaaactgggtcctgttttttt

SEQ ID NO: 54908 - DNA, 4860 bp, Homo sapiens
cctgttagcgcacaggcacgggaggcttcttccggctcggccgtgctgctcagcgggtgtaaacagcctctgcggtgtaaacagcctctgcggtgtaaacagccgcggcgggcaggccaggactgtcagtgcccgcccctcggggcaggtaatttcatgctcccaaaatgggacataaagtggttgtcttcgacatttctgtcatcagagccttgtgggaaactcgtgtcaagaagcacaaagcttggcagaagaaggaggtggaaaggcttgagaagagcgccttggagaagataaaggaggagtggaactttgtggccgaatgcaggaggaagggcatcccccaggctgtatactgcaagaatggcttcatagacaccagcgtgcggcttctggacaagattgaaaggaacactctcacaaggcagagttcacttcccaaggacagaggcaaacggagcagtgcgtttgtgtttgaactttctggggagcactggacggagctcccagattcattgaaggagcagacacacctgagagaatggtacataagcaataccttgattcaaatcattcctacatatattcagttatttcaagagatgagaattctggatctgccaaaaaaccaaatctcacatcttccagcagaaatcggttgtttgaagaacctgaaagaactcaatgtgggtttcaactatctgaagagcattcctccagaattgggagattgtgaaaatctagagagactggattgttctggaaatctagaattaatggagctgccctttgaattaagtaatttgaagcaagttacatttgtagatatctcagcaaacaagttttccagtgtcccaatctgtgtcctgcggatgtcgaatttgcagtggttggatatcagcagcaataacctgaccgacctgccgcaagatatagacaggctagaggagctgcagagctttctcttgtataaaaacaagttgacctaccttccctattccatgctgaacctgaagaagctcactctgttagtcgtcagtggggaccatttggtggagctcccaactgccctttgtgactcatccacacctttaaaatttgtaagccttatggacaatcctattgataatgcccaatgtgaagatggcaatgaaataatggaaagtgaacgggatcgccaacattttgataaagaagttatgaaagcctatattgaagaccttaaagaaagagaatctgttcccagctataccaccaaagtgtcttttagccttcaactttgatatccatcagaagactgcaaatctcactattctctggagctatatataaatctttgttatgatcatgtcatataggaagaatggcttgtgcttaaggacaaagtctagaaaccactatcatagttgctaaaaaaaatggttttcaaatgtcaaatacatgagtatctccctccatggactggagaattgaaaaattggtttgtatattgatatttccaggttcatttgcatatacttttttccaaataatgcacatttaatatgttttaaaatgtcttatttttaagaattataactaaaagaccaaatactgaagttaagtgcattgttttcaggaatcaaaagataaaggggccgggtgtggtggctcacacctgtaatcccagcactttgggaggccgaagtgggtggatcacctgaggtccggagttcgaggctggtttggccagcatggcgaaaccccatctctactaaaaatacaaaaaattagctgggcatggtggcagttgcctgtaatcctagctactcaggaggctgaggcaggagaatcgcttgaacctgggaggtggagttgcagtgagccgagatcatgggactgcactccagcctgggtgacagagccagactctgtctcaaaaaaaaaaaaaaagaaaagaaaaagataaagggattgtgaaaagagcatttatattggactaatcagatgagagtgttttgttattttgaaagagtttcttttactgagaataatcttccttgagtttatataaactgctatttccatatgttttaagttatattttggcaagtgtagactcccaggagagacttgtaggtacaatctaggccttgaagaaacaaaggctggaatatctgcccatgctttgggcatgagatgctcagatggtgcgtgggtagatctagttgaggaagtgtgggcctggctgttcatgggaagtcttcagtggccttcatggatggccatccagtcctgagtggtcaccctgggggtcctgggacacacctcagtaaagagcaaaggcaacgccctcagggtcccttcctccaagatggccatgtagggtaatggagatgaccagtccacactgataaggagttcctagcaaggcttccttgtgggtaccacaggacaactctgcccatagcaaagatgcttcagtccagagggagcccatgggctgtttgaatttgggagaggtgggattcattacaagactttgggctcttatgtcacatcacatgatttggagaaattagacacaatctcttatttttataccactgtcttgggctaaaataaacaggttgtggctgatggtgttgaagataaataagcttaaacaaataactttggccgggcacggtggctcacacctataatcccagcactatgggaggctgaggcaagcaggttgtttgagcccaggaatttgagaacaggattttgagaacagcttggacatcatgacgaaaccccatctccacaaaaaaattcaaaaaattagccaggtgtggtggcatgtgcctgtggtcccagctactcaggaggctgaggtgggaaaatcacttgagcccaggaggtcgaggctgcagtgtgctgtgattgtgacactgccctccagcctgggtgacagagtgagaccctgtctcaaaagcaaaacaaacagcaataacaatattattattgttataactaaaaaaaaaaaaacaaaaacaagcagcttttgtgactaagaaggaaaatatgcatatagtggcatatttttatatgaatcatctcctctgtggtcttgcccagtaccatccagtggagctttctgcagtgacggaaatgttctgtatttgcgttgtccaacgtggtaaaccagacacatgtgattcttgagcacttgaacaatgactgatgtgattgaagaacccatctttcaattcaattaaatttaaatagccacatttaactccagccttgggtttgacctgatggaaaattcccatgagagagtgctccaaaccgttccaaggtggggccagttgcgattctaaaggaagaagcactaaatggcagggtgatcagtccaaagcatttatgaggggagcttacatacagcatgggctgcagcgtccttgtgatgggcagtgagacaagggatgttctacctgggcatgtccccagcgagggggttgggggatggagttcacatgaagatgtaaggaatttgggtgggggctgggctggcttctacatgtttagcaacacggctgatctttcagtgtttccagcaacaacctaagcaccgttatcagtgcctaggaatgttcaaggcccaggctggggttcagacctgcagaggaaaacatcagctggctgggtcaaggcaccatgtgttacttggtcaggacagagacaaaaatgaggaaaactaggggaccccacacacatgtggctaccatactcctgaacaggtctagctagttatttgtttttttggaagttaatctggggtagaaatgtatggtgatttttattttctctgtctgaagaaccagccatttttaaaaaggttattattgacatcccaatattttgtcttggtgggcttactcataagtccaaacattttattctcaacaggtgtaaaacaggcagagcattctaaaaccacatggtagtgctttggtggaggactgcttccacttagaaacaaactctgagaagtaggctaagagaagacaagagggccgggcgcggtgactcacgcctataatcccagcactttgggaggccgagatgggtgaatcatgaggtcaggagttcgagaccagcctaaacaacatagtgaaaccctgtctctattaaaaatgcaaaaaattagccgggcgtggtgggcacccgtaatcccagctactcaggaggctgaggcaggagaattgcttgaacccaggaagcagaggttgcagtaagctgagatcccaccattgcactccagcctgggcaacagagtgagactccatctcaaaaaaaaaaagagagagagatgaaaagagtaggaaaatgagaaatcaccttcgttgaatcttaaatagttacatttttttctttttaacactaaaaatacaattcaaatttattagctctactacttgaatgattttggaattttatgtcatgctaaggtatgtgttacatatggccaagtggaaaatatatctgaagaggggctttcatacaaatagactgttcataatttatgtaaattttattttaataaaatcagttttttgtttaaaaaccttgtttcactgtcacatatgaaaaaaatactgcattgatatataattatttcatgttacataataacccaaaacaaataattacttgaatatgtttgtagagatactatttaatttattcatataaatgtgcagaaagattccaaaggagaatatatatcttgtgaaaatatggagatttgaaaatttgacatgatgcaaatagactgatacataatttggaaaggttctttacatggcagaatacatgtatgaatattaaagt

SEQ ID NO: 54909 - DNA, 934 bp, Homo sapiens
ctctctggctgctccggcatatttgagaaggtctgtttccctggtccttctgggtttccaccaattggcaagaagggatcagcctgtcctagagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggccagaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccaggtgcctggcccttggctttagccataccagggtgagttaaagagaggccccggctgggtgagctgagatggagtcctcgacttatcaccacaccactgccccaaggaccttacaggccctccctgttaataaacagctctaacacggccaggctgggctctgggattctgaaaaaaaaaaaaaaaaaaaaaaaaaaa

SEQ ID NO: 54910 - DNA, 855 bp, Homo sapiens
atctcatctcccagacgccacgtctctcggtttcttcttagatcactcctctgccaaagatcccaacaagacaacatggctcccaagaagcctgagcctaagaaggaggcagccaagccagctccagctccagctccagcccctgcaccagcccctgccccagctcctgaggctcccaaggaacctgcctttgaccccaagagtgtaaagatagacttcactgccgaccagattgaagagttcaaagaggccttttcattgtttgaccggaccccgactggagagatgaagatcacctacggccagtgcggggatgtactgcgggccctgggccagaaccctaccaatgccgaggtgctgcgtgtgctgggcaagcccaagcctgaagagatgaatgtcaagatgctggactttgagacgttcttgcccatcctgcagcacatttcccgcaacaaggagcagggcacctatgaggacttcgtggagggcctgcgtgtctttgacaaggagagcaatggcacggtcatgggtgctgagcttcggcacgtccttgccaccctgggagagaagatgactgaggctgaagtggagcagctgttagctgggcaagaggatgccaatggctgcatcaattatgaagcctttgtcaagcacatcatgtcagggtgaagcagagtcttccaggtgcctggcccttggctttagccataccagggtgagttaaagagaggccccggctgggtgagctgagatggagtcctcgacttatcaccacaccactgccccaaggaccttacaggccctccctgttaataaacagctctaacacggccaggctgggctctgggattctga

SEQ ID NO: 54911 - DNA, 8996 bp, Homo sapiens
gagggaaacacaaaacgaagagcggcccactcccagcttacgccgatggtgagcccacctctcctgatcattagcgttgctggcacaattgaatgcaagccagatcatctcttatggagacccggcagtacctcacctcagtctgtgagttttctccatgggaaggttgtgatggagtctctgggccctccgaaccaccacagccagtcgactctgaggccccctctcccaccccctcacaaccacacgctgtcccatcaccactcgtccgccaactccctcaacaggaactcactgaccaatcggcggagtcagatccacgccccggccccagcgcccaatgacctggccaccacaccagagtccgttcagcttcaggacagctgggtgctaaacagcaacgtgccactggagacccggcacttcctcttcaagacctcctcggggagcacacccttgttcagcagctcttccccgggataccctttgacctcaggaacggtttacacgcccccgccccgcctgctgcccaggaatactttctccaggaaggctttcaagctgaagaagccctccaaatactgcagctggaaatgtgctgccctctccgccattgccgcggccctcctcttggctattttgctggcgtatttcatagtgccctggtcgttgaaaaacagcagcatagacagtggtgaagcagaagttggtcggcgggtaacacaagaagtcccaccaggggtgttttggaggtcacaaattcacatcagtcagccccagttcttaaagttcaacatctccctcgggaaggacgctctctttggtgtttacataagaagaggacttccaccatctcatgcccagtatgacttcatggaacgtctggacgggaaggagaagtggagtgtggttgagtctcccagggaacgccggagcatacagaccttggttcagaatgaagccgtgtttgtgcagtacctggatgtgggcctgtggcatctggccttctacaatgatggaaaagacaaagagatggtttccttcaatactgttgtcctagattcagtgcaggactgtccacgtaactgccatgggaatggtgaatgtgtgtccggggtgtgtcactgtttcccaggatttctaggagcagactgtgctaaagctgcctgccctgtcctgtgcagtgggaatggacaatattctaaagggacgtgccagtgctacagcggctggaaaggtgcagagtgcgacgtgcccatgaatcagtgcatcgatccttcctgcgggggccacggctcctgcattgatgggaactgtgtctgctctgctggctacaaaggcgagcactgtgaggaagttgattgcttggatcccacctgctccagccacggagtctgtgtgaatggagaatgcctgtgcagccctggctggggtggtctgaactgtgagctggcgagggtccagtgcccagaccagtgcagtgggcatggcacgtacctgcctgacacgggcctctgcagctgcgatcccaactggatgggtcccgactgctctgttgaagtgtgctcagtagactgtggcactcacggcgtctgcatcgggggagcctgccgctgtgaagagggctggacaggcgcagcgtgtgaccagcgcgtgtgccacccccgctgcattgagcacgggacctgtaaagatggcaaatgtgaatgccgagagggctggaatggtgaacactgcaccattggtaggcaaacggcaggcaccgaaacagatggctgccctgacttgtgcaacggtaacgggagatgcacactgggtcagaacagctggcagtgtgtctgccagaccggctggagagggcccggatgcaacgttgccatggaaacttcctgtgctgataacaaggataatgagggagatggcctggtggattgtttggaccctgactgctgcctgcagtcagcctgtcagaacagcctgctctgccgggggtcccgggacccactggacatcattcagcagggccagacggattggcccgcagtgaagtccttctatgaccgtatcaagctcttggcaggcaaggatagcacccacatcattcctggagagaaccctttcaacagcagcttggtttctctcatccgaggccaagtagtaactacagatggaactcccctggtcggtgtgaacgtgtcttttgtcaagtacccaaaatacggctacaccatcacccgccaggatggcacgttcgacctgatcgcaaatggaggtgcttccttgactctacactttgagcgagccccgttcatgagccaggagcgcactgtgtggctgccgtggaacagcttttacgccatggacaccctggtgatgaagaccgaggagaactccatccccagctgtgacctcagtggctttgtccggcctgatccaatcatcatctcctccccactgtccaccttctttagtgctgcccctgggcagaatcccatcgtgcctgagacccaggttcttcatgaagaaatcgagctccctggttccaatgtgaaacttcgctatctgagctctagaactgcagggtacaagtcactgctgaagatcaccatgacccagtccacagtgcccctgaacctcattagggttcacctgatggtggctgtcgaggggcatctcttccagaagtcattccaggcttctcccaacctggcctacaccttcatctgggacaagacagatgcgtatggccaaagggtgtatggactctcagatgctgttgtgtctgtcgggtttgaatatgagacctgtcccagtctaattctctgggagaaaaggacagccctccttcagggattcgagctggacccctccaacctcggtggctggtccctagacaaacaccacatcctcaatgttaaaagtggaatcctacacaaaggcactggggaaaaccagttcctgacccagcagcctgccatcatcaccagcatcatgggcaatggtcgccgccggagcatttcctgtcccagctgcaacggccttgctgaaggcaacaagctgctggccccagtggctctggctgttggaatcgatgggagcctctatgtgggtgacttcaattacatccgacgcatctttccctctcgaaatgtgaccagcatcttggagttacgcaacaacccagcacacaagtactacttggcagtggaccccgtgtccggctcgctctacgtgtccgacaccaacagcaggagaatctaccgcgtcaagtctctgagtggaaccaaagacctggctgggaattcggaagttgtggcagggacgggagagcagtgtctaccctttgatgaagcccgctgcggggatggagggaaggccatagatgcaaccctgatgagcccgagaggtattgcagtagacaagaatgggctcatgtactttgtcgatgccaccatgatccggaaggttgaccagaatggaatcatctccaccctgctgggctccaatgacctcactgccgtccggccgctgagctgtgattccagcatggatgtagcccaggttcgtctggagtggccaacagaccttgctgtcaatcccatggataactccttgtatgttctagagaacaatgtcatccttcgaatcaccgagaaccaccaagtcagcatcattgcgggacgccccatgcactgccaagttcctggcattgactactcactcagcaaactagccattcactctgccctggagtcagccagtgccattgccatttctcacactggggtcctctacatcactgagacagatgagaagaagattaaccgtctacgccaggtaacaaccaacggggagatctgccttttagctggggcagcctcggactgcgactgcaaaaacgatgtcaattgcaactgctattcaggagatgatgcctacgcgactgatgccatcttgaattccccatcatccttagctgtagctccagatggtaccatttacattgcagaccttggaaatattcggatcagggcggtcagcaagaacaagcctgttcttaatgccttcaaccagtatgaggctgcatcccccggagagcaggagttatatgttttcaacgctgatggcatccaccaatacactgtgagcctggtgacaggggagtacttgtacaatttcacatatagtactgacaatgatgtcactgaattgattgacaataatgggaattccctgaagatccgtcgggacagcagtggcatgccccgtcacctgctcatgcctgacaaccagatcatcaccctcaccgtgggcaccaatggaggcctcaaagtcgtgtccacacagaacctggagcttggtctcatgacctatgatggcaacactgggctcctggccaccaagagcgatgaaacaggatggacgactttctatgactatgaccacgaaggccgcctgaccaacgtgacgcgccccacgggggtggtaaccagtctgcaccgggaaatggagaaatctattaccattgacattgagaactccaaccgtgatgatgacgtcactgtcatcaccaacctctcttcagtagaggcctcctacacagtggtacaagatcaagttcggaacagctaccagctctgtaataatggtaccctgagggtgatgtatgctaatgggatgggtatcagcttccacagcgagccccatgtcctagcgggcaccatcacccccaccattggacgctgcaacatctccctgcctatggagaatggcttaaactccattgagtggcgcctaagaaaggaacagattaaaggcaaagtcaccatctttggcaggaagctccgggtccatggaagaaatctcttgtccattgactatgatcgaaatattcggactgaaaagatctatgatgaccaccggaagttcaccctgaggatcatttatgaccaggtgggccgccccttcctctggctgcccagcagcgggctggcagctgtcaacgtgtcatacttcttcaatgggcgcctggctgggcttcagcgtggggccatgagcgagaggacagacatcgacaagcaaggccgcatcgtgtcccgcatgttcgctgacgggaaagtgtggagctactcctaccttgacaagtccatggtcctcctgcttcagagccaacgtcagtatatatttgagtatgactcctctgaccgcctccttgccgtcaccatgcccagcgtggcccggcacagcatgtccacacacacctccatcggctacatccgtaatatttacaacccgcctgaaagcaatgcttcggtcatctttgactacagtgatgacggccgcatcctgaagacctcctttttgggcaccggacgccaggtgttctacaagtatgggaaactctccaagttatcagagattgtctacgacagtaccgccgtcaccttcgggtatgacgagaccactggtgtcttgaagatggtcaacctccaaagtgggggcttctcctgcaccatcaggtaccggaagattggccccctggtggacaagcagatctacaggttctccgaggaaggcatggtcaatgccaggtttgactacacctatcatgacaacagcttccgcatcgcaagcatcaagcccgtcataagtgagactcccctccccgttgacctctaccgctatgatgagatttctggcaaggtggaacactttggtaagtttggagtcatctattatgacatcaaccagatcatcaccactgccgtgatgaccctcagcaaacacttcgacacccatgggcggatcaaggaggtccagtatgagatgttccggtccctcatgtactggatgacggtgcaatatgacagcatgggcagggtgatcaagagggagctaaaactggggccctatgccaataccacgaagtacacctatgactacgatggggacgggcagctccagagcgtggccgtcaatgaccgcccgacctggcgctacagctatgaccttaatgggaatctccacttactgaacccaggcaacagtgtgcgcctcatgcccttgcgctatgacctccgggatcggataaccagactcggggatgtgcagtacaaaattgacgacgatggctatctgtgccagagagggtctgacatcttcgaatacaattccaagggcctcctaacaagagcctacaacaaggccagcgggtggagtgtccagtaccgctatgatggcgtaggacggcgggcttcctacaagaccaacctgggccaccacctgcagtacttctactctgacctccacaacccgacgcgcatcacccatgtctacaatcactccaactcggagattacctcactgtactacgacctccagggccacctctttgccatggagagcagcagtggggaggagtactatgttgcctctgataacacagggactcctctggctgtgttcagcatcaacggcctcatgatcaaacagctgcagtacacggcctatggggagatttattatgactccaaccccgacttccagatggtcattggcttccatgggggactctatgaccccctgaccaagctggtccacttcactcagcgtgattatgatgtgctggcaggacgatggacctccccagactataccatgtggaaaaacgtgggcaaggagccggccccctttaacctgtatatgttcaagagcaacaatcctctcagcagtgagctagatttgaagaactacgtgacagatgtgaaaagctggcttgtgatgtttggatttcagcttagcaacatcattcctggcttcccgagagccaaaatgtatttcgtgcctcctccctatgaattgtcagagagtcaagcaagtgagaatggacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaacaaaataatctgctgccattccttgtctgaatggctcagcaggagtaactgttatctcctctcctaaggagatgaagacctaacaggggcactgcggctgggctgctttaggagaccaagtggcaagaaagctcacattttttgagttcaaatgctactgtccaagcgagaagtccctcatcctgaagtagactaaagcccggctgaaaattccgaggaaaacaaaacaaacgaatgaatgaacagacacacacaatgttccaagttcccctaaaatatgacccacttgttctgggtctacgcagaaaagagacgcaaagtgtccaaaaggaacaaaagaacaaaaacgaataagcaaagaagaaaacaaacaaaaacaaaacaaaacaaacacacggaccaataaacaaagaagcgaagataagaaagaaggcctcatatccaattacctcactcattcacatgtgagcgacacgcagacatccgcgagggccagcgtcaccagaccagctgcgggacaaaccactcagactgcttgtaggacaaatacttctgacattttcgtttaagcaaatacaggtgcatttaaaacacgactttgggggtgatttgtgtgtagcgcctggggaggggggataaaagaggaggagtgagcactggaaatactttttaaagaaaaaaaaacatgagggaataaaagaaattcctatcaaaaatcaaagtgaaataataccatccagcacttaactctcaggtcccaactaagtctggcctgagctaatttatttgagcgcagagtgtaaaatttaattcaaaatggtggctataatcactacagataaatttcatactcttttgtctttggagattccattgtggacagtaatacgcagttacagggtgtagtctgtttagattccgtagttcgtgggtatcagtttcggtagaggtgcagcatcgtgacacttttgctaacaggtaccacttctgatcaccctgtacatacatgagccgaaaggcacaatcactgtttcagatttaaaattattagtgtgtttgtttggtccagaaactgagacaatcacatgacagtcaccacgaggagagaaaatttaaaaaataaaaataaaaacaaaaaaaattttaaaaattaaaaaaacaaaaataaagtctaataagaactttggtacaggaacttttttgtaatatacatgtatgaattgttcatcgagtttttatattaattttaatttgctgctaagcaaagactagggacaggcaaagataatttatggcaaagtgtttaaattgtttatacataaataaagtctctaaaactcctg

SEQ ID NO: 54912 - DNA, 8657 bp, Homo sapiens
tctgtagttagagggaaacacaaaacgaagagcggcccactcccagcttacgccgatggtgagcccacctctcctgatcattagcgttgctggcacaattgaatgcaagccagatcatctcttatggagacccggcagtacctcacctcagtctgtgagttttctccatgggaaggttgtgatggagtctctgggccctccgaaccaccacagccagtcgactctgaggccccctctcccaccccctcacaaccacacgctgtcccatcaccactcgtccgccaactccctcaacaggaactcactgaccaatcggcggagtcagatccacgccccggccccagcgcccaatgacctggccaccacaccagagtccgttcagcttcaggacagctgggtgctaaacagcaacgtgccactggagacccggcacttcctcttcaagacctcctcggggagcacacccttgttcagcagctcttccccgggataccctttgacctcaggaacggtttacacgcccccgccccgcctgctgcccaggaatactttctccaggaaggctttcaagctgaagaagccctccaaatactgcagctggaaatgtgctgccctctccgccattgccgcggccctcctcttggctattttgctggcgtatttcatagcaatgcatctgctcggactcaattggcaactccagcctgcagatgggcacacctttaacaatgggataaggaccggcttaccaggaaacgatgatgtggcaacaatgccatctggaggcaaagtgccctggtcgttgaaaaacagcagcatagacagtggtgaagcagaagttggtcggcgggtaacacaagaagtcccaccaggggtgttttggaggtcacaaattcacatcagtcagccccagttcttaaagttcaacatctccctcgggaaggacgctctctttggtgtttacataagaagaggacttccaccatctcatgcccagtatgacttcatggaacgtctggacgggaaggagaagtggagtgtggttgagtctcccagggaacgccggagcatacagaccttggttcagaatgaagccgtgtttgtgcagtacctggatgtgggcctgtggcatctggccttctacaatgatggaaaagacaaagagatggtttccttcaatactgttgtcctgacacgggcctctgcagctgcgatcccaactggatgggtcccgactgctctgttgaagtgtgctcagtagactgtggcactcacggcgtctgcatcgggggagcctgccgctgtgaagagggctggacaggcgcagcgtgtgaccagcgcgtgtgccacccccgctgcattgagcacgggacctgtaaagatggcaaatgtgaatgccgagagggctggaatggtgaacactgcaccattgatggctgccctgacttgtgcaacggtaacgggagatgcacactgggtcagaacagctggcagtgtgtctgccagaccggctggagagggcccggatgcaacgttgccatggaaacttcctgtgctgataacaaggataatgagggagatggcctggtggattgtttggaccctgactgctgcctgcagtcagcctgtcagaacagcctgctctgccgggggtcccgggacccactggacatcattcagcagggccagacggattggcccgcagtgaagtccttctatgaccgtatcaagctcttggcaggcaaggatagcacccacatcattcctggagagaaccctttcaacagcagcttggtttctctcatccgaggccaagtagtaactacagatggaactcccctggtcggtgtgaacgtgtcttttgtcaagtacccaaaatacggctacaccatcacccgccaggatggcacgttcgacctgatcgcaaatggaggtgcttccttgactctacactttgagcgagccccgttcatgagccaggagcgcactgtgtggctgccgtggaacagcttttacgccatggacaccctggtgatgaagaccgaggagaactccatccccagctgtgacctcagtggctttgtccggcctgatccaatcatcatctcctccccactgtccaccttctttagtgctgcccctgggcagaatcccatcgtgcctgagacccaggttcttcatgaagaaatcgagctccctggttccaatgtgaaacttcgctatctgagctctagaactgcagggtacaagtcactgctgaagatcaccatgacccagtccacagtgcccctgaacctcattagggttcacctgatggtggctgtcgaggggcatctcttccagaagtcattccaggcttctcccaacctggcctacaccttcatctgggacaagacagatgcgtatggccaaagggtgtatggactctcagatgctgttgtgtctgtcgggtttgaatatgagacctgtcccagtctaattctctgggagaaaaggacagccctccttcagggattcgagctggacccctccaacctcggtggctggtccctagacaaacaccacatcctcaatgttaaaagtggaatcctacacaaaggcactggggaaaaccagttcctgacccagcagcctgccatcatcaccagcatcatgggcaatggtcgccgccggagcatttcctgtcccagctgcaacggccttgctgaaggcaacaagctgctggccccagtggctctggctgttggaatcgatgggagcctctatgtgggtgacttcaattacatccgacgcatctttccctctcgaaatgtgaccagcatcttggagttacgcaacaacccagcacacaagtactacttggcagtggaccccgtgtccggctcgctctacgtgtccgacaccaacagcaggagaatctaccgcgtcaagtctctgagtggaaccaaagacctggctgggaattcggaagttgtggcagggacgggagagcagtgtctaccctttgatgaagcccgctgcggggatggagggaaggccatagatgcaaccctgatgagcccgagaggtattgcagtagacaagaatgggctcatgtactttgtcgatgccaccatgatccggaaggttgaccagaatggaatcatctccaccctgctgggctccaatgacctcactgccgtccggccgctgagctgtgattccagcatggatgtagcccaggttcgtctggagtggccaacagaccttgctgtcaatcccatggataactccttgtatgttctagagaacaatgtcatccttcgaatcaccgagaaccaccaagtcagcatcattgcgggacgccccatgcactgccaagttcctggcattgactactcactcagcaaactagccattcactctgccctggagtcagccagtgccattgccatttctcacactggggtcctctacatcactgagacagatgagaagaagattaaccgtctacgccaggtaacaaccaacggggagatctgccttttagctggggcagcctcggactgcgactgcaaaaacgatgtcaattgcaactgctattcaggagatgatgcctacgcgactgatgccatcttgaattccccatcatccttagctgtagctccagatggtaccatttacattgcagaccttggaaatattcggatcagggcggtcagcaagaacaagcctgttcttaatgccttcaaccagtatgaggctgcatcccccggagagcaggagttatatgttttcaacgctgatggcatccaccaatacactgtgagcctggtgacaggggagtacttgtacaatttcacatatagtactgacaatgatgtcactgaattgattgacaataatgggaattccctgaagatccgtcgggacagcagtggcatgccccgtcacctgctcatgcctgacaaccagatcatcaccctcaccgtgggcaccaatggaggcctcaaagtcgtgtccacacagaacctggagcttggtctcatgacctatgatggcaacactgggctcctggccaccaagagcgatgaaacaggatggacgactttctatgactatgaccacgaaggccgcctgaccaacgtgacgcgccccacgggggtggtaaccagtctgcaccgggaaatggagaaatctattaccattgacattgagaactccaaccgtgatgatgacgtcactgtcatcaccaacctctcttcagtagaggcctcctacacagtggtacaagatcaagttcggaacagctaccagctctgtaataatggtaccctgagggtgatgtatgctaatgggatgggtatcagcttccacagcgagccccatgtcctagcgggcaccatcacccccaccattggacgctgcaacatctccctgcctatggagaatggcttaaactccattgagtggcgcctaagaaaggaacagattaaaggcaaagtcaccatctttggcaggaagctccgggtccatggaagaaatctcttgtccattgactatgatcgaaatattcggactgaaaagatctatgatgaccaccggaagttcaccctgaggatcatttatgaccaggtgggccgccccttcctctggctgcccagcagcgggctggcagctgtcaacgtgtcatacttcttcaatgggcgcctggctgggcttcagcgtggggccatgagcgagaggacagacatcgacaagcaaggccgcatcgtgtcccgcatgttcgctgacgggaaagtgtggagctactcctaccttgacaagtccatggtcctcctgcttcagagccaacgtcagtatatatttgagtatgactcctctgaccgcctccttgccgtcaccatgcccagcgtggcccggcacagcatgtccacacacacctccatcggctacatccgtaatatttacaacccgcctgaaagcaatgcttcggtcatctttgactacagtgatgacggccgcatcctgaagacctcctttttgggcaccggacgccaggtgttctacaagtatgggaaactctccaagttatcagagattgtctacgacagtaccgccgtcaccttcgggtatgacgagaccactggtgtcttgaagatggtcaacctccaaagtgggggcttctcctgcaccatcaggtaccggaagattggccccctggtggacaagcagatctacaggttctccgaggaaggcatggtcaatgccaggtttgactacacctatcatgacaacagcttccgcatcgcaagcatcaagcccgtcataagtgagactcccctccccgttgacctctaccgctatgatgagatttctggcaaggtggaacactttggtaagtttggagtcatctattatgacatcaaccagatcatcaccactgccgtgatgaccctcagcaaacacttcgacacccatgggcggatcaaggaggtccagtatgagatgttccggtccctcatgtactggatgacggtgcaatatgacagcatgggcagggtgatcaagagggagctaaaactggggccctatgccaataccacgaagtacacctatgactacgatggggacgggcagctccagagcgtggccgtcaatgaccgcccgacctggcgctacagctatgaccttaatgggaatctccacttactgaacccaggcaacagtgtgcgcctcatgcccttgcgctatgacctccgggatcggataaccagactcggggatgtgcagtacaaaattgacgacgatggctatctgtgccagagagggtctgacatcttcgaatacaattccaagggcctcctaacaagagcctacaacaaggccagcgggtggagtgtccagtaccgctatgatggcgtaggacggcgggcttcctacaagaccaacctgggccaccacctgcagtacttctactctgacctccacaacccgacgcgcatcacccatgtctacaatcactccaactcggagattacctcactgtactacgacctccagggccacctctttgccatggagagcagcagtggggaggagtactatgttgcctctgataacacagggactcctctggctgtgttcagcatcaacggcctcatgatcaaacagctgcagtacacggcctatggggagatttattatgactccaaccccgacttccagatggtcattggcttccatgggggactctatgaccccctgaccaagctggtccacttcactcagcgtgattatgatgtgctggcaggacgatggacctccccagactataccatgtggaaaaacgtgggcaaggagccggccccctttaacctgtatatgttcaagagcaacaatcctctcagcagtgagctagatttgaagaactacgtgacagatgtgaaaagctggcttgtgatgtttggatttcagcttagcaacatcattcctggcttcccgagagccaaaatgtatttcgtgcctcctccctatgaattgtcagagagtcaagcaagtgagaatggacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaacaaaataatctgctgccattccttgtctgaatggctcagcaggagtaactgttatctcctctcctaaggagatgaagacctaacaggggcactgcggctgggctgctttaggagaccaagtggcaagaaagctcacattttttgagttcaaatgctactgtccaagcgagaagtccctcatcctgaagtagactaaagcccggctgaaaattccgaggaaaacaaaacaaacgaatgaatgaacagacacacacaatgttccaagttcccctaaaatatgacccacttgttctgggtctacgcagaaaagagacgcaaagtgtccaaaaggaacaaaagaacaaaaacgaataagcaaagaagaaaacaaacaaaaacaaaacaaaacaaacacacggaccaataaacaaagaagcgaagataagaaagaaggcctcatatccaattacctcactcattcacatgtgagcgacacgcagacatccgcgagggccagcgtcaccagaccagctgcgggacaaaccactcagactgcttgtaggacaaatacttctgacattttcgtttaagcaaatacaggtgcatttaaaacacgactttgggggtgatttgtgtgtagcgcctggggaggggggataaaagaggaggagtgagcactggaaatactttttaaagaaaaaaaaacatgagggaataaaagaaattcctatcaaaaatcaaagtgaaataataccatccagcacttaactctcaggtcccaactaagtctggcctgagctaatttatttgagcgcagagtgtaaaatttaattcaaaatggtggctataatcactacagataaatttcatactcttttgtctttggagattccattgtggacagtaatacgcagttacagggtgtagtctgtttagattccgtagttcgtgggtatcagtttcggtagaggtgcagcatcgtgacacttttgctaacaggtaccacttctgatcaccctgtacatacatgagccgaaaggcacaatcactgtttcagatttaaaattattagtgtgtttgtttggtccagaaactgagacaatcacatgacagtcaccacgaggagagaaaatttaaaaaataaaaataaaaacaaaaaaaattttaaaaattaaaaaaacaaaaataaagtctaataagaactttggtacaggaacttttttgtaatatacatgtatgaattgttcatcgagtttttatattaattttaatttgctgctaagcaaagactagggacaggcaaagataatttatggcaaagtgtttaaattgtttatacataaataaagtctctaaaactcctg

SEQ ID NO: 54913 - DNA, 8996 bp, Homo sapiens
gagggaaacacaaaacgaagagcggcccactcccagcttacaccgatggtgagcccacctctcctgatcattagcgttgctggcacaattgaatgcaagccagatcatctcttatggagacccggcagtacctcacctcagtctgtgagttttctccatgggaaggttgtgatggagtctctgggccctccgaaccaccacagccagtcgactctgaggccccctctcccaccccctcacaaccacacgctgtcccatcaccactcgtccgccaactccctcaacaggaactcactgaccaatcggcggagtcagatccacgccccggccccagcgcccaatgacctggccaccacaccagagtccgttcagcttcaggacagctgggtgctaaacagcaacgtgccactggagacccggcacttcctcttcaagacctcctcggggagcacacccttgttcagcagctcttccccgggataccctttgacctcaggaacggtttacacgcccccgccccgcctgctgcccaggaatactttctccaggaaggctttcaagctgaagaagccctccaaatactgcagctggaaatgtgctgccctctccgccattgccgcggccctcctcttggctattttgctggcgtatttcatagtgccctggtcgttgaaaaacagcagcatagacagtggtgaagcagaagttggtcggcgggtaacacaagaagtcccaccaggggtgttttggaggtcacaaattcacatcagtcagccccagttcttaaagttcaacatctccctcgggaaggacgctctctttggtgtttacataagaagaggacttccaccatctcatgcccagtatgacttcatggaacgtctggacgggaaggagaagtggagtgtggttgagtctcccagggaacgccggagcatacagaccttggttcagaatgaagccgtgtttgtgcagtacctggatgtgggcctgtggcatctggccttctacaatgatggaaaagacaaagagatggtttccttcaatactgttgtcctagattcagtgcaggactgtccacgtaactgccatgggaatggtgaatgtgtgtccggggtgtgtcactgtttcccaggatttctaggagcagactgtgctaaagctgcctgccctgtcctgtgcagtgggaatggacaatattctaaagggacgtgccagtgctacagcggctggaaaggtgcagagtgcgacgtgcccatgaatcagtgcatcgatccttcctgcgggggccacggctcctgcattgatgggaactgtgtctgctctgctggctacaaaggcgagcactgtgaggaagttgattgcttggatcccacctgctccagccacggagtctgtgtgaatggagaatgcctgtgcagccctggctggggtggtctgaactgtgagctggcgagggtccagtgcccagaccagtgcagtgggcatggcacgtacctgcctgacacgggcctctgcagctgcgatcccaactggatgggtcccgactgctctgttgaagtgtgctcagtagactgtggcactcacggcgtctgcatcgggggagcctgccgctgtgaagagggctggacaggcgcagcgtgtgaccagcgcgtgtgccacccccgctgcattgagcacgggacctgtaaagatggcaaatgtgaatgccgagagggctggaatggtgaacactgcaccattggtaggcaaacggcaggcaccgaaacagatggctgccctgacttgtgcaacggtaacgggagatgcacactgggtcagaacagctggcagtgtgtctgccagaccggctggagagggcccggatgcaacgttgccatggaaacttcctgtgctgataacaaggataatgagggagatggcctggtggattgtttggaccctgactgctgcctgcagtcagcctgtcagaacagcctgctctgccgggggtcccgggacccactggacatcattcagcagggccagacggattggcccgcagtgaagtccttctatgaccgtatcaagctcttggcaggcaaggatagcacccacatcattcctggagagaaccctttcaacagcagcttggtttctctcatccgaggccaagtagtaactacagatggaactcccctggtcggtgtgaacgtgtcttttgtcaagtacccaaaatacggctacaccatcacccgccaggatggcacgttcgacctgatcgcaaatggaggtgcttccttgactctacactttgagcgagccccgttcatgagccaggagcgcactgtgtggctgccgtggaacagcttttacgccatggacaccctggtgatgaagaccgaggagaactccatccccagctgtgacctcagtggctttgtccggcctgatccaatcatcatctcctccccactgtccaccttctttagtgctgcccctgggcagaatcccatcgtgcctgagacccaggttcttcatgaagaaatcgagctccctggttccaatgtgaaacttcgctatctgagctctagaactgcagggtacaagtcactgctgaagatcaccatgacccagtccacagtgcccctgaacctcattagggttcacctgatggtggctgtcgaggggcatctcttccagaagtcattccaggcttctcccaacctggcctacaccttcatctgggacaagacagatgcgtatggccaaagggtgtatggactctcagatgctgttgtgtctgtcgggtttgaatatgagacctgtcccagtctaattctctgggagaaaaggacagccctccttcagggattcgagctggacccctccaacctcggtggctggtccctagacaaacaccacatcctcaatgttaaaagtggaatcctacacaaaggcactggggaaaaccagttcctgacccagcagcctgccatcatcaccagcatcatgggcaatggtcgccgccggagcatttcctgtcccagctgcaacggccttgctgaaggcaacaagctgctggccccagtggctctggctgttggaatcgatgggagcctctatgtgggtgacttcaattacatccgacgcatctttccctctcgaaatgtgaccagcatcttggagttacgcaacaacccagcacacaagtactacttggcagtggaccccgtgtccggctcgctctacgtgtccgacaccaacagcaggagaatctaccgcgtcaagtctctgagtggaaccaaagacctggctgggaattcggaagttgtggcagggacgggagagcagtgtctaccctttgatgaagcccgctgcggggatggagggaaggccatagatgcaaccctgatgagcccgagaggtattgcagtagacaagaatgggctcatgtactttgtcgatgccaccatgatccggaaggttgaccagaatggaatcatctccaccctgctgggctccaatgacctcactgccgtccggccgctgagctgtgattccagcatggatgtagcccaggttcgtctggagtggccaacagaccttgctgtcaatcccatggataactccttgtatgttctagagaacaatgtcatccttcgaatcaccgagaaccaccaagtcagcatcattgcgggacgccccatgcactgccaagttcctggcattgactactcactcagcaaactagccattcactctgccctggagtcagccagtgccattgccatttctcacactggggtcctctacatcactgagacagatgagaagaagattaaccgtctacgccaggtaacaaccaacggggagatctgccttttagctggggcagcctcggactgcgactgcaaaaacgatgtcaattgcaactgctattcaggagatgatgcctacgcgactgatgccatcttgaattccccatcatccttagctgtagctccagatggtaccatttacattgcagaccttggaaatattcggatcagggcggtcagcaagaacaagcctgttcttaatgccttcaaccagtatgaggctgcatcccccggagagcaggagttatatgttttcaacgctgatggcatccaccaatacactgtgagcctggtgacaggggagtacttgtacaatttcacatatagtactgacaatgatgtcactgaattgattgacaataatgggaattccctgaagatccgtcgggacagcagtggcatgccccgtcacctgctcatgcctgacaaccagatcatcaccctcaccgtgggcaccaatggaggcctcaaagtcgtgtccacacagaacctggagcttggtctcatgacctatgatggcaacactgggctcctggccaccaagagcgatgaaacaggatggacgactttctatgactatgaccacgaaggccgcctgaccaacgtgacgcgccccacgggggtggtaaccagtctgcaccgggaaatggagaaatctattaccattgacattgagaactccaaccgtgatgatgacgtcactgtcatcaccaacctctcttcagtagaggcctcctacacagtggtacaagatcaagttcggaacagctaccagctctgtaataatggtaccctgagggtgatgtatgctaatgggatgggtatcagcttccacagcgagccccatgtcctagcgggcaccatcacccccaccattggacgctgcaacatctccctgcctatggagaatggcttaaactccattgagtggcgcctaagaaaggaacagattaaaggcaaagtcaccatctttggcaggaagctccgggtccatggaagaaatctcttgtccattgactatgatcgaaatattcggactgaaaagatctatgatgaccaccggaagttcaccctgaggatcatttatgaccaggtgggccgccccttcctctggctgcccagcagcgggctggcagctgtcaacgtgtcatacttcttcaatgggcgcctggctgggcttcagcgtggggccatgagcgagaggacagacatcgacaagcaaggccgcatcgtgtcccgcatgttcgctgacgggaaagtgtggagctactcctaccttgacaagtccatggtcctcctgcttcagagccaacgtcagtatatatttgagtatgactcctctgaccgcctccttgccgtcaccatgcccagcgtggcccggcacagcatgtccacacacacctccatcggctacatccgtaatatttacaacccgcctgaaagcaatgcttcggtcatctttgactacagtgatgacggccgcatcctgaagacctcctttttgggcaccggacgccaggtgttctacaagtatgggaaactctccaagttatcagagattgtctacgacagtaccgccgtcaccttcgggtatgacgagaccactggtgtcttgaagatggtcaacctccaaagtgggggcttctcctgcaccatcaggtaccggaagattggccccctggtggacaagcagatctacaggttctccgaggaaggcatggtcaatgccaggtttgactacacctatcatgacaacagcttccgcatcgcaagcatcaagcccgtcataagtgagactcccctccccgttgacctctaccgctatgatgagatttctggcaaggtggaacactttggtaagtttggagtcatctattatgacatcaaccagatcatcaccactgccgtgatgaccctcagcaaacacttcgacacccatgggcggatcaaggaggtccagtatgagatgttccggtccctcatgtactggatgacggtgcaatatgacagcatgggcagggtgatcaagagggagctaaaactggggccctatgccaataccacgaagtacacctatgactacgatggggacgggcagctccagagcgtggccgtcaatgaccgcccgacctggcgctacagctatgaccttaatgggaatctccacttactgaacccaggcaacagtgtgcgcctcatgcccttgcgctatgacctccgggatcggataaccagactcggggatgtgcagtacaaaattgacgacgatggctatctgtgccagagagggtctgacatcttcgaatacaattccaagggcctcctaacaagagcctacaacaaggccagcgggtggagtgtccagtaccgctatgatggcgtaggacggcgggcttcctacaagaccaacctgggccaccacctgcagtacttctactctgacctccacaacccgacgcgcatcacccatgtctacaatcactccaactcggagattacctcactgtactacgacctccagggccacctctttgccatggagagcagcagtggggaggagtactatgttgcctctgataacacagggactcctctggctgtgttcagcatcaacggcctcatgatcaaacagctgcagtacacggcctatggggagatttattatgactccaaccccgacttccagatggtcattggcttccatgggggactctatgaccccctgaccaagctggtccacttcactcagcgtgattatgatgtgctggcaggacgatggacctccccagactataccatgtggaaaaacgtgggcaaggagccggccccctttaacctgtatatgttcaagagcaacaatcctctcagcagtgagctagatttgaagaactacgtgacagatgtgaaaagctggcttgtgatgtttggatttcagcttagcaacatcattcctggcttcccgagagccaaaatgtatttcgtgcctcctccctatgaattgtcagagagtcaagcaagtgagaatggacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaacaaaataatctgctgccattccttgtctgaatggctcagcaggagtaactgttatctcctctcctaaggagatgaagacctaacaggggcactgcggctgggctgctttaggagaccaagtggcaagaaagctcacattttttgagttcaaatgctactgtccaagcgagaagtccctcatcctgaagtagactaaagcccggctgaaaattccgaggaaaacaaaacaaacgaatgaatgaacagacacacacaatgttccaagttcccctaaaatatgacccacttgttctgggtctacgcagaaaagagacgcaaagtgtccaaaaggaacaaaagaacaaaaacgaataagcaaagaagaaaacaaacaaaaacaaaacaaaacaaacacacggaccaataaacaaagaagcgaagataagaaagaaggcctcatatccaattacctcactcattcacatgtgagcgacacgcagacatccgcgagggccagcgtcaccagaccagctgcgggacaaaccactcagactgcttgtaggacaaatacttctgacattttcgtttaagcaaatacaggtgcatttaaaacacgactttgggggtgatttgtgtgtagcgcctggggaggggggataaaagaggaggagtgagcactggaaatactttttaaagaaaaaaaaacatgagggaataaaagaaattcctatcaaaaatcaaagtgaaataataccatccagcacttaactctcaggtcccaactaagtctggcctgagctaatttatttgagcgcagagtgtaaaatttaattcaaaatggtggctataatcactacagataaatttcatactcttttgtctttggagattccattgtggacagtaatacgcagttacagggtgtagtctgtttagattccgtagttcgtgggtatcagtttcggtagaggtgcagcatcgtgacacttttgctaacaggtaccacttctgatcaccctgtacatacatgagccgaaaggcacaatcactgtttcagatttaaaattattagtgtgtttgtttggtccagaaactgagacaatcacatgacagtcaccacgaggagagaaaatttaaaaaataaaaataaaaacaaaaaaaattttaaaaattaaaaaaacaaaaataaagtctaataagaactttggtacaggaacttttttgtaatatacatgtatgaattgttcatcgagtttttatattaattttaatttgctgctaagcaaagactagggacaggcaaagataatttatggcaaagtgtttaaattgtttatacataaataaagtctctaaaactcctg

SEQ ID NO: 54914 - DNA, 8657 bp, Homo sapiens
tctgtagttagagggaaacacaaaacgaagagcggcccactcccagcttacaccgatggtgagcccacctctcctgatcattagcgttgctggcacaattgaatgcaagccagatcatctcttatggagacccggcagtacctcacctcagtctgtgagttttctccatgggaaggttgtgatggagtctctgggccctccgaaccaccacagccagtcgactctgaggccccctctcccaccccctcacaaccacacgctgtcccatcaccactcgtccgccaactccctcaacaggaactcactgaccaatcggcggagtcagatccacgccccggccccagcgcccaatgacctggccaccacaccagagtccgttcagcttcaggacagctgggtgctaaacagcaacgtgccactggagacccggcacttcctcttcaagacctcctcggggagcacacccttgttcagcagctcttccccgggataccctttgacctcaggaacggtttacacgcccccgccccgcctgctgcccaggaatactttctccaggaaggctttcaagctgaagaagccctccaaatactgcagctggaaatgtgctgccctctccgccattgccgcggccctcctcttggctattttgctggcgtatttcatagcaatgcatctgctcggactcaattggcaactccagcctgcagatgggcacacctttaacaatgggataaggaccggcttaccaggaaacgatgatgtggcaacaatgccatctggaggcaaagtgccctggtcgttgaaaaacagcagcatagacagtggtgaagcagaagttggtcggcgggtaacacaagaagtcccaccaggggtgttttggaggtcacaaattcacatcagtcagccccagttcttaaagttcaacatctccctcgggaaggacgctctctttggtgtttacataagaagaggacttccaccatctcatgcccagtatgacttcatggaacgtctggacgggaaggagaagtggagtgtggttgagtctcccagggaacgccggagcatacagaccttggttcagaatgaagccgtgtttgtgcagtacctggatgtgggcctgtggcatctggccttctacaatgatggaaaagacaaagagatggtttccttcaatactgttgtcctgacacgggcctctgcagctgcgatcccaactggatgggtcccgactgctctgttgaagtgtgctcagtagactgtggcactcacggcgtctgcatcgggggagcctgccgctgtgaagagggctggacaggcgcagcgtgtgaccagcgcgtgtgccacccccgctgcattgagcacgggacctgtaaagatggcaaatgtgaatgccgagagggctggaatggtgaacactgcaccattgatggctgccctgacttgtgcaacggtaacgggagatgcacactgggtcagaacagctggcagtgtgtctgccagaccggctggagagggcccggatgcaacgttgccatggaaacttcctgtgctgataacaaggataatgagggagatggcctggtggattgtttggaccctgactgctgcctgcagtcagcctgtcagaacagcctgctctgccgggggtcccgggacccactggacatcattcagcagggccagacggattggcccgcagtgaagtccttctatgaccgtatcaagctcttggcaggcaaggatagcacccacatcattcctggagagaaccctttcaacagcagcttggtttctctcatccgaggccaagtagtaactacagatggaactcccctggtcggtgtgaacgtgtcttttgtcaagtacccaaaatacggctacaccatcacccgccaggatggcacgttcgacctgatcgcaaatggaggtgcttccttgactctacactttgagcgagccccgttcatgagccaggagcgcactgtgtggctgccgtggaacagcttttacgccatggacaccctggtgatgaagaccgaggagaactccatccccagctgtgacctcagtggctttgtccggcctgatccaatcatcatctcctccccactgtccaccttctttagtgctgcccctgggcagaatcccatcgtgcctgagacccaggttcttcatgaagaaatcgagctccctggttccaatgtgaaacttcgctatctgagctctagaactgcagggtacaagtcactgctgaagatcaccatgacccagtccacagtgcccctgaacctcattagggttcacctgatggtggctgtcgaggggcatctcttccagaagtcattccaggcttctcccaacctggcctacaccttcatctgggacaagacagatgcgtatggccaaagggtgtatggactctcagatgctgttgtgtctgtcgggtttgaatatgagacctgtcccagtctaattctctgggagaaaaggacagccctccttcagggattcgagctggacccctccaacctcggtggctggtccctagacaaacaccacatcctcaatgttaaaagtggaatcctacacaaaggcactggggaaaaccagttcctgacccagcagcctgccatcatcaccagcatcatgggcaatggtcgccgccggagcatttcctgtcccagctgcaacggccttgctgaaggcaacaagctgctggccccagtggctctggctgttggaatcgatgggagcctctatgtgggtgacttcaattacatccgacgcatctttccctctcgaaatgtgaccagcatcttggagttacgcaacaacccagcacacaagtactacttggcagtggaccccgtgtccggctcgctctacgtgtccgacaccaacagcaggagaatctaccgcgtcaagtctctgagtggaaccaaagacctggctgggaattcggaagttgtggcagggacgggagagcagtgtctaccctttgatgaagcccgctgcggggatggagggaaggccatagatgcaaccctgatgagcccgagaggtattgcagtagacaagaatgggctcatgtactttgtcgatgccaccatgatccggaaggttgaccagaatggaatcatctccaccctgctgggctccaatgacctcactgccgtccggccgctgagctgtgattccagcatggatgtagcccaggttcgtctggagtggccaacagaccttgctgtcaatcccatggataactccttgtatgttctagagaacaatgtcatccttcgaatcaccgagaaccaccaagtcagcatcattgcgggacgccccatgcactgccaagttcctggcattgactactcactcagcaaactagccattcactctgccctggagtcagccagtgccattgccatttctcacactggggtcctctacatcactgagacagatgagaagaagattaaccgtctacgccaggtaacaaccaacggggagatctgccttttagctggggcagcctcggactgcgactgcaaaaacgatgtcaattgcaactgctattcaggagatgatgcctacgcgactgatgccatcttgaattccccatcatccttagctgtagctccagatggtaccatttacattgcagaccttggaaatattcggatcagggcggtcagcaagaacaagcctgttcttaatgccttcaaccagtatgaggctgcatcccccggagagcaggagttatatgttttcaacgctgatggcatccaccaatacactgtgagcctggtgacaggggagtacttgtacaatttcacatatagtactgacaatgatgtcactgaattgattgacaataatgggaattccctgaagatccgtcgggacagcagtggcatgccccgtcacctgctcatgcctgacaaccagatcatcaccctcaccgtgggcaccaatggaggcctcaaagtcgtgtccacacagaacctggagcttggtctcatgacctatgatggcaacactgggctcctggccaccaagagcgatgaaacaggatggacgactttctatgactatgaccacgaaggccgcctgaccaacgtgacgcgccccacgggggtggtaaccagtctgcaccgggaaatggagaaatctattaccattgacattgagaactccaaccgtgatgatgacgtcactgtcatcaccaacctctcttcagtagaggcctcctacacagtggtacaagatcaagttcggaacagctaccagctctgtaataatggtaccctgagggtgatgtatgctaatgggatgggtatcagcttccacagcgagccccatgtcctagcgggcaccatcacccccaccattggacgctgcaacatctccctgcctatggagaatggcttaaactccattgagtggcgcctaagaaaggaacagattaaaggcaaagtcaccatctttggcaggaagctccgggtccatggaagaaatctcttgtccattgactatgatcgaaatattcggactgaaaagatctatgatgaccaccggaagttcaccctgaggatcatttatgaccaggtgggccgccccttcctctggctgcccagcagcgggctggcagctgtcaacgtgtcatacttcttcaatgggcgcctggctgggcttcagcgtggggccatgagcgagaggacagacatcgacaagcaaggccgcatcgtgtcccgcatgttcgctgacgggaaagtgtggagctactcctaccttgacaagtccatggtcctcctgcttcagagccaacgtcagtatatatttgagtatgactcctctgaccgcctccttgccgtcaccatgcccagcgtggcccggcacagcatgtccacacacacctccatcggctacatccgtaatatttacaacccgcctgaaagcaatgcttcggtcatctttgactacagtgatgacggccgcatcctgaagacctcctttttgggcaccggacgccaggtgttctacaagtatgggaaactctccaagttatcagagattgtctacgacagtaccgccgtcaccttcgggtatgacgagaccactggtgtcttgaagatggtcaacctccaaagtgggggcttctcctgcaccatcaggtaccggaagattggccccctggtggacaagcagatctacaggttctccgaggaaggcatggtcaatgccaggtttgactacacctatcatgacaacagcttccgcatcgcaagcatcaagcccgtcataagtgagactcccctccccgttgacctctaccgctatgatgagatttctggcaaggtggaacactttggtaagtttggagtcatctattatgacatcaaccagatcatcaccactgccgtgatgaccctcagcaaacacttcgacacccatgggcggatcaaggaggtccagtatgagatgttccggtccctcatgtactggatgacggtgcaatatgacagcatgggcagggtgatcaagagggagctaaaactggggccctatgccaataccacgaagtacacctatgactacgatggggacgggcagctccagagcgtggccgtcaatgaccgcccgacctggcgctacagctatgaccttaatgggaatctccacttactgaacccaggcaacagtgtgcgcctcatgcccttgcgctatgacctccgggatcggataaccagactcggggatgtgcagtacaaaattgacgacgatggctatctgtgccagagagggtctgacatcttcgaatacaattccaagggcctcctaacaagagcctacaacaaggccagcgggtggagtgtccagtaccgctatgatggcgtaggacggcgggcttcctacaagaccaacctgggccaccacctgcagtacttctactctgacctccacaacccgacgcgcatcacccatgtctacaatcactccaactcggagattacctcactgtactacgacctccagggccacctctttgccatggagagcagcagtggggaggagtactatgttgcctctgataacacagggactcctctggctgtgttcagcatcaacggcctcatgatcaaacagctgcagtacacggcctatggggagatttattatgactccaaccccgacttccagatggtcattggcttccatgggggactctatgaccccctgaccaagctggtccacttcactcagcgtgattatgatgtgctggcaggacgatggacctccccagactataccatgtggaaaaacgtgggcaaggagccggccccctttaacctgtatatgttcaagagcaacaatcctctcagcagtgagctagatttgaagaactacgtgacagatgtgaaaagctggcttgtgatgtttggatttcagcttagcaacatcattcctggcttcccgagagccaaaatgtatttcgtgcctcctccctatgaattgtcagagagtcaagcaagtgagaatggacagctcattacaggtgtccaacagacaacagagagacataaccaggccttcatggctctggaaggacaggtcattactaaaaagctccacgccagcatccgagagaaagcaggtcactggtttgccaccaccacgcccatcattggcaaaggcatcatgtttgccatcaaagaagggcgggtgaccacgggcgtgtccagcatcgccagcgaagatagccgcaaggtggcatctgtgctgaacaacgcctactacctggacaagatgcactacagcatcgagggcaaggacacccactactttgtgaagattggctcagccgatggcgacctggtcacactaggcaccaccatcggccgcaaggtgctagagagcggggtgaacgtgaccgtgtcccagcccacgctgctggtcaacggcaggactcgaaggttcacgaacattgagttccagtactccacgctgctgctcagcatccgctatggcctcacccccgacaccctggacgaagagaaggcccgcgtcctggaccaggcgagacagagggccctgggcacggcctgggccaaggagcagcagaaagccagggacgggagagaggggagccgcctgtggactgagggcgagaagcagcagcttctgagcaccgggcgcgtgcaagggtacgagggatattacgtgcttcccgtggagcaatacccagagcttgcagacagtagcagcaacatccagtttttaagacagaatgagatgggaaagaggtaacaaaataatctgctgccattccttgtctgaatggctcagcaggagtaactgttatctcctctcctaaggagatgaagacctaacaggggcactgcggctgggctgctttaggagaccaagtggcaagaaagctcacattttttgagttcaaatgctactgtccaagcgagaagtccctcatcctgaagtagactaaagcccggctgaaaattccgaggaaaacaaaacaaacgaatgaatgaacagacacacacaatgttccaagttcccctaaaatatgacccacttgttctgggtctacgcagaaaagagacgcaaagtgtccaaaaggaacaaaagaacaaaaacgaataagcaaagaagaaaacaaacaaaaacaaaacaaaacaaacacacggaccaataaacaaagaagcgaagataagaaagaaggcctcatatccaattacctcactcattcacatgtgagcgacacgcagacatccgcgagggccagcgtcaccagaccagctgcgggacaaaccactcagactgcttgtaggacaaatacttctgacattttcgtttaagcaaatacaggtgcatttaaaacacgactttgggggtgatttgtgtgtagcgcctggggaggggggataaaagaggaggagtgagcactggaaatactttttaaagaaaaaaaaacatgagggaataaaagaaattcctatcaaaaatcaaagtgaaataataccatccagcacttaactctcaggtcccaactaagtctggcctgagctaatttatttgagcgcagagtgtaaaatttaattcaaaatggtggctataatcactacagataaatttcatactcttttgtctttggagattccattgtggacagtaatacgcagttacagggtgtagtctgtttagattccgtagttcgtgggtatcagtttcggtagaggtgcagcatcgtgacacttttgctaacaggtaccacttctgatcaccctgtacatacatgagccgaaaggcacaatcactgtttcagatttaaaattattagtgtgtttgtttggtccagaaactgagacaatcacatgacagtcaccacgaggagagaaaatttaaaaaataaaaataaaaacaaaaaaaattttaaaaattaaaaaaacaaaaataaagtctaataagaactttggtacaggaacttttttgtaatatacatgtatgaattgttcatcgagtttttatattaattttaatttgctgctaagcaaagactagggacaggcaaagataatttatggcaaagtgtttaaattgtttatacataaataaagtctctaaaactcctg

SEQ ID NO: 54915 - DNA, 1667 bp, Homo sapiens
cttctaggaaaggtggagtcggtagtgagaagccggaggtgagaagacccctgagcggatggattcattcattttctgaatttcctatgtgaggacagtattagagcccagtgaggctttgagaggccccaaagatgagcgccaacagcagcagagtgggccagcttctcttgcagggttcagcgtgcattaggtggaagcaggatgtggaaggggctgtctaccacctagccaactgcctcttactcctgggcttcatggggggcagtggggtgtatggatgcttctatctttttggcttcctgagtgcaggttacctgtgctgcgtgctgtggggctggttcagtgcctgtggcctggacattgttctttggagcttcctgctggctgtggtctgcctgctccagctggcacacctggtataccgcctgcgtgaggacaccctccctgaggagtttgacctcctctacaagacgctgtgcctgcccttgcaggtgcccctacagacatacaaggagattgttcactgctgcgaggagcaggtcttaactctggccactgaacagacctatgctgtggagggtgagacacccatcaaccgcctgtccctgctgctctctggccgggttcgtgtgagccaggatgggcagtttctgcactacatctttccataccagttcatggactctcctgagtgggaatcactacagccttctgaggagggggtgttccaggtcactctgactgctgagacctcatgtagctacatttcctggccccggaaaagtctccatcttcttctgaccaaagagcgatacatctcctgcctcttctcggctctgctgggatatgacatctcagagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactggcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcttaaaaaaaaaaaaaaaaaaaaa

SEQ ID NO: 54916 - DNA, 3020 bp, Homo sapiens
gtgaagaggcacacaattagcgtattgttcctttctgtattgtgctgagaggatccaagggattggtgggggaacaggcaagccaggcatcaccgtggatgttgaagaagggggttactcaaacctcggcatcttcacttgctcgatctggaattacagctatttattacgaagcactctgtgtggcttagtggagtgtgtctgaggaaacacatcccggacaccacttagggttagtctttctgagctcttcacatctctgactaattatcatcattaccatggagcccaacagtcccaaaaagatacagtttgccgtgcctgtattccagagtcagattgcacctgaagcagcagagcagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtgcaaaatgagttgataacaaccagaagttgacttgttagtgctgtgcttctactcgagcttggaaaaatcccaacacaaaacaaacaccacctccgattccatcatgatgccacgttgctttctactggattacctcctgaagcactttagatattttatacataagtattgacatgtttttcagaagctgtttcttcacttattgcttttttctaataatttttattacaccatttgccaagtccttccctttggttttagtttattcctctctacaactaaaaaagggatcttgagtttaggtacattttaagtgattcatttttagtttttctaattctggaatctgagccttctcttacaacagggagtctttcaaaaacatttttttgtttctttttcaaattccactgtgtttatttattgccttgtttctttttcaaattccattggtcttgatttaatttagttccacagattttactgatagtctactacctgccaactactgaattatgcagcagacttataaaaataaaaaggctattttattgttattgccatcctgctagtaaagatttattcaattatttataattaattaagtggcttcacctatatttctgttaataatcacattaattatgtatgacaggtaggatttatgttatagataagaaaactagagtccaaagaaaataagtgtccccaaatgaaccaataatccaacaaacgcttccactaactagcttctgacctgtttgagttgtgatagattttagaataaaaaagcctatcctccttaggagccatagacttttattctttcttatactgtcttatatattgacttagagctaaacttcctccaattcagacataaagcataggcagatacttttgctaatgaggctaagctgggaagaaaaccctgagttctactttaattcttgggcattgacttcaaactaagatgacttataagaaataaaagaagtaaatttgaaactttaataaaaaaagtacatggttcatttaaaaatgtttcctatgtctaaatctatattttaaaaataacctttatcatgtaaaatgagagaattgctgagtttatgacaatcttaggtataaccttttcttaaagaacaaggcatcaatctttaatttgtttccctttcttgatttctcataagttgcaaaataaaaataaaaataatttcacaaattgttcattattattatcctccctacttgccccaggatttaagtactaacttttacttcctactcttagactttgtattgccaaagaaataaaatatgaaaaagcataatcacccagacctacctgcggaattgtggattatgctgtagatattagatcattgaaaggaacaatatactacttaatgaggagccaaagacaacattctacctgctgctcccttcaagctgaggaatgagtttaattgacttcaaagtcccattattctcaaaagtagcaaaggtacaacatggctttgcatgaatcaaaggaagggaacaacaagaacttaaaaaaatagtttgcagatggttgaacatctctttaataattagagaagaatatcttttctttctttattgtttacagataccaacatttttcaaagccttgcagtagatgagtgagtctcctgttacatttctcctgcagcatatattctgtggatgtgttttcctaagcagactaattatatgttgctctcttcttttaccctaatgaaacatagatttttctgttttgaatttgtcacttgtttgttacatttgtcaagtgttttaaatattacattggtcctttatttgcttttgagaacacccaatagtttaaaaattaaaatgacatgaaggtcaattctaagacaggaatgatactactaaatcctggacttgcctatgataacaagctcgagctacacacttttattgtcagaataaatggaatatataggaaggagttaattggaactggttagtacctaaataagatttttcaaagtaagttttttgtcgtattggcagaacagtgttaaaaaatagacattgtcatcataaacacccacaactatatctgtagaagataatttaatgcaatattctggggaaaatacagttgccaaaattaatctccttgttttctttcattgtgcaatgtggagttaaattttttttctattgagcagtgtgtgtgtgtgtttgtgtctataatttatatatgtgcttgtatacatttctatatacacatgtatgtgtatgcaaaatatgtatatatacacatatatataaaatgtacactaaatatgtatatatgtatattcataaaatgttttgctgtatggaaataaaaaagaaggtttc

SEQ ID NO: 54917 - DNA, 1856 bp, Homo sapiens
gtgaagaggcacacaattagcgtattgttcctttctgtattgtgctgagaggatccaagggattggtgggggaacaggcaagccaggcatcaccgtggatgttgaagaagggggttactcaaacctcggcatcttcacttgctcgatctggaattacagctatttattacgaagcactctgtgtggcttagtggagtgtgtctgaggaaacacatcccggacaccacttagggttagtctttctgagctcttcacatctctgactaattatcatcattaccatggagcccaacagtcccaaaaagatacagtttgccgtgcctgtattccagagtcagattgcacctgaagcagcagagcagctgggcttttgtcgttcacagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtgcaaaatgagttgataacaaccagaagttgacttgttagtgctgtgcttctactcgagcttggaaaaatcccaacacaaaacaaacaccacctccgattccatcatgatgccacgttgctttctactggattacctcctgaagcactttagatattttatacataagtattgacatgtttttcagaagctgtttcttcacttattgcttttttctaataatttttattacaccatttgccaagtccttccctttggttttagtttattcctctctacaactaaaaaagggatcttgagtttaggtacattttaagtgattcatttttagtttttctaattctggaatctgagccttctcttacaacagggagtctttcaaaaacatttttttgtttctttttcaaattccactgtgtttatttattgccttgtttctttttcaaattccattggtcttgatttaatttagttccacagattttactgatagtctactacctgccaactactgaattatgcagcagacttataaaaataaaaaggctattttattgttattgccatcctgctagtaaagatttattcaattatttataattaattaagtggcttcacctatatttctgttaataatcacattaattatgtatgacaggtaggatttatgttatagataagaaaactagagtccaaagaaaataagtgtccccaaatgaaccaataatccaacaaacgcttccactaactagcttctgacctgtttgagttgtgatagattttagaataaaaaagcctatcctccttaggagccatagacttttattctttcttatactgtcttatatattgacttagagctaaacttcctccaattcagacataaagcataggcagatacttttgctaatgaggctaagctgggaagaaaaccctgagttctactttaattcttgggcattgacttcaaactaagatgacttataagaaataaaagaagtaaatttgaaactttaataaaaaaagtacatggttcatttaaaaatgtttcctatgtctaaatctatattttaaaaataacctttatcatgtaaaatgagagaattgctgagtttatgacaatcttaggtataaccttttcttaaagaacaaggcatcaatctttaatttgtttccctttcttgatttctcataagttgcaaaataaaaataaaaata

SEQ ID NO: 54918 - DNA, 2002 bp, Homo sapiens
gtgaagaggcacacaattagcgtattgttcctttctgtattgtgctgagaggatccaagggattggtgggggaacaggcaagccaggcatcaccgtggatgttgaagaagggggttactcaaacctcggcatcttcacttgctcgatctggaattacagctatttattacgaagcactctgtgtggcttagtggagtgtgtctgaggaaacacatcccggacaccacttagggttagtctttctgagctcttcacatctctgactaattatcatcattaccatggagcccaacagtcccaaaaagatacagtttgccgtgcctgtattccagagtcagattgcacctgaagcagcagagcagatcaggaaaagaagacctacaccagcatcacttgtgattctcaatgagcataaccccccagaaatagatgacaagagggggcccaacacacaaggggaattacagaatgcatcccctaagcaaaggaagcagagtgtgtacacaccacccaccataaaaggggttaagcatctgaaaggccagaatgaatcagcattccctgaagaagaagaaggcaccaatgaaagagaggagcagcgggaccattaattactggtctgcagcaagaaggcttcttggaaataactgaactattaacttttctgagtataccatggaattccactgcttgacttccagaagcatcctccatctctgcaccccacactcatacagtagctatgcacatcctggaagtctccttgactgaactttagaactaagtgcaaaatgagttgataacaaccagaagttgacttgttagtgctgtgcttctactcgagcttggaaaaatcccaacacaaaacaaacaccacctccgattccatcatgatgccacgttgctttctactggattacctcctgaagcactttagatattttatacataagtattgacatgtttttcagaagctgtttcttcacttattgcttttttctaataatttttattacaccatttgccaagtccttccctttggttttagtttattcctctctacaactaaaaaagggatcttgagtttaggtacattttaagtgattcatttttagtttttctaattctggaatctgagccttctcttacaacagggagtctttcaaaaacatttttttgtttctttttcaaattccactgtgtttatttattgccttgtttctttttcaaattccattggtcttgatttaatttagttccacagattttactgatagtctactacctgccaactactgaattatgcagcagacttataaaaataaaaaggctattttattgttattgccatcctgctagtaaagatttattcaattatttataattaattaagtggcttcacctatatttctgttaataatcacattaattatgtatgacaggtaggatttatgttatagataagaaaactagagtccaaagaaaataagtgtccccaaatgaaccaataatccaacaaacgcttccactaactagcttctgacctgtttgagttgtgatagattttagaataaaaaagcctatcctccttaggagccatagacttttattctttcttatactgtcttatatattgacttagagctaaacttcctccaattcagacataaagcataggcagatacttttgctaatgaggctaagctgggaagaaaaccctgagttctactttaattcttgggcattgacttcaaactaagatgacttataagaaataaaagaagtaaatttgaaactttaataaaaaaagtacatggttcatttaaaaatgtttcctatgtctaaatctatattttaaaaataacctttatcatgtaaaatgagagaattgctgagtttatgacaatcttaggtataaccttttcttaaagaacaaggcatcaatctttaatttgtttccctttcttgatttctcataagttgcaaaataaaaataaaaata

SEQ ID NO: 54919 - DNA, 1856 bp, Homo sapiens; identical to SEQ ID NO: 54917

SEQ ID NO: 54920 - DNA, 3020 bp, Homo sapiens; identical to SEQ ID NO: 54916

SEQ ID NO: 54921 - DNA, 2002 bp, Homo sapiens; identical to SEQ ID NO: 54918

SEQ ID NO: 54922 - DNA, 3326 bp, Homo sapiens
agtcatggcgaagcagtacgatgtgctgttccggctgctgctgatcggggactccggggtgggcaagacctgcctgctgtgccgcttcaccgacaacgagttccactcctcgcacatctccaccatcggtgttgactttaagatgaagaccatagaggtagacggcatcaaagtgcggatacagatctgggacactgcagggcaggagagataccagaccatcacaaagcagtactatcggcgggcccaggggatatttttggtctatgacattagcagcgagcgctcttaccagcacatcatgaagtgggtcagtgacgtggatgaggtaggagatgccacctcactgccggggtgtggagagggtgcctcaccggggaaggcaaggcgagggccagatgggaaggcaaatgcttccaggaagctttgccttccacagccctggatgaagacctctggtacgcaccagaaggcgtccagaagatccttattgggaataaggctgatgaggagcagaaacggcaggtgggaagagagcaagggcagcagctggcgaaggagtatggcatggacttctatgaaacaagtgcctgcaccaacctcaacattaaagagtcattcacgcgtctgacagagctggtgctgcaggcccataggaaggagctggaaggcctccggatgcgtgccagcaatgagttggcactggcagagctggaggaggaggagggcaaacccgagggcccagcgaactcttcgaaaacctgctggtgctgagtcctgtgtggggcaccccacacgacacccctcttccctcaggaggcccgtgggcagacaggggagccggggctttgccctgctgctgtcctctcgtgtgatgaccctattgagtatcagtagccactactccccctgcctggccctgagagcggctctgctgtcatctcaagcagcccctgtccccagcccgtccaccctggagtggtcttcttcagcctgtttccccagccacaggcctgctacgacccccacgatgtgccgcaagcactgtctcaccatcccgcacccaccagacaacagccagggctggagtccaggccactttcagctgctcctttctccgtgcatcgtgtctcttctctgctttttctctcttcccccacttctctttctctgacccctcccctccggtgcgtttcgtatcaagctcctcaaaccccgtcccccgtgtgtcctgctgtgtgcagctcgctctttccttccttcctaagctatccaaggggatggacccaggctcgtggggaggttccacccttggatccaggaagaaccctccaccctgcctcgtgggtgggccaaaggctacagggtgcttcttcctcttcccccacccccactgtccctcatgtgccatgggcctgcctccccagtgacctgcgaaagtggagcatcgaggtaggagggaaacggcaaccagggagtcctcgagcctggggctgccctacctctacccattccccgaccagagctttgcccttgcttggctgccagcctgcctctttggggaactgagctcagaggcaggtgcttcagagaaggaaacaaaatgaggggtggcagggataaaaagtcacctccattctctacctcccatgcagcatgaacacaatttctctccacctggctcccaaatttaaagatgtggaccaaggcctgtgggtactccaggggcaaggagagccctggggtcagtgacactgtcaggccaaccatgcactccacaaaggggagcatttggaaatgaaggactggctcctatgtatcaggttaagagcaagggagagctggccagggacagcagtttgcacagcagaggggaatgtagcaacagcagggcctcctaggccccatcttccatttcttaggtaagaagagcatttcctcagactcccaggcggaggactgagcctagccttcagcaaccaaggttctcctgggacccaaagtttatgggagaagggcaaagacttcatgggaagagagaaggaaggccctgggtagaaacgcttggtgctgttctctttggcctttaagacaaagcgctcatcttgccctctacctcctgataggcttgagggtttgccaaccacactgtggctacaggtggagggaagaggactccttcctccagagtgctatgttcaggaagtttctttaaccgcatatggcccaagagtagctcgtaggaggccctttaaagacggaacaagtaatttaccagttctactggggttcctgcccaccgtcccaaggtgggcgaggcctaggaagagggtcattcttaagccacacattagctgcactgcgtggctgcagccaaaacaaagaactgggtgttgagtattcatcaactaagaaccaaaatccagggcactcatatgtgaaggataagaacctcacttccttactcctccaaaaagaagtggggaaagaaccatcaaacctttcctcctgacttaccaaaccaggaaaacagcaggagagggtggctcaggacttagggacagggtatagcttagatggtggaaagcaaaggagagcaggaagttgtaaatcactggctaatgagaaaaggagacagctaactctaggatgaagctgtgactaggctggagttgcttccttgaagatgggactccttgggtatcaagacctatgccacatcacactggggctagggaagtaggtgatgccagccctcaagtctgtcttcagccagggacttgagaagttatattgggcagtggctccaatctgtggaccagtatttcagctttccctgaagatcaggcagggtgccattcattgtctttctctcctagccccctcaggaaagaaggactatatttgtactgtaccctaggggttctggaagggaaaacatggaatcaggattctatagactgataggccctatccacaagggccatgactgggaaaaggtatgggagcagaaggagaattgggattttagggtgcagctacgctcaccctaaacttttggtggcctggggcatgtcttgaggcccagactgttaaccaggctctgctggcctgtttactcgtcaccacctctgcacctgctgtcttgagactccatccagccccaggcacgccacctgctcctgagcctccactatctccctgtgacgggtgaacttcgtgtactgtgtctcgggtccatatatgaattgtgagcagggttcatctattttaaacacagatgtttacaaaataaagattatttcaaaccaaaaaaaaaaaaaaaa

SEQ ID NO: 54923 - DNA, 8526 bp, Homo sapiens
agacggcggcggcgcccgtaggatgcagggatcgctcccccggggccgctgagcctgcgcccagtgccccgagccccgcgccgagccgagtccgcgccaagcagcagccgcccaccccggggcccggccgggggaccagcagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcggagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcatacacaactgaatttgtggacctgggcaatgtctcagccttacgcaccttccgagtcctccgggccctgaaaactatatcagtcatttcagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcaggaatcccagcctgtgtccggtggcccagaggcccctccggattccaggacctggagccaggtgtcagcgactgcctcctctgaggccgaggccagtgcatctcaggccgactggcggcagcagtggaaagcggaaccccaggccccagggtgcggtgagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtgagcctcggcctggctggccaggacacactgaaaagcagcctttttcaccatggcaaacctaaatgcagtcagtcacaaaccagcctggggccttcctggctttgggagtaagaaatgggcctcagccccgcggatcaaccaggcagagttctgtggcgccgcgtggacagccggagcagttggcctgtgcttggaggcctcagatagacctgtgacctggtctggtcaggcaatgccctgcggctctggaaagcaacttcatcccagctgctgaggcgaaatataaaactgagactgtatatgttgtgaatgggctttcataaatttattatatttgatatttttttacttgagcaaagaactaaggatttttccatggacatgggcagcaattcacgctgtctcttcttaaccctgaacaagagtgtctatggagcagccggaagtctgttctcaaagcagaagtggaatccagtgtggctcccacaggtcttcactgcccaggggtcgaatggggtccccctcccacttgacctgagatgctgggagggctgaacccccactcacacaagcacacacacacagtcctcacacacggaggccagacacaggccgtgggacccaggctcccagcctaagggagacaggcctttccctgccggccccccaaggatggggttcttgtccacggggctcactctggccccctattgtctccaaggtcccattttccccctgtgttttcacgcaggtcatattgtcagtcctacaaaaataaaaggcttccagaggagagtggcctgggtcccagggctggccctaggcactgatagttgccttttcttcccctcctgtaagagtattaacaaaaccaaaggacacaagggtgcaagccccattcacggcctggcatgcagcttgtccttgctcctggaacctggcaggccctgcccagccagccatcggaagagagggctgagccatgggggtttggggctaagaagttcaccagccctgagccatggcggcccctcagcctgcctgaagagaggaaactggcgatctcccagggctctctggaccatacgcggaggagttttctgtgtggtctccagctcctctccagacacagagacatgggagtggggagcggagcttggccctgcgccctgtgcagggaaagggatggtcaggcccagttctcgtgcccttagaggggaatgaaccatggcacctttgagagagggggcactgtggtcaggcccagcctctctggctcagcccgggatcctgatggcacccacacagaggacctctttggggcaagatccaggtggtcccataggtcttgtgaaaaggctttttcagggaaaaatattttactagtccaatcacccccaggacctcttcagctgctgacaatcctatttagcatatgcaaatcttttaacatagagaactgtcaccctgaggtaacagggtcaactggcgaagcctgagcaggcaggggcttggctgccccattccagctctcccatggagcccctccaccgggcgcatgcctcccaggccacctcagtctcacctgccggctctgggctggctgctcctaacctacctcgccgagctgtcggagggctggacatttgtggcagtgctgaagggggcattgccggcgagtaaagtattatgtttcttcttgtcaccccagttcccttggtggcaaccccagacccaacccatgcccctgacagatctagttctcttctcctgtgttccctttgagtccagtgtgggacacggtttaactgtcccagcgacatttctccaagtggaaatcctatttttgtagatctccatgctttgctctcaaggcttggagaggtatgtgcccctcctgggtgctcaccgcctgctacacaggcaggaatgcggttgggaggcaggtcgggctgccagcccagctggccggaaggagactgtggtttttgtgtgtgtggacagcccgggagctttgagacaggtgcctggggctggctgcagacggtgtggttgggggtgggaggtgagctagacccaacccttagcttttagcctggctgtcacctttttaatttccagaactgcacaatgaccagcaggagggaaggacagacatcaagtgccagatgttgtctgaactaatcgagcacttctcaccaaacttcatgtataaataaaatacatatttttaaaacaaaccaataaatggcttacatgaaaaaaaaaaaaaaaaaaaaaaaaaa

SEQ ID NO: 54924 - DNA, 8527 bp, Homo sapiens
agacggcggcggcgcccgtaggatgcagggatcgctcccccggggccgctgagcctgcgcccagtgccccgagccccgcgccgagccgagtccgcgccaagcagcagccgcccaccccggggcccggccgggggaccagcagcttccccacaggcaacgtgaggagagcctgtgcccagaagcaggatgagaagatggcaaacttcctattacctcggggcaccagcagcttccgcaggttcacacgggagtccctggcagccatcgagaagcgcatggcggagaagcaagcccgcggctcaaccaccttgcaggagagccgagaggggctgcccgaggaggaggctccccggccccagctggacctgcaggcctccaaaaagctgccagatctctatggcaatccaccccaagagctcatcggagagcccctggaggacctggaccccttctatagcacccaaaagactttcatcgtactgaataaaggcaagaccatcttccggttcagtgccaccaacgccttgtatgtcctcagtcccttccaccccatccggagagcggctgtgaagattctggttcactcgctcttcaacatgctcatcatgtgcaccatcctcaccaactgcgtgttcatggcccagcacgaccctccaccctggaccaagtatgtcgagtacaccttcaccgccatttacacctttgagtctctggtcaagattctggctcgaggcttctgcctgcacgcgttcactttccttcgggacccatggaactggctggactttagtgtgattatcatggcatacacaactgaatttgtggacctgggcaatgtctcagccttacgcaccttccgagtcctccgggccctgaaaactatatcagtcatttcagggctgaagaccatcgtgggggccctgatccagtctgtgaagaagctggctgatgtgatggtcctcacagtcttctgcctcagcgtctttgccctcatcggcctgcagctcttcatgggcaacctaaggcacaagtgcgtgcgcaacttcacagcgctcaacggcaccaacggctccgtggaggccgacggcttggtctgggaatccctggacctttacctcagtgatccagaaaattacctgctcaagaacggcacctctgatgtgttactgtgtgggaacagctctgacgctgggacatgtccggagggctaccggtgcctaaaggcaggcgagaaccccgaccacggctacaccagcttcgattcctttgcctgggcctttcttgcactcttccgcctgatgacgcaggactgctgggagcgcctctatcagcagaccctcaggtccgcagggaagatctacatgatcttcttcatgcttgtcatcttcctggggtccttctacctggtgaacctgatcctggccgtggtcgcaatggcctatgaggagcaaaaccaagccaccatcgctgagaccgaggagaaggaaaagcgcttccaggaggccatggaaatgctcaagaaagaacacgaggccctcaccatcaggggtgtggataccgtgtcccgtagctccttggagatgtcccctttggccccagtaaacagccatgagagaagaagcaagaggagaaaacggatgtcttcaggaactgaggagtgtggggaggacaggctccccaagtctgactcagaagatggtcccagagcaatgaatcatctcagcctcacccgtggcctcagcaggacttctatgaagccacgttccagccgcgggagcattttcacctttcgcaggcgagacctgggttctgaagcagattttgcagatgatgaaaacagcacagcgggggagagcgagagccaccacacatcactgctggtgccctggcccctgcgccggaccagtgcccagggacagcccagtcccggaacctcggctcctggccacgccctccatggcaaaaagaacagcactgtggactgcaatggggtggtctcattactgggggcaggcgacccagaggccacatccccaggaagccacctcctccgccctgtgatgctagagcacccgccagacacgaccacgccatcggaggagccaggcgggccccagatgctgacctcccaggctccgtgtgtagatggcttcgaggagccaggagcacggcagcgggccctcagcgcagtcagcgtcctcaccagcgcactggaagagttagaggagtctcgccacaagtgtccaccatgctggaaccgtctcgcccagcgctacctgatctgggagtgctgcccgctgtggatgtccatcaagcagggagtgaagttggtggtcatggacccgtttactgacctcaccatcactatgtgcatcgtactcaacacactcttcatggcgctggagcactacaacatgacaagtgaattcgaggagatgctgcaggtcggaaacctggtcttcacagggattttcacagcagagatgaccttcaagatcattgccctcgacccctactactacttccaacagggctggaacatcttcgacagcatcatcgtcatccttagcctcatggagctgggcctgtcccgcatgagcaacttgtcggtgctgcgctccttccgcctgctgcgggtcttcaagctggccaaatcatggcccaccctgaacacactcatcaagatcatcgggaactcagtgggggcactggggaacctgacactggtgctagccatcatcgtgttcatctttgctgtggtgggcatgcagctctttggcaagaactactcggagctgagggacagcgactcaggcctgctgcctcgctggcacatgatggacttctttcatgccttcctcatcatcttccgcatcctctgtggagagtggatcgagaccatgtgggactgcatggaggtgtcggggcagtcattatgcctgctggtcttcttgcttgttatggtcattggcaaccttgtggtcctgaatctcttcctggccttgctgctcagctccttcagtgcagacaacctcacagcccctgatgaggacagagagatgaacaacctccagctggccctggcccgcatccagaggggcctgcgctttgtcaagcggaccacctgggatttctgctgtggtctcctgcggcagcggcctcagaagcccgcagcccttgccgcccagggccagctgcccagctgcattgccaccccctactccccgccacccccagagacggagaaggtgcctcccacccgcaaggaaacacggtttgaggaaggcgagcaaccaggccagggcacccccggggatccagagcccgtgtgtgtgcccatcgctgtggccgagtcagacacagatgaccaagaagaagatgaggagaacagcctgggcacggaggaggagtccagcaagcagcaggaatcccagcctgtgtccggtggcccagaggcccctccggattccaggacctggagccaggtgtcagcgactgcctcctctgaggccgaggccagtgcatctcaggccgactggcggcagcagtggaaagcggaaccccaggccccagggtgcggtgagaccccagaggacagttgctccgagggcagcacagcagacatgaccaacaccgctgagctcctggagcagatccctgacctcggccaggatgtcaaggacccagaggactgcttcactgaaggctgtgtccggcgctgtccctgctgtgcggtggacaccacacaggccccagggaaggtctggtggcggttgcgcaagacctgctaccacatcgtggagcacagctggttcgagacattcatcatcttcatgatcctactcagcagtggagcgctggccttcgaggacatctacctagaggagcggaagaccatcaaggttctgcttgagtatgccgacaagatgttcacatatgtcttcgtgctggagatgctgctcaagtgggtggcctacggcttcaagaagtacttcaccaatgcctggtgctggctcgacttcctcatcgtagacgtctctctggtcagcctggtggccaacaccctgggctttgccgagatgggccccatcaagtcactgcggacgctgcgtgcactccgtcctctgagagctctgtcacgatttgagggcatgagggtggtggtcaatgccctggtgggcgccatcccgtccatcatgaacgtcctcctcgtctgcctcatcttctggctcatcttcagcatcatgggcgtgaacctctttgcggggaagtttgggaggtgcatcaaccagacagagggagacttgcctttgaactacaccatcgtgaacaacaagagccagtgtgagtccttgaacttgaccggagaattgtactggaccaaggtgaaagtcaactttgacaacgtgggggccgggtacctggcccttctgcaggtggcaacatttaaaggctggatggacattatgtatgcagctgtggactccagggggtatgaagagcagcctcagtgggaatacaacctctacatgtacatctattttgtcattttcatcatctttgggtctttcttcaccctgaacctctttattggtgtcatcattgacaacttcaaccaacagaagaaaaagttagggggccaggacatcttcatgacagaggagcagaagaagtactacaatgccatgaagaagctgggctccaagaagccccagaagcccatcccacggcccctgaacaagtaccagggcttcatattcgacattgtgaccaagcaggcctttgacgtcaccatcatgtttctgatctgcttgaatatggtgaccatgatggtggagacagatgaccaaagtcctgagaaaatcaacatcttggccaagatcaacctgctctttgtggccatcttcacaggcgagtgtattgtcaagctggctgccctgcgccactactacttcaccaacagctggaatatcttcgacttcgtggttgtcatcctctccatcgtgggcactgtgctctcggacatcatccagaagtacttcttctccccgacgctcttccgagtcatccgcctggcccgaataggccgcatcctcagactgatccgaggggccaaggggatccgcacgctgctctttgccctcatgatgtccctgcctgccctcttcaacatcgggctgctgctcttcctcgtcatgttcatctactccatctttggcatggccaacttcgcttatgtcaagtgggaggctggcatcgacgacatgttcaacttccagaccttcgccaacagcatgctgtgcctcttccagatcaccacgtcggccggctgggatggcctcctcagccccatcctcaacactgggccgccctactgcgaccccactctgcccaacagcaatggctctcggggggactgcgggagcccagccgtgggcatcctcttcttcaccacctacatcatcatctccttcctcatcgtggtcaacatgtacattgccatcatcctggagaacttcagcgtggccacggaggagagcaccgagcccctgagtgaggacgacttcgatatgttctatgagatctgggagaaatttgacccagaggccactcagtttattgagtattcggtcctgtctgactttgccgatgccctgtctgagccactccgtatcgccaagcccaaccagataagcctcatcaacatggacctgcccatggtgagtggggaccgcatccattgcatggacattctctttgccttcaccaaaagggtcctgggggagtctggggagatggacgccctgaagatccagatggaggagaagttcatggcagccaacccatccaagatctcctacgagcccatcaccaccacactccggcgcaagcacgaagaggtgtcggccatggttatccagagagccttccgcaggcacctgctgcaacgctctttgaagcatgcctccttcctcttccgtcagcaggcgggcagcggcctctccgaagaggatgcccctgagcgagagggcctcatcgcctacgtgatgagtgagaacttctcccgaccccttggcccaccctccagctcctccatctcctccacttccttcccaccctcctatgacagtgtcactagagccaccagcgataacctccaggtgcgggggtctgactacagccacagtgaagatctcgccgacttccccccttctccggacagggaccgtgagtccatcgtgtgagcctcggcctggctggccaggacacactgaaaagcagcctttttcaccatggcaaacctaaatgcagtcagtcacaaaccagcctggggccttcctggctttgggagtaagaaatgggcctcagccccgcggatcaaccaggcagagttctgtggcgccgcgtggacagccggagcagttggcctgtgcttggaggcctcagatagacctgtgacctggtctggtcaggcaatgccctgcggctctggaaagcaacttcatcccagctgctgaggcgaaatataaaactgagactgtatatgttgtgaatgggctttcataaatttattatatttgatatttttttacttgagcaaagaactaaggatttttccatggacatgggcagcaattcacgctgtctcttcttaaccctgaacaagagtgtctatggagcagccggaagtctgttctcaaagcagaagtggaatccagtgtggctcccacaggtcttcactgcccaggggtcgaatggggtccccctcccacttgacctgagatgctgggagggctgaacccccactcacacaagcacacacacacagtcctcacacacggaggccagacacaggccgtgggacccaggctcccagcctaagggagacaggcctttccctgccggccccccaaggatggggttcttgtccacggggctcactctggccccctattgtctccaaggtcccattttccccctgtgttttcacgcaggtcatattgtcagtcctacaaaaataaaaggcttccagaggagagtggcctgggtcccagggctggccctaggcactgatagttgccttttcttcccctcctgtaagagtattaacaaaaccaaaggacacaagggtgcaagccccattcacggcctggcatgcagcttgtccttgctcctggaacctggcaggccctgcccagccagccatcggaagagagggctgagccatgggggtttggggctaagaagttcaccagccctgagccatggcggcccctcagcctgcctgaagagaggaaactggcgatctcccagggctctctggaccatacgcggaggagttttctgtgtggtctccagctcctctccagacacagagacatgggagtggggagcggagcttggccctgcgccctgtgcagggaaagggatggtcaggcccagttctcgtgcccttagaggggaatgaaccatggcacctttgagagagggggcactgtggtcaggcccagcctctctggctcagcccgggatcctgatggcacccacacagaggacctctttggggcaagatccaggtggtcccataggtcttgtgaaaaggctttttcagggaaaaatattttactagtccaatcacccccaggacctcttcagctgctgacaatcctatttagcatatgcaaatcttttaacatagagaactgtcaccctgaggtaacagggtcaactggcgaagcctgagcaggcaggggcttggctgccccattccagctctcccatggagcccctccaccgggcgcatgcctcccaggccacctcagtctcacctgccggctctgggctggctgctcctaacctacctcgccgagctgtcggagggctggacatttgtggcagtgctgaagggggcattgccggcgagtaaagtattatgtttcttcttgtcaccccagttcccttggtggcaaccccagacccaacccatgcccctgacagatctagttctcttctcctgtgttccctttgagtccagtgtgggacacggtttaactgtcccagcgacatttctccaagtggaaatcctatttttgtagatctccatgctttgctctcaaggcttggagaggtatgtgcccctcctgggtgctcaccgcctgctacacaggcaggaatgcggttgggaggcaggtcgggctgccagcccagctggccggaaggagactgtggtttttgtgtgtgtggacagcccgggagctttgagacaggtgcctggggctggctgcagacggtgtggttgggggtgggaggtgagctagacccaacccttagcttttagcctggctgtcacctttttaatttccagaactgcacaatgaccagcaggagggaaggacagacatcaagtgccagatgttgtctgaactaatcgagcacttctcaccaaacttcatgtataaataaaatacatatttttaaaacaaaccaataaatggcttacatgaaaaaaaaaaaaaaaaaaaaaaaa

SEQ ID NO: 54925 - DNA, 886 bp, Homo sapiens
gttctcaataccgggagaggcacagagctatttcagccacatgaaaagcatcggaattgagatcgcagctcagaggacaccgggcgccccttccaccttccaaggagctttgtattcttgcatctggctgcctgggacttcccttaggcagtaaacaaatacataaagcagggataagactgcatgaatatgtcgaaacagccagtttccaatgttagagccatccaggcaaatatcaatattccaatgggagcctttcggccaggagcaggtcaaccccccagaagaaaagaatgtactcctgaagtggaggagggtgttcctcccacctcggatgaggagaagaagccaattccaggagcgaagaaacttccaggacctgcagtcaatctatcggaaatccagaatattaaaagtgaactaaaatatgtccccaaagctgaacagtagtaggaagaaaaaaggattgatgtgaagaaataaagaggcagaagatggattcaatagctcactaaaattttatatatttgtatgatgattgtgaacctcctgaatgcctgagactctagcagaaatggcctgtttgtacatttatatctcttccttctagttggctgtatttcttactttatcttcatttttggcacctcacagaacaaattagcccataaattcaacacctggagggtgtggttttgaggagggatatgattttatggagaatgatatggcaatgtgcctaacgattttgatgaaaagtttcccaagctacttcctacagtattttggtcaatatttggaatgcgttttagttcttcaccttttaaattatgtcactaaactttgtatgagttcaaataaatatttgactaaatgtaaaatgtga

SEQ ID NO: 54926 - DNA, 5577 bp, Homo sapiens
ccatgagggcgctggtcctgctcggctgcctcctggcctcgctcctgttctcaggacaagcagaactgcaagtctccgcgtcgggtggcacagaagatgttggcaatttgttggagaatcatttctctgctggagacgcaagtctagaggagaaagaaagggcgctttatgcagacacagcccctcaagacaagaaactgctccttcactacccagatggcagggaggccgagagccccaagaagacccccgcgtctgccgccagcgcgggccccgatcctgaagccagcctctccaatgcctcagccacagagtcacctccacctggggaaagggacgacagggacgctgcggggcctggggaggaaaagaatggcccaccagtggcaagcgccctccctccaggaggggccaaggggcctgtggaagaggagtggccggagcccagttctggagagggacaaggagaggaggagactgggtttgggctccccacggagggaactgccagtggagaggcaggaggacaggctgggggccatgaactccccgaggaagtccaggaggtccaaggggacagcctggtgcagggagcagtagcagggacagcagagccaaaggcagagggggcctctcctcactcagagggtgatggggtcggcccactgaacgcagaggccgagggcagccctgggcctggcgaggagcctgcagtgccagagggagcccctgacgtcgcggctgttgggggagagtcggagccagatattgacacacaagccagtgagggcaccgaggaccagggggagcccggcccagctgcagaggccagtgcagagcctgggggcgcccaaagcgttaaggcaggggacactgaggagaaccagtccccagagatgactgaggaggacgcagatgaagcctcctctgaagaggaaagtggtgatggaagtggaagcgaggaagaaggaggagttccctccgaagaggagtccgaagaggacagcggcgatggggctagctcagaagaagcagagggcgcctccgaggaggccacggagccccaggaggctggggagccccaggaagccagggagccccaggaaggcggggatctgcaggaagccgaggagtcccaggaaggcggggatccccaggaagccgaggagccccaggaaggtggagcgccacaggaaggcggggagccccaggaaggtggggatccccaggaagccagggagccccaggaagccagggaaccccaggaaggtgcagagcttccggaagccacaggaaccacaagtcacagggacagaggggcccagcctggcccggaggaattgaatacagagtccatgggcagtgagaccctggatatgaaggcagaggagcccgaggagggacatcagggggagggagagtcccatcattgttgcccaggaagagacggaggatgcaaatgaagaagccccattgagggaccgctcccacatcgagaagaccctcatgctgaatgaggacaagccatccgatgactactctgcggtgctgcagcggcttcggaagatctaccactcatccatcaagcctctggagcagtcctacaagtacaatgagctccggcagcatgagatcacagatggagagattacctccaagcccatggtactgttcctgggaccgtggagtgttggtaaatctaccatgataaactacctccttgggctggaaaatactcgctatcagctctatacaggcgctgaacccaccacctctgagttcacggtcctcatgcatgggcctaagctgaaaaccatcgagggcatcgtcatggctgctgacagcgcccgttccttctcaccccttgagaagtttggccagaatttcctagagaagctgattggcattgaggttccccacaaacttctggagagggtcacttttgtggatacaccaggcatcatcgagaaccgcaagcagcaagaaagaggctaccccttcaacgacgtgtgccagtggttcatcgacagagctgacctcatctttgtcgtctttgacccaacaaagctggatgtgggtctagagctggagatgctcttccgccagttgaaggggcgtgaatcccagataaggatcatcctgaacaaggctgacaatctggccacccaaatgctcatgcgggtttacggggccctcttctggagcttggcccctctcatcaatgtcacagagcccccaagggtttacgtcagctccttctggccacaagagtataagccggacacccatcaggaactgttcctccaagaagagatctccctcctagaagacctgaatcaggtgatcgagaacagactggagaacaagattgccttcatccgccagcacgccatccgggtccgcatccacgccctcctggttgaccgctacctgcagacttacaaggacaaaatgaccttcttcagtgatggagaactggtctttaaggacattgtggaagatcccgataaattctacatcttcaagaccatcctggcaaagaccaatgtcagcaaatttgaccttcccaaccgcgaggcctataaggacttcttcggcatcaatcccatttccagtttcaaactgctctcccagcagtgctcctacatgggaggttgctttctggagaagattgagcgggccatcactcaggagcttccgggcctcctgggtagcctcgggctcgggaagaatccaggtgctctcaactgtgacaaaacagggtgtagcgaaacaccaaaaaatcgctacaggaagcactaggtggtggagcggtccttgggttcctgttggtgaatcagcttgtgtcctaactgtctgagaggtcctggtttattaaccctttgagccacactggcaggaattattacacagtggagagttgggagttcattgaggccaggggtcggggcaggtgtgtgggtctagggaggagagtggaaactgtgaattcctgtgtgcttgtcttgttgcttcaatgaggaggcctgattgaggcaagtcagcctccacctgcttttcctgggtcctgtcttggaaggacagagagcagctaaattctagtgtatcttaaatcagtgagggtcaaataagctaaaagcagctgaaattcctttgttccctgtgagctgggaaaacagcgaaggcctgagtcgtagagattgtcaggtccattttggcttctttccacacccacagtctcgcgtttgttccccagccctcggctgcctcttaactttgggttgactttcaacagtgaatagtctcttgggtctgaatatacctgggtttgtttttgtgtttttgagacggagtctcgctctgtcggccaggttggagtgcagtggtgcaatctcagctcactgcaacctccccctcctgggttcaagcgattctcctgcctcagcctcctgagtagctgagattataggcctaccaccatgcccagccaatttttgtatttttagtagaaacgggacttcaccatgttgcccaggctggcctcgaactcctgacctcaagtgatccacccgcctcggcctcccaaagtgctgggattacaggcatgagctgccgcacccggcctccacctgggttttgagccaatcccccggacttgctcctggtttcctcaaggggtggggcagtggtttaggacactcgacaactaagaacaggagttcccaggaaggacaaggatctgcctcccccactgccacttctctgatgtgttcctcaaagctggctcgagggctcgatcccttcatcggacccaggaggggactggttggtgtatccaggtaatttactcttggaagtgactgtagtgaaggtcgtggaagggctcagagggttaattggtttgcagtgcgtctttgtctattgcatgtcttggaaaactcagatcccaaaggcgctgggtttcagagaggacagtggagaccttgctccttttccttaggccgccagtctctcaaatttcagaggaggctgtttccacaactcccctgtggaaacacttggcagcggagttgctcctttgcagtttccacaccatggcttttcctttcctttcttctccattccctgatgcatcaacacttacttggagcaatttcctaggagtcagaaccagcaccagccactcggtgtcggtggccaccaaggcttaacattgaccttcccgcctgaccttgatgcagatgtccactgaacacaccgcaggaaagccagggccttcaataccaataagtgtgaatatgtgtgtatgttgtccaagagagattagggagatcacatagactctagggagtagagaacttgtaacagtcttgcaaggctagcatgcacggctccacagcaggtggtggggagcagaggggcaggacctgcagggaagaagcagcctttggatggtgaaatgtgcatggtgcacagtctgtgcatgcccaggagacccagcccgggctgcctcgaggggctcctttgtacacagccagccgcttctcttgggaacaagctgtcctgggggccttacccacgaggcaggagtcaggatgcaccagctcagcaccaggaagtcatcctggacccaggacagtggaaaggcaggcagagggagaggcactctgaggtcaggcagggtaagccagttggcagtcaggttaggtctatgaggagaacctcgagttaggaattcccggttctcagaattgttatcactctggtgcatgctgtcacaggggccgttgcgtttggctttgtggagggcctggacccttccacaagaacacccgaggttccagggcactcaggacaatgtttccaaggaacgagtcgaccaggaaagaacagtgagttctgcaaggggcatccacggagcctgtgataggggctgatgagatggaatctgtcctggacttttcttctcattaaccaccctccgcaaaccccagaacccctcgcctcatctctgtactgtctgccctcttgggggatgggccctcccactttcccctgcctgctcctccatgctgtgagctgctttggcagatctgtttttctgtgtagtcaggggaaaaacaaaaaaagatgcacaactgtgtgggcattgtcatagctgttggtgtcaccactgctttgggggaaatggctgggatgaggctaatacattcatgcaatatttatattttcagggggctgcgttatcagcatgctctccctgccttgggcttttctttccgtcatgttttccttttcgtgttccttctctgatttctcttgtctctgctgctcacaggcctgcccatcagtcagtacagatactcagtgtctggtttctggccagctccgtggagggggctttaagcagaattctgactctttggggtgggggattaggaactgggggaaacttaatgatccagagattcccccaagaggagtgtctggaaggatctgtgcctggacagtggcagaacctttccagtgttcttttggttctgatttcatcagtctcaataaagttccgatctctct

SEQ ID NO: 54927 - DNA, 2548 bp, Homo sapiens
agtcaccatgagggcgctggtcctgctcggctgcctcctggcctcgctcctgttctcaggacaagcagaagagacggaggatgcaaatgaagaagccccattgagggaccgctcccacatcgagaagaccctcatgctgaatgaggacaagccatccgatgactactctgcggtgctgcagcggcttcggaagatctaccactcatccatcaagcctctggagcagtcctacaagtacaatgagctccggcagcatgagatcacagatggagagattacctccaagcccatggtactgttcctgggaccgtggagtgttggtaaatctaccatgataaactacctccttgggctggaaaatactcgctatcagctctatacaggcgctgaacccaccacctctgagttcacggtcctcatgcatgggcctaagctgaaaaccatcgagggcatcgtcatggctgctgacagcgcccgttccttctcaccccttgagaagtttggccagaatttcctagagaagctgattggcattgaggttccccacaaacttctggagagggtcacttttgtggatacaccaggcatcatcgagaaccgcaagcagcaagaaagaggctaccccttcaacgacgtgtgccagtggttcatcgacagagctgacctcatctttgtcgtctttgacccaacaaagctggatgtgggtctagagctggagatgctcttccgccagttgaaggggcgtgaatcccagataaggatcatcctgaacaaggctgacaatctggccacccaaatgctcatgcgggtttacggggccctcttctggagcttggcccctctcatcaatgtcacagagcccccaagggtttacgtcagctccttctggccacaagagtataagccggacacccatcaggaactgttcctccaagaagagatctccctcctagaagacctgaatcaggtgatcgagaacagactggagaacaagattgccttcatccgccagcacgccatccgggtccgcatccacgccctcctggttgaccgctacctgcagacttacaaggacaaaatgaccttcttcagtgatggagaactggtctttaaggacattgtggaagatcccgataaattctacatcttcaagaccatcctggcaaagaccaatgtcagcaaatttgaccttcccgcctgaccttgatgcagatgtccactgaacacaccgcaggaaagccagggccttcaataccaataagtgtgaatatgtgtgtatgttgtccaagagagattagggagatcacatagactctagggagtagagaacttgtaacagtcttgcaaggctagcatgcacggctccacagcaggtggtggggagcagaggggcaggacctgcagggaagaagcagcctttggatggtgaaatgtgcatggtgcacagtctgtgcatgcccaggagacccagcccgggctgcctcgaggggctcctttgtacacagccagccgcttctcttgggaacaagctgtcctgggggccttacccacgaggcaggagtcaggatgcaccagctcagcaccaggaagtcatcctggacccaggacagtggaaaggcaggcagagggagaggcactctgaggtcaggcagggtaagccagttggcagtcaggttaggtctatgaggagaacctcgagttaggaattcccggttctcagaattgttatcactctggtgcatgctgtcacaggggccgttgcgtttggctttgtggagggcctggacccttccacaagaacacccgaggttccagggcactcaggacaatgtttccaaggaacgagtcgaccaggaaagaacagtgagttctgcaaggggcatccacggagcctgtgataggggctgatgagatggaatctgtcctggacttttcttctcattaaccaccctccgcaaaccccagaacccctcgcctcatctctgtactgtctgccctcttgggggatgggccctcccactttcccctgcctgctcctccatgctgtgagctgctttggcagatctgtttttctgtgtagtcaggggaaaaacaaaaaaagatgcacaactgtgtgggcattgtcatagctgttggtgtcaccactgctttgggggaaatggctgggatgaggctaatacattcatgcaatatttatattttcagggggctgcgttatcagcatgctctccctgccttgggcttttctttccgtcatgttttccttttcgtgttccttctctgatttctcttgtctctgctgctcacaggcctgcccatcagtcagtacagatactcagtgtctggtttctggccagctccgtggagggggctttaagcagaattctgactctttggggtgggggattaggaactgggggaaacttaatgatccagagattcccccaagaggagtgtctggaaggatctgtgcctggacagtggcagaacctttccagtgttcttttggttctgatttcatcagtctcaataaagttccgatctctct

SEQ ID NO: 54928 - DNA, 5577 bp, Homo sapiens
ccatgagggcgctggtcctgctcggctgcctcctggcctcgctcctgttctcaggacaagcagaactgcaagtctccgcgtcgggtggcacagaagatgttggcaatttgttggagaatcatttctctgctggagacgcaagtctagaggagaaagaaagggcgctttatgcagacacagcccctcaagacaagaaactgctccttcactacccagatggcagggaggccgagagccccaagaagacccccgcgtctgccgccagcgcgggccccgatcctgaagccagcctctccaatgcctcagccacagagtcacctccacctggggaaagggacgacagggacgctgcggggcctggggaggaaaagaatggcccaccagtggcaagcgccctccctccaggaggggccaaggggcctgtggaagaggagtggccggagcccagttctggagagggacaaggagaggaggagactgggtttgggctccccacggagggaactgccagtggagaggcaggaggacaggctgggggccatgaactccccgaggaagtccaggaggtccaaggggacagcctggtgcagggagcagtagcagggacagcagagccaaaggcagagggggcctctcctcactcagagggtgatggggtcggcccactgaacgcagaggccgagggcagccctgggcctggcgaggagcctgcagtgccagagggagcccctgacgtcgcggctgttgggggagagtcggagccagatattgacacacaagccagtgagggcaccgaggaccagggggagcccggcccagctgcagaggccagtgcagagcctgggggcgcccaaagcgttaaggcaggggacactgaggagaaccagtccccagagatgactgaggaggacgcagatgaagcctcctctgaagaggaaagtggtgatggaagtggaagcgaggaagaaggaggagttccctccgaagaggagtccgaagaggacagcggcgatggggctagctcagaagaagcagagggcgcctccgaggaggccacggagccccaggaggctggggagccccaggaagccagggagccccaggaaggcggggatctgcaggaagccgaggagtcccaggaaggcggggatccccaggaagccgaggagccccaggaaggtggagcgccacaggaaggcggggagccccaggaaggtggggatccccaggaagccagggagccccaggaagccagggaaccccaggaaggtgcagagcttccggaagccacaggaaccacaagtcacagggacagaggggcccagcctggcccggaggaattgaatacagagtccatgggcagtgagaccctggatatgaaggcagaggagcccgaggagggacatcagggggagggagagtcccatcattgttgcccaggaagagacggaggatgcaaatgaagaagccccattgagggaccgctcccacatcgagaagaccctcatgctgaatgaggacaagccatccgatgactactctgcggtgctgcagcggcttcggaagatctaccactcatccatcaagcctctggagcagtcctacaagtacaatgagctccggcagcatgagatcacagatggagagattacctccaagcccatggtactgttcctgggaccgtggagtgttggtaaatctaccatgataaactacctccttgggctggaaaatactcgctatcagctctatacaggcgctgaacccaccacctctgagttcacggtcctcatgcatgggcctaagctgaaaaccatcgagggcatcgtcatggctgctgacagcgcccgctccttctcaccccttgagaagtttggccagaatttcctagagaagctgattggcattgaggttccccacaaacttctggagagggtcacttttgtggatacaccaggcatcatcgagaaccgcaagcagcaagaaagaggctaccccttcaacgacgtgtgccagtggttcatcgacagagctgacctcatctttgtcgtctttgacccaacaaagctggatgtgggtctagagctggagatgctcttccgccagttgaaggggcgtgaatcccagataaggatcatcctgaacaaggctgacaatctggccacccaaatgctcatgcgggtttacggggccctcttctggagcttggcccctctcatcaatgtcacagagcccccaagggtttacgtcagctccttctggccacaagagtataagccggacacccatcaggaactgttcctccaagaagagatctccctcctagaagacctgaatcaggtgatcgagaacagactggagaacaagattgccttcatccgccagcacgccatccgggtccgcatccacgccctcctggttgaccgctacctgcagacttacaaggacaaaatgaccttcttcagtgatggagaactggtctttaaggacattgtggaagatcccgataaattctacatcttcaagaccatcctggcaaagaccaatgtcagcaaatttgaccttcccaaccgcgaggcctataaggacttcttcggcatcaatcccatttccagtttcaaactgctctcccagcagtgctcctacatgggaggttgctttctggagaagattgagcgggccatcactcaggagcttccgggcctcctgggtagcctcgggctcgggaagaatccaggtgctctcaactgtgacaaaacagggtgtagcgaaacaccaaaaaatcgctacaggaagcactaggtggtggagcggtccttgggttcctgttggtgaatcagcttgtgtcctaactgtctgagaagtcctggtttattaaccctttgagccacactggcaggaattattacacagtggagagttgggagatcattgaggccaggggtcggggcaggtgtgtgggtctagggaggagagtggaaactgtgaattcctgtgtgcttgtcttgttgcttcaatgaggaggcctgattgaggcaagtcagcctccacctgcttttcctgggtcctgtcttggaaggacagagagcagctaaattctagtgtatcttaaatcagtgagggtcaaataagctaaaagcagctgaaattcctttgttccctgtgagctgggaaaacagcgaaggcctgagtcgtagagattgtcaggtccattttggcttctttccacacccacagtctcgcgtttgttccccagccctcggctgcctcttaactttgggttgactttcaacagtgaatagtctcttgggtctgaatatacctgggtttgtttttgtgtttttgagacggagtctcgctctgtcggccaggttggagtgcagtggtgcaatctcagctcactgcaacctccccctcctgggttcaagcgattctcctgcctcagcctcctgagtagctgagattataggcctaccaccatgcccagccaatttttgtatttttagtagaaacgggacttcaccatgttgcccaggctggcctcgaactcctgacctcaagtgatccacccgcctcggcctcccaaagtgctgggattacaggcatgagctgccgcacccggcctccacctgggttttgagccaatcccccggacttgctcctggtttcctcaaggggtggggcagtggtttaggacactcgacaactaagaacaggagttcccaggaaggacaaggatctgcctcccccactgccacttctctgatgtgttcctcaaagctggctcgagggctcgatcccttcatcggacccaggaggggactggttggtgtatccaggtaatttactcttggaagtgactgtagtgaaggtcgtggaagggctcagagggttaattggtttgcagtgcgtctttgtctattgcatgtcttggaaaactcagatcccaaaggcgctgggtttcagagaggacagtggagaccttgctccttttccttaggccgccagtctctcaaatttcagaggaggctgtttccacaactcccctatggaaacacttggcagcggagttgctcctttgcagtttccacaccatggcttttcctttcctttcttctccattccctgatgcatcaacacttacttggagcaatttcctaggagtcagaaccagcaccagccactcggtgtcggtggccaccaaggcttaacattgaccttcccgcctgaccttgatgcagatgtccactgaacacaccgcaggaaagccagggccttcaataccaataagtgtgaatatgtgtgtatgttgtccaagagagattagggagatcacatagactctagggagtagagaacttgtaacagtcttgcaaggctagcatgcacggctccacagcaggtggtggggagcagaggggcaggacctgcagggaagaagcagcctttggatggtgaaatgtgcatggtgcacagtctgtgcatgcccaggagacccagcccgggctgcctcgaggggctcctttgtacacagccagccgcttctcttgggaacaagctgtcctgggggccttacccacgaggcaggagtcaggatgcaccagctcagcaccaggaagtcatcctggacccaggacagtggaaaggcaggcagagggagaggcactctgaggtcaggcagggtaagccagttggcagtcaggttaggtctatgaggagaacctcgagttaggaattcccggttctcagaattgttatcactctggtgcatgctgtcacaggggccgttgcgtttggctttgtggagggcctggacccttccacaagaacacccgaggttccagggcactcaggacaatgtttccaaggaacgagtcgaccaggaaagaacagtgagttctgcaaggggcatccacggagcctgtgataggggctgatgagatggaatctgtcctggacttttcttctcattaaccaccctccgcaaaccccagaacccctcgcctcatctctgtactgtctgccctcttgggggatgggccctcccactttcccctgcctgctcctccatgctgtgagctgctttggcagatctgtttttctgtgtagtcaggggaaaaacaaaaaaagatgcacaactgtgtgggcattgtcatagctgttggtgtcaccactgctttgggggaaatggctgggatgaggctaatacattcatgcaatatttatattttcagggggctgcgttatcagcatgctctccctgccttgggcttttctttccgtcatgttttccttttcgtgttccttctctgatttctcttgtctctgctgctcacaggcctgcccatcagtcagtacagatactcagtgtctggtttctggccagctccgtggagggggctttaagcagaattctgactctttggggtgggggattaggaactgggggaaacttaatgatccagagattcccccaagaggagtgtctggaaggatctgtgcctggacagtggcagaacctttccagtgttcttttggttctgatttcatcagtctcaataaagttccgatctctct

SEQ ID NO: 54929 - DNA, 2548 bp, Homo sapiens
agtcaccatgagggcgctggtcctgctcggctgcctcctggcctcgctcctgttctcaggacaagcagaagagacggaggatgcaaatgaagaagccccattgagggaccgctcccacatcgagaagaccctcatgctgaatgaggacaagccatccgatgactactctgcggtgctgcagcggcttcggaagatctaccactcatccatcaagcctctggagcagtcctacaagtacaatgagctccggcagcatgagatcacagatggagagattacctccaagcccatggtactgttcctgggaccgtggagtgttggtaaatctaccatgataaactacctccttgggctggaaaatactcgctatcagctctatacaggcgctgaacccaccacctctgagttcacggtcctcatgcatgggcctaagctgaaaaccatcgagggcatcgtcatggctgctgacagcgcccgctccttctcaccccttgagaagtttggccagaatttcctagagaagctgattggcattgaggttccccacaaacttctggagagggtcacttttgtggatacaccaggcatcatcgagaaccgcaagcagcaagaaagaggctaccccttcaacgacgtgtgccagtggttcatcgacagagctgacctcatctttgtcgtctttgacccaacaaagctggatgtgggtctagagctggagatgctcttccgccagttgaaggggcgtgaatcccagataaggatcatcctgaacaaggctgacaatctggccacccaaatgctcatgcgggtttacggggccctcttctggagcttggcccctctcatcaatgtcacagagcccccaagggtttacgtcagctccttctggccacaagagtataagccggacacccatcaggaactgttcctccaagaagagatctccctcctagaagacctgaatcaggtgatcgagaacagactggagaacaagattgccttcatccgccagcacgccatccgggtccgcatccacgccctcctggttgaccgctacctgcagacttacaaggacaaaatgaccttcttcagtgatggagaactggtctttaaggacattgtggaagatcccgataaattctacatcttcaagaccatcctggcaaagaccaatgtcagcaaatttgaccttcccgcctgaccttgatgcagatgtccactgaacacaccgcaggaaagccagggccttcaataccaataagtgtgaatatgtgtgtatgttgtccaagagagattagggagatcacatagactctagggagtagagaacttgtaacagtcttgcaaggctagcatgcacggctccacagcaggtggtggggagcagaggggcaggacctgcagggaagaagcagcctttggatggtgaaatgtgcatggtgcacagtctgtgcatgcccaggagacccagcccgggctgcctcgaggggctcctttgtacacagccagccgcttctcttgggaacaagctgtcctgggggccttacccacgaggcaggagtcaggatgcaccagctcagcaccaggaagtcatcctggacccaggacagtggaaaggcaggcagagggagaggcactctgaggtcaggcagggtaagccagttggcagtcaggttaggtctatgaggagaacctcgagttaggaattcccggttctcagaattgttatcactctggtgcatgctgtcacaggggccgttgcgtttggctttgtggagggcctggacccttccacaagaacacccgaggttccagggcactcaggacaatgtttccaaggaacgagtcgaccaggaaagaacagtgagttctgcaaggggcatccacggagcctgtgataggggctgatgagatggaatctgtcctggacttttcttctcattaaccaccctccgcaaaccccagaacccctcgcctcatctctgtactgtctgccctcttgggggatgggccctcccactttcccctgcctgctcctccatgctgtgagctgctttggcagatctgtttttctgtgtagtcaggggaaaaacaaaaaaagatgcacaactgtgtgggcattgtcatagctgttggtgtcaccactgctttgggggaaatggctgggatgaggctaatacattcatgcaatatttatattttcagggggctgcgttatcagcatgctctccctgccttgggcttttctttccgtcatgttttccttttcgtgttccttctctgatttctcttgtctctgctgctcacaggcctgcccatcagtcagtacagatactcagtgtctggtttctggccagctccgtggagggggctttaagcagaattctgactctttggggtgggggattaggaactgggggaaacttaatgatccagagattcccccaagaggagtgtctggaaggatctgtgcctggacagtggcagaacctttccagtgttcttttggttctgatttcatcagtctcaataaagttccgatctctct

SEQ ID NO: 54930 - DNA, 1764 bp, Homo sapiens
agaattcgggcaccaggagaaggaagccaacaggatccgacccggtgttttgtgacaaaggcaagacccccaggtctacttagagcaaagttagtagaggaggcagctaggcgtggctctcattccttcccacagaatggattataagtcgagcctgatccaggatgggaatcccatggagaacttggagaagcagctgatctgccctatctgcctggagatgtttaccaagccagtggtcatcttgccgtgccagcacaacctgtgccggaagtgtgccaatgacatcttccaggctgcaaatccctactggaccagccggggcagctcagtgtccatgtctggaggccgtttccgctgccccacctgccgccacgaggtgatcatggatcgtcacggagtgtacggcctgcagaggaacctgctggtggagaacatcatcgacatctacaaacaggagtgctccagtcggccgctgcagaagggcagtcaccccatgtgcaaggagcacgaagatgagaaaatcaacatctactgtctcacgtgtgaggtgcccacctgctccatgtgcaaggtgtttgggatccacaaggcctgcgaggtggccccattgcagagtgtcttccagggacaaaagactgaactgaataactgtatctccatgctggtggcggggaatgaccgtgtgcagaccatcatcactcagctggaggattcccgtcgagtgaccaaggagaacagtcaccaggtaaaggaagagctgagccagaagtttgacacgttgtatgccatcctggatgagaagaaaagtgagttgctgcagcggatcacgcaggagcaggagaaaaagcttagcttcatcgaggccctcatccagcagtaccaggagcagctggacaagtccacaaagctggtggaaactgccatccagtccctggacgagcctgggggagccaccttcctcttgactgccaagcaactcatcaaaagcattgtggaagcttccaagggctgccagctggggaagacagagcagggctttgagaacatggacttctttactttggatttagagcacatagcagacgccctgagagccattgactttgggacagatgaggaagaggaagaattcattgaagaagaagatcaggaagaggaagagtccacagaagggaaggaagaaggacaccagtaaggagctggatgaatgagaggcccccagatgcagagagactggagagggtggggaggggcccagcggccttggtgacaggcccagggtgggaggggtcggggcccctggaggggcaatggggaggtgatgtcttctctctgctcagagagcagggactagggtaggaccctcaccgctgcgtccagcagacactgaaccagaattggaaacgtgcttgaaacaatcacacaggacacttttctacattggtgcaaaatggaatattttgtacatttttaaaatgtgatttttgtatatacttgtatatgtatgccaatttggtgctttttgtaaaggaacttttgtataataatgcctggtcattgggtgacctgcgattgtcagaaagaggggaaggaagccaggttgatacagctgcccacttcctttcctgagcaggaggatggggtagcactcacagggacgatgtgctgtatttcagtgtctatcccagacatacggggtggtaactgagtttgtgttatatgttgttttaataaatgcacaatgctctcttcctgttcttc

SEQ ID NO: 54931 - protein, 272 aa, Homo sapiens
MVRCYVEIVEKLPERRPDPATIEGCAQLKPNNYLLAWHTPFNEKGSGFGAATKAMCIGLRYWKPERLETLIEVSVECGRMTHNHPTGFLGSLCTALFVSFAAQGKPLVQWGRDMLRAVPLAEEYCRKTIRHTAEYQEHWFYFEAKWQFYLEERKISKDSENKAIFPDNYDAEEREKTYRKWSSEGRGGRRGHDAPMIAYDALLAAGNSWTELCHRAMFHGGESAATGTIAGCLFGLLYGLDLVPKGLYQDLEDKEKLEDLGAALYRLSTEEK

SEQ ID NO: 54932 - protein, 360 aa, Homo sapiens
MAKAPSWAGVGALAYKAPEALWPAEAVMDGTMEDSEAVQRATALIEQRLAQEEENEKLRGDARQKLPMDLLVLEDEKHHGAQSAALQKVKGQERVRKTSLDLRREIIDVGGIQNLIELRKKRKQKKRDALAASHEPPPEPEEITGPVDEETFLKAAVEGKMKVIEKFLADGGSADTCDQFRRTALHRASLEGHMEILEKLLDNGATVDFQDRLDCTAMHWACRGGHLEVVKLLQSHGADTNVRDKLLSTPLHVAVRTGQVEIVEHFLSLGLEINARDREGDTALHDAVRLNRYKIIKLLLLHGADMMTKNLAGKTPTDLVQLWQADTRHALEHPEPGAEHNGLEGPNDSGRETPQPVPAQ

SEQ ID NO: 54933 - protein, 164 aa, Homo sapiens
MPSLAPDCPLLAMPEETQEDSVAPMMPSQRSRGPLAPNHVHEVCLHQVESISDLHSGAGTLRPYLTEEARPWDELLGVLPPSLCAQAGCSPVYRRGGFLLLLALLVLTCLVLALLAVYLSVLQSESLRILAHTLRTQEETLLKLRLASLSQLRRLNSSEAQAPS

SEQ ID NO: 54934 - protein, 1843 aa, Homo sapiens
MADTQTQVAPTPTMRMATAEDLPLPPPPALEDLPLPPPKESFSKFHQQRQASELRRLYRHIHPELRKNLAEAVAEDLAEVLGSEEPTEGDVQCMRWIFENWRLDAIGEHERPAAKEPVLCGDVQATSRKFEEGSFANSTDQEPTRPQPGGGDVRAARWLFETKPLDELTGQAKELEATVREPAASGDVQGTRMLFETRPLDRLGSRPSLQEQSPLELRSEIQELKGDVKKTVKLFQTEPLCAIQDAEGAIHEVKAACREEIQSNAVRSARWLFETRPLDAINQDPSQVRVIRGISLEEGARPDVSATRWIFETQPLDAIREILVDEKDFQPSPDLIPPGPDVQQQQHLFETRALDTLKGDEEAGAEAPPKEEVVPGDVRSTLWLFETKPLDAFRDKVQVGHLQRVDPQDGEGHLSSDSSSALPFSQSAPQRDELKGDVKTFKNLFETLPLDSIGQGEVLAHGSPSREEGTDSAGQAQGIGSPVYAMQDSKGRLHALTSVSREQIVGGDVQGYRWMFETQPLDQLGRSPSTIDVVRGITRQEVVAGDVGTARWLFETQPLEMIHQREQQERQKEEGKSQGDPQPEAPPKGDVQTIRWLFETCPMSELAEKQGSEVTDPTAKAEAQSCTWMFKPQPVDRPVGSREQHLQVSQVPAGERQTDRHVFETEPLQASGRPCGRRPVRYCSRVEIPSGQVSRQKEVFQALEAGKKEEQEPRVIAGSIPAGSVHKFTWLFENCPMGSLAAESIQGGNLLEEQPMSPSGNRMQESQETAAEGTLRTLHATPGILHHGGILMEARGPGELCLAKYVLSGTGQGHPYIRKEELVSGELPRIICQVLRRPDVDQQGLLVQEDPTGQLQLKPLRLPTPGSSGNIEDMDPELQQLLACGLGTSVARTGLVMQETEQGLVALTAYSLQPRLTSKASERSSVQLLASCIDKGDLSGLHSLRWEPPADPSPVPASEGAQSLHPTESIIHVPPLDPSMGMGHLRASGATPCPPQAIGKAVPLAGEAAAPAQLQNTEKQEDSHSGQKGMAVLGKSEGATTTPPGPGAPDLLAAMQSLRMATAEAQSLHQQVLNKHKQGPTPTATSNPIQDGLRKAGATQSNIRPGGGSDPRIPAAPRKVSREEQALPRGLPGGWVTIQDGIYTAHPVRTFDPPGGVQLSQREPQSRHRETALSVQAPRPLQGGPGQSTGPGREEPGGCTQMAWGPPGKAMAEVCPGGLQAAETTLKTAPLGRHILASGPQAAGASPHPHNAFVPPPPTLPAAVTGPDFPAGAHRAEDSIQQASEPLKDPLLHSHSSPAGQRTPGGSQTKTPKLDPTMPPKKKPQLPPKPAHLTQSHPPQRLPKPLPLSPSFSSEVGQREHQRGERDTAIPQPAKVPTTVDQGHIPLARCPSGHSQPSLQHGLSTTAPRPTKNQATGSNAQSSEPPKLNALNHDPTSPQWGPGPSGEQPMEGSHQGAPESPDSLQRNQKELQGLLNQVQALEKEAASSVDVQALRRLFEAVPQLGGAAPQAPAAHQKPEASVEQAFGELTRVSTEVAQLKEQTLARLLDIEEAVHKALSSMSSLQPEASARGHFQGPPKDHSAHKISVTVSSSARPSGSGQEVGGQTAVKNQAKVECHTEAQSQVKIRNHTEARGHTASTAPSTRRQETSREYLCPPRVLPSSRDSPSSPTFISIQSATRKPLETPSFKGNPDVSVKSTQLAQDIGQALLHQKGVQDKTGKKDITQCSVQPEPAPPSASPLPRGWQKSVLELQTGPGSSQHYGAMRTVTEQYEEVDQFGNTVLMSSTTVTEQAEPPRNPGSHLGLHASPLLRQFLHSPAGFSSDLTEAETVQVSCSYSQPAAQ

SEQ ID NO: 54935 - protein, 720 aa, Homo sapiens
MGWVGGTHQRGPPHLQAHLPPTAGDTQAKLRASVPEPRTQAGESQERPLTQADLGRQQSHQAQEETPQPGDAGKRVAPSGSKVVLNPAKEPQTWWAQDLAGDKGMAIGVGGACQRSDQGQQHLQGPWEERGRSTAWGEGTRAARNPAVPPGEPEGPGSPAAQGQAQKQVQEWDRGQVQGHAQEQAQWQTQIEAQGQAQEQAQGGTQGHSQGQAQKQFQNWAQGQAQGHAQEQAQWQIQIEAQGQAQEPAQGGAQGQVQGQAQKWAQGQIQGQAQKQVQGEVQKWAQEEAQGQAQWQTQIKAQKWAQEQTQKGAQERVQGQAQKGAQERAQEQAQEQTQIEAQGQAQKGAQERAREQAQKGAQERARERAQKGAQERAREQAQKGAQERAREQAQKGAQERAREQAQKGAQERAQEQGREQTHIEAQGQAQKGAQEWARDRARDQGWEQTQIETQRQTQKGAQERAWEQGWEQTHIEAQGQAQKGAQERAREQAQKGAQERAQEQGREQTHIEAQGQAQKGAQEWARDRARDQGWEQTQIETQRQTQKGAQERAWEQGREQALTSGMAPRAWEQPISGIAEGVDAAGRSGGSRSPAPRDGGQSGGSGLGEPSAGYPPPGSRPLRGKSIATSPLGLGKSPTEPKPEAGGCGTPQAPAQEGSPDHPGAERALQDRMEASEPERRGRSRHLAKYKAQSFRDQRAFDLSFRPMSVRASDMSELPK

SEQ ID NO: 54936 - protein, 224 aa, Homo sapiens
MATVIHNPLKALGDQFYKEAIEHCRSYNSRLSAERSVRLPFLDSQTGVAQNNCYIWMEKRHRGPGLAPGQLYTYPARCWRKKRRLHPPEDPKLRLLEIKPEVELPLKKDGFTSESTTLEALLRGEGVEKKVDAREEESIQEIQRVLENDENVEEGNEEEDLEEDIPKRKDRTRGRARCPLPSLHCFSSLPSAVIDAKEWGGGGKWEATVAYRKKKIYPVHIFNM

SEQ ID NO: 54937 - protein, 504 aa, Homo sapiens
MGIKTALPAAELGLYSLVLSGALAYAGRGLLEASQDGAHRKAFRESVRPGWEYIGRKMDVADFEWVMWFTSFRNVIIFALSGHVLFAKLCTMVAPKLRSWMYAVYGALAVMGTMGPWYLLLLLGHCVGLYVASLLGQPWLCLGLGLASLASFKMDPLISWQSGFVTGTFDLQEVLFHGGSSFTVLRCASFALESCAHPDRHYSLADLLKYNFYLPFFFFGPIMTFDRFHAQVSQVEPVRREGELWHIRAQAGLSVVAIMAVDIFFHFFYILTIPSDLKFANRLPDSALAGLAYSNLVYDWVKAAVLFGVVNTVACLDHLDPPQPPKCITALYVFTETHFDRGINDWLCKYVYNHIGGEHSAVIPELAATVATFAITTLWLGPCDIVYLWSFLNCFGLNFELWMQKLAEWGPLARIEASLSVQMSRRVRALFGAMNFWAIIMYNLVSLNSLKFTELVARRLLLTGFPQTTLSILFVTYCGVQLVKERERTLALEEEQKQDKEKPE

SEQ ID NO: 54938 - protein, 699 aa, Homo sapiens
MGHHRPWLHASVLWAGVASLLLPPAMTQQLRGDGLGFRNRNNSTGVAGLSEEASAELRHHLHSPRDHPDENKDVSTENGHHFWSHPDREKEDEDVSKEYGHLLPGHRSQDHKVGDEGVSGEEVFAEHGGQARGHRGHGSEDTEDSAEHRHHLPSHRSHSHQDEDEDEVVSSEHHHHILRHGHRGHDGEDDEGEEEEEEEEEEEEASTEYGHQAHRHRGHGSEEDEDVSDGHHHHGPSHRHQGHEEDDDDDDDDDDDDDDDDVSIEYRHQAHRHQGHGIEEDEDVSDGHHHRDPSHRHRSHEEDDNDDDDVSTEYGHQAHRHQDHRKEEVEAVSGEHHHHVPDHRHQGHRDEEEDEDVSTERWHQGPQHVHHGLVDEEEEEEEITVQFGHYVASHQPRGHKSDEEDFQDEYKTEVPHHHHHRVPREEDEEVSAELGHQAPSHRQSHQDEETGHGQRGSIKEMSHHPPGHTVVKDRSHLRKDDSEEEKEKEEDPGSHEEDDESSEQGEKGTHHGSRDQEDEEDEEEGHGLSLNQEEEEEEDKEEEEEEEDEERREERAEVGAPLSPDHSEEEEEEEEGLEEDEPRFTIIPNPLDRREEAGGASSEEESGEDTGPQDAQEYGNYQPGSLCGYCSFCNRCTECESCHCDEENMGEHCDQCQHCQFCYLCPLVCETVCAPGSYVDYFSSSLYQALADMLETPEP

SEQ ID NO: 54939 - protein, 170 aa, Homo sapiens
MSHRTSSTFRAERSFHSSSSSSSSSTSSSASRALPAQDPPMEKALSMFSDDFGSFMRPHSEPLAFPARPGGAGNIKTLGDAYEFAVDVRDFSPEDIIVTTSNNHIEVRAEKLAADGTVMNTFAHKCQLPEDVDPTSVTSALREDGSLTIRARRHPHTEHVQQTFRTEIKI

SEQ ID NO: 54940 - protein, 410 aa, Homo sapiens
MVVQNSADAGDMRAGVQLEPFLHQVGGHMSVMKYDEHTVCKPLVSREQRFYESLPLAMKRFTPQYKGTVTVHLWKDSTGHLSLVANPVKESQEPFKVSTESAAVAIWQTLQQTTGSNGSDCTLAQWPHAQLARSPKESPAKALLRSEPHLNTPAFSLVEDTNGNQVERKSFNPWGLQCHQAHLTRLCSEYPENKRHRFLLLENVVSQYTHPCVLDLKMGTRQHGDDASEEKKARHMRKCAQSTSACLGVRICGMQVYQTDKKYFLCKDKYYGRKLSVEGFRQALYQFLHNGSHLRRELLEPILHQLRALLSVIRSQSSYRFYSSSLLVIYDGQEPPERAPGSPHPHEAPQAAHGSSPGGLTKVDIRMIDFAHTTYKGYWNEHTTYDGPDPGYIFGLENLIRILQDIQEGE

SEQ ID NO: 54941 - protein, 186 aa, Homo sapiens
MKLIVGIGGMTNGGKTTLTNSLLRALPNCCVIHQDDFFKPQDQIAVGEDGFKQWDVLESLDMEAMLDTVQAWLSSPQKFARAHGVSVQPEASDTHILLLEGFLLYSYKPQKYRQEMEANGVEVVYLDGMKSREELFREVLEDIQNSLLNRSQESAPSPARPARTQGPGRGCGHRTARPAASQQDSM

SEQ ID NO: 54942 - protein, 230 aa, Homo sapiens
MKLIVGIGGMTNGGKTTLTNSLLRALPNCCVIHQDDFFKPQDQIAVGEDGFKQWDVLESLDMEAMLDTVQAWLSSPQKFARAHGVSVQPEASDTHILLLEGFLLYSYKPLVDLYSRRYFLTVPYEECKWRRSTRNYTVPDPPGLFDGHVWPMYQKYRQEMEANGVEVVYLDGMKSREELFREVLEDIQNSLLNRSQESAPSPARPARTQGPGRGCGHRTARPAASQQDSM

SEQ ID NO: 54943 - protein, 371 aa, Homo sapiens
MGHKVVVFDISVIRALWETRVKKHKAWQKKEVERLEKSALEKIKEEWNFVAECRRKGIPQAVYCKNGFIDTSVRLLDKIERNTLTRQSSLPKDRGKRSSAFVFELSGEHWTELPDSLKEQTHLREWYISNTLIQIIPTYIQLFQEMRILDLPKNQISHLPAEIGCLKNLKELNVGFNYLKSIPPELGDCENLERLDCSGNLELMELPFELSNLKQVTFVDISANKFSSVPICVLRMSNLQWLDISSNNLTDLPQDIDRLEELQSFLLYKNKLTYLPYSMLNLKKLTLLVVSGDHLVELPTALCDSSTPLKFVSLMDNPIDNAQCEDGNEIMESERDRQHFDKEVMKAYIEDLKERESVPSYTTKVSFSLQL

SEQ ID NO: 54944 - protein, 197 aa, Homo sapiens
MAPKKPEPKKEAAKPAPAPAPAPAPAPAPAPEAPKEPAFDPKSVKIDFTADQIEEFKEAFSLFDRTPTGEMKITYGQCGDVLRALGQNPTNAEVLRVLGKPKPEEMNVKMLDFETFLPILQHISRNKEQGTYEDFVEGLRVFDKESNGTVMGAELRHVLATLGEKMTEAEVEQLLAGQEDANGCINYEAFVKHIMSG

SEQ ID NO: 54945 - protein, 197 aa, Homo sapiens; identical to SEQ ID NO: 54944

SEQ ID NO: 54946 - protein, 2535 aa, Homo sapiens
MVSPPLLIISVAGTIECKPDHLLWRPGSTSPQSVSFLHGKVVMESLGPPNHHSQSTLRPPLPPPHNHTLSHHHSSANSLNRNSLTNRRSQIHAPAPAPNDLATTPESVQLQDSWVLNSNVPLETRHFLFKTSSGSTPLFSSSSPGYPLTSGTVYTPPPRLLPRNTFSRKAFKLKKPSKYCSWKCAALSAIAAALLLAILLAYFIVPWSLKNSSIDSGEAEVGRRVTQEVPPGVFWRSQIHISQPQFLKFNISLGKDALFGVYIRRGLPPSHAQYDFMERLDGKEKWSVVESPRERRSIQTLVQNEAVFVQYLDVGLWHLAFYNDGKDKEMVSFNTVVLDSVQDCPRNCHGNGECVSGVCHCFPGFLGADCAKAACPVLCSGNGQYSKGTCQCYSGWKGAECDVPMNQCIDPSCGGHGSCIDGNCVCSAGYKGEHCEEVDCLDPTCSSHGVCVNGECLCSPGWGGLNCELARVQCPDQCSGHGTYLPDTGLCSCDPNWMGPDCSVEVCSVDCGTHGVCIGGACRCEEGWTGAACDQRVCHPRCIEHGTCKDGKCECREGWNGEHCTIGRQTAGTETDGCPDLCNGNGRCTLGQNSWQCVCQTGWRGPGCNVAMETSCADNKDNEGDGLVDCLDPDCCLQSACQNSLLCRGSRDPLDIIQQGQTDWPAVKSFYDRIKLLAGKDSTHIIPGENPFNSSLVSLIRGQVVTTDGTPLVGVNVSFVKYPKYGYTITRQDGTFDLIANGGASLTLHFERAPFMSQERTVWLPWNSFYAMDTLVMKTEENSIPSCDLSGFVRPDPIIISSPLSTFFSAAPGQNPIVPETQVLHEEIELPGSNVKLRYLSSRTAGYKSLLKITMTQSTVPLNLIRVHLMVAVEGHLFQKSFQASPNLAYTFIWDKTDAYGQRVYGLSDAVVSVGFEYETCPSLILWEKRTALLQGFELDPSNLGGWSLDKHHILNVKSGILHKGTGENQFLTQQPAIITSIMGNGRRRSISCPSCNGLAEGNKLLAPVALAVGIDGSLYVGDFNYIRRIFPSRNVTSILELRNNPAHKYYLAVDPVSGSLYVSDTNSRRIYRVKSLSGTKDLAGNSEVVAGTGEQCLPFDEARCGDGGKAIDATLMSPRGIAVDKNGLMYFVDATMIRKVDQNGIISTLLGSNDLTAVRPLSCDSSMDVAQVRLEWPTDLAVNPMDNSLYVLENNVILRITENHQVSIIAGRPMHCQVPGIDYSLSKLAIHSALESASAIAISHTGVLYITETDEKKINRLRQVTTNGEICLLAGAASDCDCKNDVNCNCYSGDDAYATDAILNSPSSLAVAPDGTIYIADLGNIRIRAVSKNKPVLNAFNQYEAASPGEQELYVFNADGIHQYTVSLVTGEYLYNFTYSTDNDVTELIDNNGNSLKIRRDSSGMPRHLLMPDNQIITLTVGTNGGLKVVSTQNLELGLMTYDGNTGLLATKSDETGWTTFYDYDHEGRLTNVTRPTGVVTSLHREMEKSITIDIENSNRDDDVTVITNLSSVEASYTVVQDQVRNSYQLCNNGTLRVMYANGMGISFHSEPHVLAGTITPTIGRCNISLPMENGLNSIEWRLRKEQIKGKVTIFGRKLRVHGRNLLSIDYDRNIRTEKIYDDHRKFTLRIIYDQVGRPFLWLPSSGLAAVNVSYFFNGRLAGLQRGAMSERTDIDKQGRIVSRMFADGKVWSYSYLDKSMVLLLQSQRQYIFEYDSSDRLLAVTMPSVARHSMSTHTSIGYIRNIYNPPESNASVIFDYSDDGRILKTSFLGTGRQVFYKYGKLSKLSEIVYDSTAVTFGYDETTGVLKMVNLQSGGFSCTIRYRKIGPLVDKQIYRFSEEGMVNARFDYTYHDNSFRIASIKPVISETPLPVDLYRYDEISGKVEHFGKFGVIYYDINQIITTAVMTLSKHFDTHGRIKEVQYEMFRSLMYWMTVQYDSMGRVIKRELKLGPYANTTKYTYDYDGDGQLQSVAVNDRPTWRYSYDLNGNLHLLNPGNSVRLMPLRYDLRDRITRLGDVQYKIDDDGYLCQRGSDIFEYNSKGLLTRAYNKASGWSVQYRYDGVGRRASYKTNLGHHLQYFYSDLHNPTRITHVYNHSNSEITSLYYDLQGHLFAMESSSGEEYYVASDNTGTPLAVFSINGLMIKQLQYTAYGEIYYDSNPDFQMVIGFHGGLYDPLTKLVHFTQRDYDVLAGRWTSPDYTMWKNVGKEPAPFNLYMFKSNNPLSSELDLKNYVTDVKSWLVMFGFQLSNIIPGFPRAKMYFVPPPYELSESQASENGQLITGVQQTTERHNQAFMALEGQVITKKLHASIREKAGHWFATTTPIIGKGIMFAIKEGRVTTGVSSIASEDSRKVASVLNNAYYLDKMHYSIEGKDTHYFVKIGSADGDLVTLGTTIGRKVLESGVNVTVSQPTLLVNGRTRRFTNIEFQYSTLLLSIRYGLTPDTLDEEKARVLDQARQRALGTAWAKEQQKARDGREGSRLWTEGEKQQLLSTGRVQGYEGYYVLPVEQYPELADSSSNIQFLRQNEMGKR

SEQ ID NO: 54947 - protein, 2029 aa, Homo sapiens
MGPDCSVEVCSVDCGTHGVCIGGACRCEEGWTGAACDQRVCHPRCIEHGTCKDGKCECREGWNGEHCTIDGCPDLCNGNGRCTLGQNSWQCVCQTGWRGPGCNVAMETSCADNKDNEGDGLVDCLDPDCCLQSACQNSLLCRGSRDPLDIIQQGQTDWPAVKSFYDRIKLLAGKDSTHIIPGENPFNSSLVSLIRGQVVTTDGTPLVGVNVSFVKYPKYGYTITRQDGTFDLIANGGASLTLHFERAPFMSQERTVWLPWNSFYAMDTLVMKTEENSIPSCDLSGFVRPDPIIISSPLSTFFSAAPGQNPIVPETQVLHEEIELPGSNVKLRYLSSRTAGYKSLLKITMTQSTVPLNLIRVHLMVAVEGHLFQKSFQASPNLAYTFIWDKTDAYGQRVYGLSDAVVSVGFEYETCPSLILWEKRTALLQGFELDPSNLGGWSLDKHHILNVKSGILHKGTGENQFLTQQPAIITSIMGNGRRRSISCPSCNGLAEGNKLLAPVALAVGIDGSLYVGDFNYIRRIFPSRNVTSILELRNNPAHKYYLAVDPVSGSLYVSDTNSRRIYRVKSLSGTKDLAGNSEVVAGTGEQCLPFDEARCGDGGKAIDATLMSPRGIAVDKNGLMYFVDATMIRKVDQNGIISTLLGSNDLTAVRPLSCDSSMDVAQVRLEWPTDLAVNPMDNSLYVLENNVILRITENHQVSIIAGRPMHCQVPGIDYSLSKLAIHSALESASAIAISHTGVLYITETDEKKINRLRQVTTNGEICLLAGAASDCDCKNDVNCNCYSGDDAYATDAILNSPSSLAVAPDGTIYIADLGNIRIRAVSKNKPVLNAFNQYEAASPGEQELYVFNADGIHQYTVSLVTGEYLYNFTYSTDNDVTELIDNNGNSLKIRRDSSGMPRHLLMPDNQIITLTVGTNGGLKVVSTQNLELGLMTYDGNTGLLATKSDETGWTTFYDYDHEGRLTNVTRPTGVVTSLHREMEKSITIDIENSNRDDDVTVITNLSSVEASYTVVQDQVRNSYQLCNNGTLRVMYANGMGISFHSEPHVLAGTITPTIGRCNISLPMENGLNSIEWRLRKEQIKGKVTIFGRKLRVHGRNLLSIDYDRNIRTEKIYDDHRKFTLRIIYDQVGRPFLWLPSSGLAAVNVSYFFNGRLAGLQRGAMSERTDIDKQGRIVSRMFADGKVWSYSYLDKSMVLLLQSQRQYIFEYDSSDRLLAVTMPSVARHSMSTHTSIGYIRNIYNPPESNASVIFDYSDDGRILKTSFLGTGRQVFYKYGKLSKLSEIVYDSTAVTFGYDETTGVLKMVNLQSGGFSCTIRYRKIGPLVDKQIYRFSEEGMVNARFDYTYHDNSFRIASIKPVISETPLPVDLYRYDEISGKVEHFGKFGVIYYDINQIITTAVMTLSKHFDTHGRIKEVQYEMFRSLMYWMTVQYDSMGRVIKRELKLGPYANTTKYTYDYDGDGQLQSVAVNDRPTWRYSYDLNGNLHLLNPGNSVRLMPLRYDLRDRITRLGDVQYKIDDDGYLCQRGSDIFEYNSKGLLTRAYNKASGWSVQYRYDGVGRRASYKTNLGHHLQYFYSDLHNPTRITHVYNHSNSEITSLYYDLQGHLFAMESSSGEEYYVASDNTGTPLAVFSINGLMIKQLQYTAYGEIYYDSNPDFQMVIGFHGGLYDPLTKLVHFTQRDYDVLAGRWTSPDYTMWKNVGKEPAPFNLYMFKSNNPLSSELDLKNYVTDVKSWLVMFGFQLSNIIPGFPRAKMYFVPPPYELSESQASENGQLITGVQQTTERHNQAFMALEGQVITKKLHASIREKAGHWFATTTPIIGKGIMFAIKEGRVTTGVSSIASEDSRKVASVLNNAYYLDKMHYSIEGKDTHYFVKIGSADGDLVTLGTTIGRKVLESGVNVTVSQPTLLVNGRTRRFTNIEFQYSTLLLSIRYGLTPDTLDEEKARVLDQARQRALGTAWAKEQQKARDGREGSRLWTEGEKQQLLSTGRVQGYEGYYVLPVEQYPELADSSSNIQFLRQNEMGKR

SEQ ID NO: 54948 - protein, 2535 aa, Homo sapiens; identical to SEQ ID NO: 54946

SEQ ID NO: 54949 - protein, 2029 aa, Homo sapiens; identical to SEQ ID NO: 54947

SEQ ID NO: 54950 - protein, 364 aa, Homo sapiens
MSANSSRVGQLLLQGSACIRWKQDVEGAVYHLANCLLLLGFMGGSGVYGCFYLFGFLSAGYLCCVLWGWFSACGLDIVLWSFLLAVVCLLQLAHLVYRLREDTLPEEFDLLYKTLCLPLQVPLQTYKEIVHCCEEQVLTLATEQTYAVEGETPINRLSLLLSGRVRVSQDGQFLHYIFPYQFMDSPEWESLQPSEEGVFQVTLTAETSCSYISWPRKSLHLLLTKERYISCLFSALLGYDISEKLYTLNDKLFAKFGLRFDIRLPSLYHVLGPTAADAGPESEKGDEEVCEPAVSPPQATPTSLQQTPPCSTPPATTNFPAPPTRARLSRPDSGILASRIPLQSYSQVISRGQAPLAPTHTPEL

SEQ ID NO: 54951 - protein, 109 aa, Homo sapiens
MEPNSPKKIQFAVPVFQSQIAPEAAEQIRKRRPTPASLVILNEHNPPEIDDKRGPNTQGELQNASPKQRKQSVYTPPTIKGVKHLKGQNESAFPEEEEGTNEREEQRDH

SEQ ID NO: 54952 - protein, 116 aa, Homo sapiens
MEPNSPKKIQFAVPVFQSQIAPEAAEQLGFCRSQIRKRRPTPASLVILNEHNPPEIDDKRGPNTQGELQNASPKQRKQSVYTPPTIKGVKHLKGQNESAFPEEEEGTNEREEQRDH

SEQ ID NO: 54953 - protein, 109 aa, Homo sapiens; identical to SEQ ID NO: 54951

SEQ ID NO: 54954 - protein, 116 aa, Homo sapiens; identical to SEQ ID NO: 54952

SEQ ID NO: 54955 - protein, 109 aa, Homo sapiens; identical to SEQ ID NO: 54951

SEQ ID NO: 54956 - protein, 109 aa, Homo sapiens; identical to SEQ ID NO: 54951

SEQ ID NO: 54957 - protein, 208 aa, Homo sapiens
MAKQYDVLFRLLLIGDSGVGKTCLLCRFTDNEFHSSHISTIGVDFKMKTIEVDGIKVRIQIWDTAGQERYQTITKQYYRRAQGIFLVYDISSERSYQHIMKWVSDVDEVGDATSLPGCGEGASPGKARRGPDGKANASRKLCLPQPWMKTSGTHQKASRRSLLGIRLMRSRNGRWEESKGSSWRRSMAWTSMKQVPAPTSTLKSHSRV

SEQ ID NO: 54958 - protein, 2015 aa, Homo sapiens [sequence omitted]

SEQ ID NO: 54959 - protein, 2016 aa, Homo sapiens [sequence omitted]

SEQ ID NO: 54960 - protein, 88 aa, Homo sapiens
MNMSKQPVSNVRAIQANINIPMGAFRPGAGQPPRRKECTPEVEEGVPPTSDEEKKPIPGAKKLPGPAVNLSEIQNIKSELKYVPKAEQ

SEQ ID NO: 54961 - protein, 448 aa, Homo sapiens
  VARIANT 432,443: Xaa = Any Amino Acid
MLNEDKPSDDYSAVLQRLRKIYHSSIKPLEQSYKYNELRQHEITDGEITSKPMVLFLGPWSVGKSTMINYLLGLENTRYQLYTGAEPTTSEFTVLMHGPKLKTIEGIVMAADSARSFSPLEKFGQNFLEKLIGIEVPHKLLERVTFVDTPGIIENRKQQERGYPFNDVCQWFIDRADLIFVVFDPTKLDVGLELEMLFRQLKGRESQIRIILNKADNLATQMLMRVYGALFWSLAPLINVTEPPRVYVSSFWPQEYKPDTHQELFLQEEISLLEDLNQVIENRLENKIAFIRQHAIRVRIHALLVDRYLQTYKDKMTFFSDGELVFKDIVEDPDKFYIFKTILAKTNVSKFDLPNREAYKDFFGINPISSFKLLSQQCSYMGGCFLEKIERAITQELPGLLGSLGLGKNPGALNCDKTGCSETPKNRYRKHXVVERSLGSCWXISLCP

SEQ ID NO: 54962 - protein, 397 aa, Homo sapiens [sequence omitted]

SEQ ID NO: 54963 - protein, 448 aa, Homo sapiens; identical to SEQ ID NO: 54961
  VARIANT 432,443: Xaa = Any Amino Acid

SEQ ID NO: 54964 - protein, 397 aa, Homo sapiens [sequence omitted]

SEQ ID NO: 54965 - protein, 353 aa, Homo sapiens
MDYKSSLIQDGNPMENLEKQLICPICLEMFTKPVVILPCQHNLCRKCANDIFQAANPYWTSRGSSVSMSGGRFRCPTCRHEVIMDRHGVYGLQRNLLVENIIDIYKQECSSRPLQKGSHPMCKEHEDEKINIYCLTCEVPTCSMCKVFGIHKACEVAPLQSVFQGQKTELNNCISMLVAGNDRVQTIITQLEDSRRVTKENSHQVKEELSQKFDTLYAILDEKKSELLQRITQEQEKKLSFIEALIQQYQEQLDKSTKLVETAIQSLDEPGGATFLLTAKQLIKSIVEASKGCQLGKTEQGFENMDFFTLDLEHIADALRAIDFGTDEEEEEFIEEEDQEEEESTEGKEEGHQ

SEQ ID NO: 54966 - DNA, 20 bp, Homo sapiens
gatcctcactgagcgtggct

SEQ ID NO: 54967 - DNA, 20 bp, Homo sapiens
gatcagcaataccagggtac

SEQ ID NO: 54968 - DNA, 20 bp, Homo sapiens
gatcgtatgcagaaggaaat

SEQ ID NO: 54969 - DNA, 20 bp, Homo sapiens
gatctgagtcatcttctccc

SEQ ID NO: 54970 - DNA, 20 bp, Homo sapiens
gatcactgcgcatgagcagt

SEQ ID NO: 54971 - DNA, 20 bp, Homo sapiens
gatctggaccatcatccttc

SEQ ID NO: 54972 - DNA, 20 bp, Homo sapiens
gatcttaaaatctagtgtga

SEQ ID NO: 54973 - DNA, 20 bp, Homo sapiens
gatcaaagcttgaaaattta

SEQ ID NO: 54974 - DNA, 20 bp, Homo sapiens
gatcatccatctggtgagca

SEQ ID NO: 54975 - DNA, 20 bp, Homo sapiens
gatcatgaaggtctgaatat

SEQ ID NO: 54976 - DNA, 20 bp, Homo sapiens
gatcctcctgcttctctaaa

SEQ ID NO: 54977 - DNA, 20 bp, Homo sapiens
gatcgaattccgtgatatgc

SEQ ID NO: 54978 - DNA, 20 bp, Homo sapiens
gatctgaagacacttctagc

SEQ ID NO: 54979 - DNA, 20 bp, Homo sapiens
gatctggtgctacactggca

SEQ ID NO: 54980 - DNA, 20 bp, Homo sapiens
gatctttgttctagtttttt

SEQ ID NO: 54981 - DNA, 20 bp, Homo sapiens
gatcactggccctgtggatg

SEQ ID NO: 54982 - DNA, 20 bp, Homo sapiens
gatcatgcagaaaaaaggct

SEQ ID NO: 54983 - DNA, 20 bp, Homo sapiens
gatcggctggactgcacagc

SEQ ID NO: 54984 - DNA, 20 bp, Homo sapiens
gatctcttcaagccaggcct

SEQ ID NO: 54985 - DNA, 20 bp, Homo sapiens
gatctcaagacctcatcaca

SEQ ID NO: 54986 - DNA, 20 bp, Homo sapiens
gatccacacgaccatcctga

SEQ ID NO: 54987 - DNA, 20 bp, Homo sapiens
gatcccagcttaggctagga

SEQ ID NO: 54988 - DNA, 20 bp, Homo sapiens
gatccttcttagagaaggct

SEQ ID NO: 54989 - DNA, 20 bp, Homo sapiens
gatctgaataccccttctct

SEQ ID NO: 54990 - DNA, 20 bp, Homo sapiens
gatctgttccgtgacagtca

SEQ ID NO: 54991 - DNA, 20 bp, Homo sapiens
gatcttccaactgctgagga

SEQ ID NO: 54992 - DNA, 20 bp, Homo sapiens
gatcttgttctttgctggac

SEQ ID NO: 54993 - DNA, 20 bp, Homo sapiens
gatcctaacgtggacaccag

SEQ ID NO: 54994 - DNA, 20 bp, Homo sapiens
gatcctgcctatctttacaa

SEQ ID NO: 54995 - DNA, 20 bp, Homo sapiens
gatcgaccaattctatctat

SEQ ID NO: 54996 - DNA, 20 bp, Homo sapiens
gatctacaattttatatttt

SEQ ID NO: 54997 - DNA, 20 bp, Homo sapiens
gatcagaaatcacacagagg

SEQ ID NO: 54998 - DNA, 20 bp, Homo sapiens
gatcatctgccaagtcctgc

SEQ ID NO: 54999 - DNA, 20 bp, Homo sapiens
gatcccttcagggcaggtgt

SEQ ID NO: 55000 - DNA, 20 bp, Homo sapiens
gatcacagtgaagaaaaaga

SEQ ID NO: 55001 - DNA, 20 bp, Homo sapiens
gatcagctttggtgagagga

SEQ ID NO: 55002 - DNA, 20 bp, Homo sapiens
gatcaggaagaaagtgaaca

SEQ ID NO: 55003 - DNA, 20 bp, Homo sapiens
gatctgtatgaagaagcagt

SEQ ID NO: 55004 - DNA, 20 bp, Homo sapiens
gatcagagacttttgccagc

SEQ ID NO: 55005 - DNA, 20 bp, Homo sapiens
gatcataattttatagaaga

SEQ ID NO: 55006 - DNA, 20 bp, Homo sapiens
gatcagactccaacaggtgc

SEQ ID NO: 55007 - DNA, 20 bp, Homo sapiens
gatcccagctgatgtagacc

SEQ ID NO: 55008 - DNA, 20 bp, Homo sapiens
gatcttttcccgacgtctac

SEQ ID NO: 55009 - DNA, 20 bp, Homo sapiens
gatcaactcttcagcaattt

SEQ ID NO: 55010 - DNA, 20 bp, Homo sapiens
gatcacttctgaggagaaac

SEQ ID NO: 55011 - DNA, 20 bp, Homo sapiens
gatcaggtctttactgaatg

SEQ ID NO: 55012 - DNA, 20 bp, Homo sapiens
gatccctttgtcctatcgtg

SEQ ID NO: 55013 - DNA, 20 bp, Homo sapiens
gatcgatacctttccccaaa

SEQ ID NO: 55014 - DNA, 20 bp, Homo sapiens
gatcgggtatggacaaggcg

SEQ ID NO: 55015 - DNA, 20 bp, Homo sapiens
gatctagagccatacaagat

SEQ ID NO: 55016 - DNA, 20 bp, Homo sapiens
gatcttttctttgagataga

SEQ ID NO: 55017 - DNA, 20 bp, Homo sapiens
gatccagcaggtttgaccca

SEQ ID NO: 55018 - DNA, 20 bp, Homo sapiens
gatcgagcagccttcttctt

SEQ ID NO: 55019 - DNA, 20 bp, Homo sapiens
gatcaccttacacatttaat

SEQ ID NO: 55020 - DNA, 20 bp, Homo sapiens
gatcagctgattaacaggct

SEQ ID NO: 55021 - DNA, 20 bp, Homo sapiens
gatcagctttaagttggggg

SEQ ID NO: 55022 - DNA, 20 bp, Homo sapiens
gatccagttccagttcccat

SEQ ID NO: 55023 - DNA, 20 bp, Homo sapiens
gatctctgtgttcttgaagg

SEQ ID NO: 55024 - DNA, 20 bp, Homo sapiens
gatcatctgtgcagccccct

SEQ ID NO: 55025 - DNA, 20 bp, Homo sapiens
gatcagtttcagttattgtg

SEQ ID NO: 55026 - DNA, 20 bp, Homo sapiens
gatccaaaaccagtattcta

SEQ ID NO: 55027 - DNA, 20 bp, Homo sapiens
gatcacctgtaaggacaaca

SEQ ID NO: 55028 - DNA, 20 bp, Homo sapiens
gatctccttcacccccaagg

SEQ ID NO: 55029 - DNA, 20 bp, Homo sapiens
gatcccagagctggcagcca

SEQ ID NO: 55030 - DNA, 20 bp, Homo sapiens
gatcgcttccatgctcaggt

SEQ ID NO: 55031 - DNA, 20 bp, Homo sapiens
gatcttcaagaggtgctgtt

SEQ ID NO: 55032 - DNA, 20 bp, Homo sapiens
gatcacagtccagttcggcc

SEQ ID NO: 55033 - DNA, 20 bp, Homo sapiens
gatctcctcttcttcctctt

SEQ ID NO: 55034 - DNA, 20 bp, Homo sapiens
gatccagttgggactaagtg

SEQ ID NO: 55035 - DNA, 20 bp, Homo sapiens
gatcctttacttccaccacc

SEQ ID NO: 55036 - DNA, 20 bp, Homo sapiens
gatcacctaacagagatgga

SEQ ID NO: 55037 - DNA, 20 bp, Homo sapiens
gatcagagggtttgtctgcc

SEQ ID NO: 55038 - DNA, 20 bp, Homo sapiens
gatctaaccttcagtgacaa

SEQ ID NO: 55039 - DNA, 20 bp, Homo sapiens
gatctatgaagtctctgcag

SEQ ID NO: 55040 - DNA, 20 bp, Homo sapiens
gatctgaacccagggtgtca

SEQ ID NO: 55041 - DNA, 20 bp, Homo sapiens
gatctacccatctcatctgc

SEQ ID NO: 55042 - DNA, 20 bp, Homo sapiens
gatccatcaggatgacttct

SEQ ID NO: 55043 - DNA, 20 bp, Homo sapiens
gatcagggactgtgtagttg

SEQ ID NO: 55044 - DNA, 20 bp, Homo sapiens
gatccccccggcctcttcga

SEQ ID NO: 55045 - DNA, 20 bp, Homo sapiens
gatctggtatatttcttact

SEQ ID NO: 55046 - DNA, 20 bp, Homo sapiens
gatcaagtctgccagctaca

SEQ ID NO: 55047 - DNA, 20 bp, Homo sapiens
gatccctcaccagaaggacc

SEQ ID NO: 55048 - DNA, 20 bp, Homo sapiens
gatccaaggtgacagctcca

SEQ ID NO: 55049 - DNA, 20 bp, Homo sapiens
gatctgctcccaacagttga

SEQ ID NO: 55050 - DNA, 20 bp, Homo sapiens
gatcaccctgccatttagtg

SEQ ID NO: 55051 - DNA, 20 bp, Homo sapiens
gatcaaagtggtttctaatc

SEQ ID NO: 55052 - DNA, 20 bp, Homo sapiens
gatcactcccaagacccctg

SEQ ID NO: 55053 - DNA, 20 bp, Homo sapiens
gatctcagcagttgaagctg

SEQ ID NO: 55054 - DNA, 20 bp, Homo sapiens
gatcagcagggcagttgtcg

SEQ ID NO: 55055 - DNA, 20 bp, Homo sapiens
gatccaggggcttccttcag

SEQ ID NO: 55056 - DNA, 20 bp, Homo sapiens
gatcccccatcgcagcacag

SEQ ID NO: 55057 - DNA, 20 bp, Homo sapiens
gatctccgggtgactgacgc

SEQ ID NO: 55058 - DNA, 20 bp, Homo sapiens
gatctttggggtaaaaggag

SEQ ID NO: 55059 - DNA, 20 bp, Homo sapiens
gatcaaaaacaagattcagc

SEQ ID NO: 55060 - DNA, 20 bp, Homo sapiens
gatcaagccgctgctgaaga

SEQ ID NO: 55061 - DNA, 20 bp, Homo sapiens
gatcatcaaggccaaggcaa

SEQ ID NO: 55062 - DNA, 20 bp, Homo sapiens
gatcatccacctgctgctcc

SEQ ID NO: 55063 - DNA, 20 bp, Homo sapiens
gatccagctcagccacgcca

SEQ ID NO: 55064 - DNA, 20 bp, Homo sapiens
gatccctagagcaagagaag

SEQ ID NO: 55065 - DNA, 20 bp, Homo sapiens
gatccgactccatcttcttc

SEQ ID NO: 55066 - DNA, 20 bp, Homo sapiens
gatcctctcaacgagactgt

SEQ ID NO: 55067 - DNA, 20 bp, Homo sapiens
gatcctggccgagtggaagc

SEQ ID NO: 55068 - DNA, 20 bp, Homo sapiens
gatcgagatgaacaagaagc

SEQ ID NO: 55069 - DNA, 20 bp, Homo sapiens
gatcgccctcaagggaggca

SEQ ID NO: 55070 - DNA, 20 bp, Homo sapiens
gatctcctccagctcccgag

SEQ ID NO: 55071 - DNA, 20 bp, Homo sapiens
gatctgacccagctccagtc

SEQ ID NO: 55072 - DNA, 20 bp, Homo sapiens
gatctgctcggcctcgtcca

SEQ ID NO: 55073 - DNA, 20 bp, Homo sapiens
gatcttccagctgaaagctg

SEQ ID NO: 55074 - DNA, 20 bp, Homo sapiens
gatcttgtcaaagtttctct

SEQ ID NO: 55075 - DNA, 20 bp, Homo sapiens
gatcaccaacaacccctacg

SEQ ID NO: 55076 - DNA, 20 bp, Homo sapiens
gatcatccaggccaaccctg

SEQ ID NO: 55077 - DNA, 20 bp, Homo sapiens
gatcatcgatgtcccttttg

SEQ ID NO: 55078 - DNA, 20 bp, Homo sapiens
gatcattgccaagctgacca

SEQ ID NO: 55079 - DNA, 20 bp, Homo sapiens
gatccctggagcaagagaag

SEQ ID NO: 55080 - DNA, 20 bp, Homo sapiens
gatcctctcaatgagactgt

SEQ ID NO: 55081 - DNA, 20 bp, Homo sapiens
gatcgccctcaagggcggca

SEQ ID NO: 55082 - DNA, 20 bp, Homo sapiens
gatctccgacttgactgagc

SEQ ID NO: 55083 - DNA, 20 bp, Homo sapiens
gatctggagctgacactggc

SEQ ID NO: 55084 - DNA, 20 bp, Homo sapiens
gatcttcgatttcaacagct

SEQ ID NO: 55085 - DNA, 20 bp, Homo sapiens
gatcttgtcgaagttcctct

SEQ ID NO: 55086 - DNA, 20 bp, Homo sapiens
gatcatttcatcaatttctt

SEQ ID NO: 55087 - DNA, 20 bp, Homo sapiens
gatcgttcttgtcaatgaag

SEQ ID NO: 55088 - DNA, 20 bp, Homo sapiens
gatctgagagacacctttgc

SEQ ID NO: 55089 - DNA, 20 bp, Homo sapiens
gatcaagattgagttcacac

SEQ ID NO: 55090 - DNA, 20 bp, Homo sapiens
gatcacctacgggcagtgtg

SEQ ID NO: 55091 - DNA, 20 bp, Homo sapiens
gatcttcatctcacacttgg

SEQ ID NO: 55092 - DNA, 20 bp, Homo sapiens
gatcttggaagcatcaaact

SEQ ID NO: 55093 - DNA, 20 bp, Homo sapiens
gatcacctacggccagtgcg

SEQ ID NO: 55094 - DNA, 20 bp, Homo sapiens
gatcccaacaagacaacatg

SEQ ID NO: 55095 - DNA, 20 bp, Homo sapiens
gatcaactatcagcccacac

SEQ ID NO: 55096 - DNA, 20 bp, Homo sapiens
gatcacacattgtgcttttg

SEQ ID NO: 55097 - DNA, 20 bp, Homo sapiens
gatcaaatactaataaacaa

SEQ ID NO: 55098 - DNA, 20 bp, Homo sapiens
gatcccaggtttatgtcctt

SEQ ID NO: 55099 - DNA, 20 bp, Homo sapiens
gatccggagcttttagaggc

SEQ ID NO: 55100 - DNA, 20 bp, Homo sapiens
gatcctcaagtaactgggga

SEQ ID NO: 55101 - DNA, 20 bp, Homo sapiens
gatctgacaaatacacattt

SEQ ID NO: 55102 - DNA, 20 bp, Homo sapiens
gatctgagattgaaattgaa

SEQ ID NO: 55103 - DNA, 20 bp, Homo sapiens
gatctgttagcaatagtagc

SEQ ID NO: 55104 - DNA, 20 bp, Homo sapiens
gatcaaaaaagtcaaggcat

SEQ ID NO: 55105 - DNA, 20 bp, Homo sapiens
gatctagaaacttctactaa

SEQ ID NO: 55106 - DNA, 20 bp, Homo sapiens
gatctcccaaatttgttgtt

SEQ ID NO: 55107 - DNA, 20 bp, Homo sapiens
gatctggtttttccaatgtg

SEQ ID NO: 55108 - DNA, 20 bp, Homo sapiens
gatctttaataacacatccc

SEQ ID NO: 55109 - DNA, 20 bp, Homo sapiens
gatcaatgcagcattcacca

SEQ ID NO: 55110 - DNA, 20 bp, Homo sapiens
gatcgtcatttcttacagca

SEQ ID NO: 55111 - DNA, 20 bp, Homo sapiens
gatcacaactccatggcaac

SEQ ID NO: 55112 - DNA, 20 bp, Homo sapiens
gatcatcccatctaagctgc

SEQ ID NO: 55113 - DNA, 20 bp, Homo sapiens
gatcagctcctccagtggcc

SEQ ID NO: 55114 - DNA, 20 bp, Homo sapiens
gatccatgtctctggaggga

SEQ ID NO: 55115 - DNA, 20 bp, Homo sapiens
gatccccagacagcaccttc

SEQ ID NO: 55116 - DNA, 20 bp, Homo sapiens
gatccggtccatcttcctcc

SEQ ID NO: 55117 - DNA, 20 bp, Homo sapiens
gatcactccagcatatcaga

SEQ ID NO: 55118 - DNA, 20 bp, Homo sapiens
gatcaaacagctgcagtaca

SEQ ID NO: 55119 - DNA, 20 bp, Homo sapiens
gatcagaagtggtacctgtt

SEQ ID NO: 55120 - DNA, 20 bp, Homo sapiens
gatccaacagatgaatacat

SEQ ID NO: 55121 - DNA, 20 bp, Homo sapiens
gatctgcagcttgccacatc

SEQ ID NO: 55122 - DNA, 20 bp, Homo sapiens
gatcattggactatcttctc

SEQ ID NO: 55123 - DNA, 20 bp, Homo sapiens
gatccaatgagttgatttag

SEQ ID NO: 55124 - DNA, 20 bp, Homo sapiens
gatcattgaaaggaacaata

SEQ ID NO: 55125 - DNA, 20 bp, Homo sapiens
gatcttgagtttaggtacat

SEQ ID NO: 55126 - DNA, 20 bp, Homo sapiens
gatcataagaaatatttctt

SEQ ID NO: 55127 - DNA, 20 bp, Homo sapiens
gatccttattgggaataagg

SEQ ID NO: 55128 - DNA, 20 bp, Homo sapiens
gatctatcgaatcatctttg

SEQ ID NO: 55129 - DNA, 20 bp, Homo sapiens
gatctgaagagagaaggagg

SEQ ID NO: 55130 - DNA, 20 bp, Homo sapiens
gatctgcagaaggatatggt

SEQ ID NO: 55131 - DNA, 20 bp, Homo sapiens
gatcaaccaggcagagttct

SEQ ID NO: 55132 - DNA, 20 bp, Homo sapiens
gatctccatgctttgctctc

SEQ ID NO: 55133 - DNA, 20 bp, Homo sapiens
gatcaagttcactgtaaatc

SEQ ID NO: 55134 - DNA, 20 bp, Homo sapiens
gatccattgtgtggtttaat

SEQ ID NO: 55135 - DNA, 20 bp, Homo sapiens
gatctcatcatacaacacca

SEQ ID NO: 55136 - DNA, 20 bp, Homo sapiens
gatcttcaagtctgatggcc

SEQ ID NO: 55137 - DNA, 20 bp, Homo sapiens
gatcttgatgatacagtcgc

SEQ ID NO: 55138 - DNA, 20 bp, Homo sapiens
gatcggttcatgtcctctat

SEQ ID NO: 55139 - DNA, 20 bp, Homo sapiens
gatcgcagctcagaggacac

SEQ ID NO: 55140 - DNA, 20 bp, Homo sapiens
gatctcaattccgatgcttt

SEQ ID NO: 55141 - DNA, 20 bp, Homo sapiens
gatcaactcctcctacaaat

SEQ ID NO: 55142 - DNA, 20 bp, Homo sapiens
gatcagagaaattagagtat

SEQ ID NO: 55143 - DNA, 20 bp, Homo sapiens
gatcatggattagtttcaca

SEQ ID NO: 55144 - DNA, 20 bp, Homo sapiens
gatctgaccactataaatta

SEQ ID NO: 55145 - DNA, 20 bp, Homo sapiens
gatctgggcaacatattgag

SEQ ID NO: 55146 - DNA, 20 bp, Homo sapiens
gatctgtttttctgtgtagt

SEQ ID NO: 55147 - DNA, 20 bp, Homo sapiens
gatctctcttccttgacatt

SEQ ID NO: 55148 - DNA, 20 bp, Homo sapiens
gatcctggcctggcagtggg

SEQ ID NO: 55149 - DNA, 20 bp, Homo sapiens
gatcctcactctccgcaggg

SEQ ID NO: 55150 - DNA, 20 bp, Homo sapiens
gatctccgcctcgagaaaat

SEQ ID NO: 55151 - DNA, 20 bp, Homo sapiens
gatctctgcagatgccatga

SEQ ID NO: 55152 - DNA, 20 bp, Homo sapiens
gatctgcaatctccgtgatg

SEQ ID NO: 55153 - DNA, 20 bp, Homo sapiens
gatcttagattttttcttgg

SEQ ID NO: 55154 - DNA, 20 bp, Homo sapiens
gatctttgaccttcgaggca

SEQ ID NO: 55155 - DNA, 20 bp, Homo sapiens
gatcgttacttggaaatgga

SEQ ID NO: 55156 - DNA, 20 bp, Homo sapiens
gatcaacgataaccagaaag

SEQ ID NO: 55157 - DNA, 20 bp, Homo sapiens
gatcagcgcctgcaactcat

SEQ ID NO: 55158 - DNA, 20 bp, Homo sapiens
gatcagctgagggagaaggc

SEQ ID NO: 55159 - DNA, 20 bp, Homo sapiens
gatccccgatggagagagag

SEQ ID NO: 55160 - DNA, 20 bp, Homo sapiens
gatcctggaggcgtctgctc

SEQ ID NO: 55161 - DNA, 20 bp, Homo sapiens
gatcctgtctttgagagaaa

SEQ ID NO: 55162 - DNA, 20 bp, Homo sapiens
gatcctgtttcggagaacat

SEQ ID NO: 55163 - DNA, 20 bp, Homo sapiens
gatcgagagacgtcgggcag

SEQ ID NO: 55164 - DNA, 20 bp, Homo sapiens
gatcgaggctcactttgaga

SEQ ID NO: 55165 - DNA, 20 bp, Homo sapiens
gatctcatatttctgctgct

SEQ ID NO: 55166 - DNA, 20 bp, Homo sapiens
gatctgctcctcgctcgcac

SEQ ID NO: 55167 - DNA, 20 bp, Homo sapiens
gatctgtcggcagctgctgt

SEQ ID NO: 55168 - DNA, 20 bp, Homo sapiens
gatcttcattcaggtggtca

SEQ ID NO: 55169 - DNA, 20 bp, Homo sapiens
gatcttgggaggcaccaagt

SEQ ID NO: 55170 - DNA, 20 bp, Homo sapiens
gatctttggtgaaggaggcc

SEQ ID NO: 55171 - DNA, 20 bp, Homo sapiens
gatcaaggtcctttccgaca

SEQ ID NO: 55172 - DNA, 20 bp, Homo sapiens
gatccaactcttcctcaacc

SEQ ID NO: 55173 - DNA, 20 bp, Homo sapiens
gatccaactgaaagaggcca

SEQ ID NO: 55174 - DNA, 20 bp, Homo sapiens
gatccaaggcgttctccttg

SEQ ID NO: 55175 - DNA, 20 bp, Homo sapiens
gatcgagctgagcaggcgga

SEQ ID NO: 55176 - DNA, 20 bp, Homo sapiens
gatctcctgaatttccattt

SEQ ID NO: 55177 - DNA, 20 bp, Homo sapiens
gatctcttcctcatatctgt

SEQ ID NO: 55178 - DNA, 20 bp, Homo sapiens
gatcttatacaaatcttcta

SEQ ID NO: 55179 - DNA, 20 bp, Homo sapiens
gatccacaaggcctgcgagg

SEQ ID NO: 55180 - DNA, 20 bp, Homo sapiens
gatcgtcacggagtgtacgg

SEQ ID NO: 55181 - DNA, 20 bp, Homo sapiens
gatcgtagttcctcttaagg

SEQ ID NO: 55182 - DNA, 20 bp, Homo sapiens
gatcttcaaagtatatctcc

SEQ ID NO: 55183 - DNA, 20 bp, Homo sapiens
gatcaaggacattgaaaatc

SEQ ID NO: 55184 - DNA, 20 bp, Homo sapiens
gatcttatcatacctccttc

SEQ ID NO: 55185 - DNA, 20 bp, Homo sapiens
gatcatagcagtgacaatga

SEQ ID NO: 55186 - DNA, 20 bp, Homo sapiens
gatcatctctttattgaggt

SEQ ID NO: 55187 - DNA, 20 bp, Homo sapiens
gatcattctttctgtaccca

SEQ ID NO: 55188 - DNA, 20 bp, Homo sapiens
gatctgagaaattaaggttt

SEQ ID NO: 55189 - DNA, 5821 bp, Homo sapiens
gctttgcccagtagttggaaagtgaactcgactcgtgatggttctcctgtcactttggttgatagcagccgctctggtagaggttaggacttcagctgatggacaagctggtaatgaagaaatggtgcaaatagatttaccaataaagagatatagagagtatgagctggtgactccagtcagcacaaatctagaaggacgctatctctcccatactctttctgcgagtcacaaaaagaggtcagcgagggacgtgtcttccaaccctgagcagttgttctttaacatcacggcatttggaaaagattttcatctgcgactaaagcccaacactcaactagtagctcctggggctgttgtggagtggcatgagacatctctggtgcctgggaatataaccgatcccattaacaaccatcaaccaggaagtgctacgtatagaatccggaaaacagagcctttgcagactaactgtgcttatgttggtgacatcgtggacattccaggaacctctgttgccatcagcaactgtgatggtctggctggaatgataaaaagtgataatgaagagtatttcattgaacccttggaaagaggtaaacagatggaggaagaaaaaggaaggattcatgttgtctacaagagatcagctgtagaacaggctcccatagacatgtccaaagacttccactacagagagtcggacctggaaggccttgatgatctaggtactgtttatggcaacatccaccagcagctgaatgaaacaatgagacgccgcagacacgcgggagaaaacgattacaatatcgaggtactgctgggagtggatgactctgtggtccgtttccatggcaaagagcacgtccaaaactacctcctgaccctaatgaacattgtgaatgaaatttaccatgatgagtccctcggagtgcatataaatgtggtcctggtgcgcatgataatgctgggatatgcaaagtccatcagcctcatagaaaggggaaacccatccagaagcttggagaatgtgtgtcgctgggcgtcccaacagcaaagatctgatctcaaccactctgaacaccatgaccatgcaatttttttaaccaggcaagactttggacctgctggaatgcaaggatatgctccagtcaccggcatgtgtcatccagtgagaagttgtaccctgaatcatgaggatggtttttcatctgcttttgtagtagcccatgaaacgggccatgtgttgggaatggagcatgatggacaaggcaacaggtgtggtgatgagactgctatgggaagtgtcatggctcccttggtacaagcagcattccatcgttaccactggtcccgatgcagtggtcaagaactgaaaagatatatccattcctatgactgtctccttgatgacccttttgatcatgattggcctaaactcccagaacttcctggaatcaattattctatggatgagcaatgtcgttttgattttggtgttggctataaaatgtgcaccgcgttccgaacctttgacccatgtaaacagctgtggtgtagccatcctgataatccctacttttgtaagactaaaaagggacctccacttgatgggactgaatgtgctgctggaaaatggtgctataagggtcattgcatgtggaagaatgctaatcagcaaaaacaagatggcaattgggggtcatggactaaatttggctcctgttctcggacatgtggaactggtgttcgtttcagaacacgccagtgcaataatcccatgcccatcaatggtggtcaggattgtcctggtgttaattttgagtaccagctttgtaacacagaagaatgccaaaaacactttgaggacttcagagcacagcagtgtcagcagcgaaactcccactttgaataccagaataccaaacaccactggttgccatatgaacatcctgaccccaagaaaagatgccacctttactgtcagtccaaggagactggagatgttgcttacatgaaacaactggtgcatgatggaacgcactgttcttacaaagatccatatagcatatgtgtgcgaggagagtgtgtgaaagtgggctgtgataaagaaattggttctaataaggttgaggataagtgtggtgtctgtggaggagataattcccactgccgaaccgtgaaggggacatttaccagaactcccaggaagcttgggtaccttaagatgtttgatataccccctggggctagacatgtgttaatccaagaagacgaggcttctcctcatattcttgctattaagaaccaggctacaggccattatattttaaatggcaaaggggaggaagccaagtcgcggaccttcatagatcttggtgtggagtgggattataacattgaagatgacattgaaagtcttcacaccgatggacctttacatgatcctgttattgttttgattatacctcaagaaaatgatacccgctctagcctgacatataagtacatcatccatgaagactctgtacctacaatcaacagcaacaatgtcatccaggaagaattagatacttttgagtgggctttgaagagctggtctcagtgttccaaaccctgtggtggaggtttccagtacactaaatatggatgccgtaggaaaagtgataataaaatggtccatcgcagcttctgtgaggccaacaaaaagccgaaacctattagacgaatgtgcaatattcaagagtgtacacatccactctgggtagcagaagaatgggaacactgcaccaaaacctgtggaagttctggctatcagcttcgcactgtacgctgccttcagccactccttgatggcaccaaccgctctgtgcacagcaaatactgcatgggtgaccgtcccgagagccgccggccctgtaacagagtgccctgccctgcacagtggaaaacaggaccctggagtgagtgttcagtgacctgcggtgaaggaacggaggtgaggcaggtcctctgcagggctggggaccactgtgatggtgaaaagcctgagtcggtcagagcctgtcaactgcctccttgtaatgatgaaccatgtttgggagacaagtccatattctgtcaaatggaagtgttggcacgatactgctccataccaggttataacaagttatgttgtgagtcctgcagcaagcgcagtagcaccctgccaccaccataccttctagaagctgctgaaactcatgatgatgtcatctctaaccctagtgacctccctagatctctagtgatgcctacatctttggttccttatcattcagagacccctgcaaagaagatgtctttgagtagcatctcttcagtgggaggtccaaatgcatatgctgctttcaggccaaacagtaaacctgatggtgctaatttacgccagaggagtgctcagcaagcaggaagtaagactgtgagactggtcaccgtaccatcctccccacccaccaagagggtccacctcagttcagcttcacaaatggctgctgcttccttctttgcagccagtgattcaataggtgcttcttctcaggcaagaacctcaaagaaagatggaaagatcattgacaacagacgtccgacaagatcatccaccttagaaagatgagaaagtgaaccaaaaaggctagaaaccagaggaaaacctggacaacctctctcttcccatggtgcatatgcttgtttaaagtggaaatctctatagatcgtcagctcattttatctgtaattggaagaacagaaagtgctggctcactttctagttgctttcatcctccttttgttctgcattgactcatttaccagaattcattggaagaaatcaccaaagattattacaaaagaaaaatatgttgctaagattgtgttggtcgctctctgaagcagaaaagggactggaaccaattgtgcatatcagctgactttttgtttgttttagaaaagttacagtaaaaattaaaaagagataccaatggtttacactttaacaagaaattttggatatggaacaaagaattcttagacttgtattcctatttatctatattagaaatattgtatgagcaaatttgcagctgttgtgtaaatactgtatattgcaaaaatcagtattattttaagagatgtgttctcaaatgattgtttactatattacatttctggatgttctaggtgcctgtcgttgagtattgccttgtttgacattctataggttaattttcaaagcagagtattacaaaagagaagttagaattacagctactgacaatataaagggttttgttgaatcaacaatgtgatacgtaaattatagaaaaagaaaagaaacacaaaagctatagatatacagatatcagcttacctattgccttctatacttataatttaaaggattggtgtcttagtacacttgtggtcacagggatcaacgaatagtaaataatgaactcgtgcaagacaaaactgaaaccctctttccaggacctcagtaggcaccgttgaggtgtcctttgtttttgtgtgtgtgtgttcttttttaattttcgcattgttgacagatacaaacagttatactcaatgtactgtaataatcgcaaaggaaaaagttttgggataacttatttgtatgttggtagctgagaaaaatatcatcagtctagaattgatatttgagtatagtagagctttggggctttgaaggcaggttcaagaaagcatatgtcgatggttgagatatttattttccatatggttcatgttcaaatgttcacaaccacaatgcatctgactgcaataatgtgctaataatttatgtcagtagtcaccttgctcacagcaaagccagaaatgctctctccagggagtagatgtaaagtacttgtacatagaattcagaactgaagatatttattaaaagttgattttttttcttgatagtatttttatgtactaaatatttacactaatatcaattacatattttggtaaactagagagacataattagagatgcatgctttgttctgtgcatagagacctttaagcaaactactacagccaactcaaaagctaaaactgaacaaatttgatgttatgcaaacatcttgcatttttagtagttgatattaagttgatgacttgtttcccttcaaggaaacattaaattgtatggactcagctagctgttcaatgaaattgtgaattagaaacatttttaaaagtttttgaaagagataagtgcatcatgaattacatgtacatgagaggagatagtgatatcagcataatgattttgaggtcagtacctgagctgtctaaaaatatattatacaaactaaaatgtagatgaattaacctctcaaagcacagaatgtgcaagaacttttgcattttaatcgttgtaaactaacagcttaaactattgactctatacctctaaagaattgctgctactttgtgcaagaactttgaaggtcaaattaggcaaattccagatagtaaaacaatccctaagccttaagtcttttttttttcctaaaaattcccatagaataaaattctctctagtttacttgtgtgtgcatacatctcatccacaggggaagataaagatggtcacacaaacagtttccataaagatgtacatattcattatacttctgacctttgggctttcttttctactaagctaaaaattcctttttatcaaagtgtacactactgatgctgtttgttgtactgagagcacgtaccaataaaaatgttaacaaaatat

SEQ ID NO: 55190 - DNA, 2654 bp, Homo sapiens
tcatcgtaggaggttccagctcagtgcccagagacagcccccacatcccaccccatcaggtcagctcaggctggagcaggcatatgagcaacacccctcattccacccccatacacatgcataagcccatccgcctgcgccctgccagtctgaccagcacagtcctggggacaggagcgtggtggaggagctgcaggtgggggccagagaagcctccacagagagcaaaagccagggtcagccagagacaggacaccagaagagacaggagatcagagaccagaggaacagagaagaggccccagagcaaggcaaggaacggccaaggcaccaggacatggatgcagtggagccagggggacgtggctgggccagcatgttggcgtgcaggctttggaaagccatcagcagggcgctgtttgcagagttcctggccacggggctgtatgtgttctttggcgtgggctcagtcatgcgctggcccacagcacttccctccgtgctacagattgccatcaccttcaacctggtcaccgccatggctgtgcaggtcacctggaaggccagcggggcccacgccaaccccgccgtgacgctggccttcctcgtaggctcccacatctctctgccccgtgctgtggcctatgtggctgcccagctggtgggggccacggtgggggctgctctgctttatggggtcatgccgggagacatccgagagacccttgggatcaacgtggtccggaacagtgtctcaactggccaggcggtggcagtggagctgcttctgaccctgcagctggtgctctgtgtcttcgcttccaccgacagccgtcagacatcaggctccccggccaccatgattgggatctctgtggcactgggccacctcattgggatccacttcactggctgctccatgaatccagcccgctccttcggccctgccatcatcattgggaagttcacagtccactgggtcttctgggtggggcccctgatgggagccctcctggcctcactgatctacaacttcgtcctgttccccgacaccaagaccctggcgcagcggctggctatcctcacaggcaccgtagaggtggggacaggggcaggggcaggggcggagcccctgaagaaggaatcccagccgggttcgggagccgtggagatggagagtgtgtgaaacagcctacgcctggccgcgcccttgggcttcctgccttgcaggacctgcctggaggttctccctgggggtggcgggagggggaggcttgaccttttgtcctgaccaggtgggctggaggggacaagccctatccctggcattacgtttctaggtagaatctgggagtgaatttgtcccattccctctctgtagggcttccccacctctcggtgggacagagcagaggaaggcaggggatttaggatcgccctcccatcctctcacccactggaccccgtaggagtcctgaccccagatgcccaagtcttgggggagaaaggaatgggagcccagacagccactctgcttagacatgggagctatagggacctcagggagccccagcttcttacccacccaggaaacccttggtccagagaggacaggctttctggaggaatcaggccctgggacagcctctgagctcctgggggtgtttctctgaccttgggtgtggttttgggggctatatttcctccttcagactgggggcttcctgaggacagagactgctctaccaatagatctttgtttgttttgagacagaatcttgatctgttacccaggctggagtgcagtggcatgatctcggctcactgcaacctctacctcctgggttcaagggattctcctgcctcagcctcccaagtagctgggattacaggcgcctgccaccacgcccagctaattttttgtatttttagtagagatggggtttcatcatattggtcagggtggtctcaaactcctgacctgaggcgatctgcccacctcggcctcccaaagtgctgggattacaggcgtgagccaccgtgcccggcctctcccaataggtctttattcctcaatcctccaaatgctctggagaggcccccacccttgagaagaactgacacagagaagaacattttctcaggctcgtagagaggtgggatagaggaagggaggtttgagccagacaggcctttcccagggaagcctcctcccaggtgcttgccccagctcccaccccacagcccactctcaggcaggaacaatcctcagaggggaagtgcccatctagccattgactcatgacctgggtcaaagaagccgtctccaggctctctgtcagcattacaggatccccagaaagctgttgaataagccctaagggtggtaggaacccaggagggacccaggaaactaagatttgagattcagtgcctctgaaagactaccaaaatctaagttggtttaatagttaaaagctgctgtagatttattctgcccacaacttgggggtcctttctggatctcggcttctccagctgtaaaatggacacacaatcctcctccagggactgctgtgaaatcaagaaatcggaaaatactttcagaagttaaaatgctagaaaaacaaccccaataaatgatgattattgtt

SEQ ID NO: 55191 - DNA, 3152 bp, Homo sapiens
ataacgctacctgccgagcaagccgagtggagggaggcaaaggccaggctgaggatcagggtggcccgggtggcagcggggaggcgctgcatgctggaggctgtgctgagtgcccggtgcaggtgagccggtcctgcggagttgtgccgagtgcctgctgcagtctcatttccagttcctccatgacgtggcaagtgaagacaggaatgaaaggaatgtaaagcagcttttctctgaagagaagaagagagagagacacagccaagaccgaggctgggccaagatggtgtctgtgtttcgaagcgaggagatgtgtttgtcacaactgtttctccaggtggaagctgcatattgctgtgtggctgagctcggagagctcggattggttcagttcaaagatttaaatatgaatgtgaacagctttcaaaggaaatttgtgaatgaagtcagaaggtgtgaatcactggagagaatcctccgttttctggaagacgagatgcaaaatgagattgtagttcagttgctcgagaaaagcccactgaccccgctcccacgggaaatgattaccctggagactgttctagaaaaactggaaggagagttacaggaagccaaccagaaccagcaggccttgaaacaaagcttcctagaactgacagaactgaaatacctcctgaagaaaacccaagacttctttgagacggaaaccaatttagctgatgatttctttactgaggacacttctggcctcctggagttgaaagcagtgcctgcatatatgaccggaaagttggggttcatagccggtgtgatcaacagggagaggatggcttcctttgagcggttactgtggcgaatctgccgaggaaacgtgtacttgaagttcagtgagatggacgcccctctggaggatcctgtgacgaaagaagaaattcagaagaacatattcatcatattttaccaaggagagcagctcaggcagaaaatcaagaagatctgtgatgggtttcgagccactgtctacccttgcccagagcctgcggtggagcgcagagagatgttggagagcgtcaatgtgaggctggaagatttaatcaccgtcataacacaaacagagtctcaccgccagcgcctgctgcaggaagccgctgccaactggcactcctggctcatcaaggtgcagaagatgaaagctgtctaccacatcctgaacatgtgcaacatcgacgtcacccagcagtgtgtcatcgccgagatctggttcccggtggcagatgccacacgtatcaagagggcactggagcaaggcatggaactaagtggctcctccatggcccccatcatgaccacagtgcaatctaaaacagcccctcccacatttaacaggaccaataaattcacagctggcttccagaatattgttgatgcctatggtgtcggcagctaccgggagataaacccagccccctacaccatcatcactttccccttcctgttcgctgtgatgtttggagactgtggtcatggaaccgtgatgctcctggctgcactttggatgattctgaatgagagacgcttgctctcccagaagacagacaatgagatttggaacaccttcttccacgggcgctatctgatcctacttatgggcatcttctccatctacacgggtttgatctacaatgactgcttctccaagtccttgaacatctttggctcttcttggagtgtccaacccatgttcagaaacggcacatggaatactcatgtaatggaggaaagtctatatctgcagctggacccagccataccaggagtgtattttggaaatccatacccgtttgggattgatccgatttggaacttggcttcaaacaaactcacatttctgaactcgtataaaatgaagatgtcggtgatcctgggaattgtccagatggttttcggtgtcatcctcagccttttcaatcacatatacttcagaagaactctcaacatcattctgcaatttatccctgagatgatttttatcctgtgtctgtttggatacctggttttcatgatcattttcaaatggtgctgctttgacgtccatgtatctcagcacgcccccagcatcctcatccacttcatcaacatgtttctgtttaactacagtgactcttccaacgcacccctctacaaacatcagcaagaagtccaaagtttctttgtggttatggctttgatttctgtgccgtggatgcttctgattaagccgtttattcttagagccagtcatcggaaatcccagctgcaggcatccaggatccaagaagatgccactgagaacattgaaggtgatagctccagcccttctagccgttctggccagaggacttctgcagatacccacggggctctggacgaccatggagaagagttcaactttggagacgtctttgtccaccaagccatccacaccatcgagtactgcctgggctgcatttcaaacacagcctcctacctgcggctctgggccctcagcctggctcatgcacaactgtctgaagtgctctggactatggtgatgaacagcggccttcagacgcgaggctggggaggaatcgtcggggtttttattatttttgccgtatttgctgtcctgacagtagccatccttctgatcatggagggcctctctgctttcctgcacgccctgcgactgcactgggttgagttccagaacaagttctatgtcggggatggttacaagttttctccattctcctttaaacacatcctggatggcacagccgaggagtaggctgagggctgcacctcccacggtggtcaccatgccaatgaaggaagttcagtcttgtctttgatatcagcccctgcaaggcgctcaatgggaaggttgttcttggctcacctgaagcatgaaactgtgtattatttggacgtcagcctgtggatttgatacgacttaaccacgtcagaggaaggactttggcaagtgatattgtcttcatgtggggtattaattctcaaataataaagtaattgacaaatgaggggagaatgctaaacagatgtcttcttgcaatattttaaatattgtatttgagaaaataaacatctgagtcattcaaaaaaaaaaaaaaaaa

SEQ ID NO: 55192 - DNA, 3049 bp, Homo sapiens
ataacgctacctgccgagcaagccgagtggagggaggcaaaggccaggctgaggatcagggtggcccgggtggcagcggggaggcgctgcatgctggaggctgtgctgagtgcccggtgcaggtgagccggtcctgcggagttgtgccgagtgcctgctgcagaccgaggctgggccaagatggtgtctgtgtttcgaagcgaggagatgtgtttgtcacaactgtttctccaggtggaagctgcatattgctgtgtggctgagctcggagagctcggattggttcagttcaaagatttaaatatgaatgtgaacagctttcaaaggaaatttgtgaatgaagtcagaaggtgtgaatcactggagagaatcctccgttttctggaagacgagatgcaaaatgagattgtagttcagttgctcgagaaaagcccactgaccccgctcccacgggaaatgattaccctggagactgttctagaaaaactggaaggagagttacaggaagccaaccagaaccagcaggccttgaaacaaagcttcctagaactgacagaactgaaatacctcctgaagaaaacccaagacttctttgagacggaaaccaatttagctgatgatttctttactgaggacacttctggcctcctggagttgaaagcagtgcctgcatatatgaccggaaagttggggttcatagccggtgtgatcaacagggagaggatggcttcctttgagcggttactgtggcgaatctgccgaggaaacgtgtacttgaagttcagtgagatggacgcccctctggaggatcctgtgacgaaagaagaaattcagaagaacatattcatcatattttaccaaggagagcagctcaggcagaaaatcaagaagatctgtgatgggtttcgagccactgtctacccttgcccagagcctgcggtggagcgcagagagatgttggagagcgtcaatgtgaggctggaagatttaatcaccgtcataacacaaacagagtctcaccgccagcgcctgctgcaggaagccgctgccaactggcactcctggctcatcaaggtgcagaagatgaaagctgtctaccacatcctgaacatgtgcaacatcgacgtcacccagcagtgtgtcatcgccgagatctggttcccggtggcagatgccacacgtatcaagagggcactggagcaaggcatggaactaagtggctcctccatggcccccatcatgaccacagtgcaatctaaaacagcccctcccacatttaacaggaccaataaattcacagctggcttccagaatattgttgatgcctatggtgtcggcagctaccgggagataaacccagccccctacaccatcatcactttccccttcctgttcgctgtgatgtttggagactgtggtcatggaaccgtgatgctcctggctgcactttggatgattctgaatgagagacgcttgctctcccagaagacagacaatgagatttggaacaccttcttccacgggcgctatctgatcctacttatgggcatcttctccatctacacgggtttgatctacaatgactgcttctccaagtccttgaacatctttggctcttcttggagtgtccaacccatgttcagaaacggcacatggaatactcatgtaatggaggaaagtctatatctgcagctggacccagccataccaggagtgtattttggaaatccatacccgtttgggattgatccgatttggaacttggcttcaaacaaactcacatttctgaactcgtataaaatgaagatgtcggtgatcctgggaattgtccagatggttttcggtgtcatcctcagccttttcaatcacatatacttcagaagaactctcaacatcattctgcaatttatccctgagatgatttttatcctgtgtctgtttggatacctggttttcatgatcattttcaaatggtgctgctttgacgtccatgtatctcagcacgcccccagcatcctcatccacttcatcaacatgtttctgtttaactacagtgactcttccaacgcacccctctacaaacatcagcaagaagtccaaagtttctttgtggttatggctttgatttctgtgccgtggatgcttctgattaagccgtttattcttagagccagtcatcggaaatcccagctgcaggcatccaggatccaagaagatgccactgagaacattgaaggtgatagctccagcccttctagccgttctggccagaggacttctgcagatacccacggggctctggacgaccatggagaagagttcaactttggagacgtctttgtccaccaagccatccacaccatcgagtactgcctgggctgcatttcaaacacagcctcctacctgcggctctgggccctcagcctggctcatgcacaactgtctgaagtgctctggactatggtgatgaacagcggccttcagacgcgaggctggggaggaatcgtcggggtttttattatttttgccgtatttgctgtcctgacagtagccatccttctgatcatggagggcctctctgctttcctgcacgccctgcgactgcactgggttgagttccagaacaagttctatgtcggggatggttacaagttttctccattctcctttaaacacatcctggatggcacagccgaggagtaggctgagggctgcacctcccacggtggtcaccatgccaatgaaggaagttcagtcttgtctttgatatcagcccctgcaaggcgctcaatgggaaggttgttcttggctcacctgaagcatgaaactgtgtattatttggacgtcagcctgtggatttgatacgacttaaccacgtcagaggaaggactttggcaagtgatattgtcttcatgtggggtattaattctcaaataataaagtaattgacaaatgaggggagaatgctaaacagatgtcttcttgcaatattttaaatattgtatttgagaaaataaacatctgagtcattcaaaaaaaaaaaaaaaaa

SEQ ID NO: 55193 - DNA, 3107 bp, Homo sapiens
aacagagctgcctcctggctctttgggagcctgggaggagaaggagccgggaggggcgctgcggggaagccacctgcggattcactggctgctgctccgcccaggactgctagcaagcacggagggctgccagacctggggctccctgctccgtgcgtcaggttggggaaaccaccgtctgccccagaccctgacccaggacccgcctggaggaagctgggaccgaggctgggccaagatggtgtctgtgtttcgaagcgaggagatgtgtttgtcacaactgtttctccaggtggaagctgcatattgctgtgtggctgagctcggagagctcggattggttcagttcaaagatttaaatatgaatgtgaacagctttcaaaggaaatttgtgaatgaagtcagaaggtgtgaatcactggagagaatcctccgttttctggaagacgagatgcaaaatgagattgtagttcagttgctcgagaaaagcccactgaccccgctcccacgggaaatgattaccctggagactgttctagaaaaactggaaggagagttacaggaagccaaccagaaccagcaggccttgaaacaaagcttcctagaactgacagaactgaaatacctcctgaagaaaacccaagacttctttgagacggaaaccaatttagctgatgatttctttactgaggacacttctggcctcctggagttgaaagcagtgcctgcatatatgaccggaaagttggggttcatagccggtgtgatcaacagggagaggatggcttcctttgagcggttactgtggcgaatctgccgaggaaacgtgtacttgaagttcagtgagatggacgcccctctggaggatcctgtgacgaaagaagaaattcagaagaacatattcatcatattttaccaaggagagcagctcaggcagaaaatcaagaagatctgtgatgggtttcgagccactgtctacccttgcccagagcctgcggtggagcgcagagagatgttggagagcgtcaatgtgaggctggaagatttaatcaccgtcataacacaaacagagtctcaccgccagcgcctgctgcaggaagccgctgccaactggcactcctggctcatcaaggtgcagaagatgaaagctgtctaccacatcctgaacatgtgcaacatcgacgtcacccagcagtgtgtcatcgccgagatctggttcccggtggcagatgccacacgtatcaagagggcactggagcaaggcatggaactaagtggctcctccatggcccccatcatgaccacagtgcaatctaaaacagcccctcccacatttaacaggaccaataaattcacagctggcttccagaatattgttgatgcctatggtgtcggcagctaccgggagataaacccagccccctacaccatcatcactttccccttcctgttcgctgtgatgtttggagactgtggtcatggaaccgtgatgctcctggctgcactttggatgattctgaatgagagacgcttgctctcccagaagacagacaatgagatttggaacaccttcttccacgggcgctatctgatcctacttatgggcatcttctccatctacacgggtttgatctacaatgactgcttctccaagtccttgaacatctttggctcttcttggagtgtccaacccatgttcagaaacggcacatggaatactcatgtaatggaggaaagtctatatctgcagctggacccagccataccaggagtgtattttggaaatccatacccgtttgggattgatccgatttggaacttggcttcaaacaaactcacatttctgaactcgtataaaatgaagatgtcggtgatcctgggaattgtccagatggttttcggtgtcatcctcagccttttcaatcacatatacttcagaagaactctcaacatcattctgcaatttatccctgagatgatttttatcctgtgtctgtttggatacctggttttcatgatcattttcaaatggtgctgctttgacgtccatgtatctcagcacgcccccagcatcctcatccacttcatcaacatgtttctgtttaactacagtgactcttccaacgcacccctctacaaacatcagcaagaagtccaaagtttctttgtggttatggctttgatttctgtgccgtggatgcttctgattaagccgtttattcttagagccagtcatcggaaatcccagctgcaggcatccaggatccaagaagatgccactgagaacattgaaggtgatagctccagcccttctagccgttctggccagaggacttctgcagatacccacggggctctggacgaccatggagaagagttcaactttggagacgtctttgtccaccaagccatccacaccatcgagtactgcctgggctgcatttcaaacacagcctcctacctgcggctctgggccctcagcctggctcatgcacaactgtctgaagtgctctggactatggtgatgaacagcggccttcagacgcgaggctggggaggaatcgtcggggtttttattatttttgccgtatttgctgtcctgacagtagccatccttctgatcatggagggcctctctgctttcctgcacgccctgcgactgcactgggttgagttccagaacaagttctatgtcggggatggttacaagttttctccattctcctttaaacacatcctggatggcacagccgaggagtaggctgagggctgcacctcccacggtggtcaccatgccaatgaaggaagttcagtcttgtctttgatatcagcccctgcaaggcgctcaatgggaaggttgttcttggctcacctgaagcatgaaactgtgtattatttggacgtcagcctgtggatttgatacgacttaaccacgtcagaggaaggactttggcaagtgatattgtcttcatgtggggtattaattctcaaataataaagtaattgacaaatgaggggagaatgctaaacagatgtcttcttgcaatattttaaatattgtatttgagaaaataaacatctgagtcattcaaaaaaaaaaaaaaaaa

SEQ ID NO: 55194 - DNA, 2370 bp, Homo sapiens
gcaaatcttcaggggccgtccaggactacagagctgtttcaccctaccttggcttcaatctcttcccccatgctcgaaggtgcggagctgtacttcaacgtggaccatggctacctggagggcctggttcgaggatgcaaggccagcctcctgacccagcaagactatatcaacctggtccagtgtgagaccctagaagacctgaaaattcatctccagactactgattatggtaactttttggctaatcacacaaatcctcttactgtttccaaaattgacactgagatgaggaaaagactatgtggagaatttgagtatttccggaatcattccctggagcccctcagcacatttctcacctatatgacgtgcagttatatgatagacaatgtgattctgctgatgaatggtgcattgcagaaaaaatctgtgaaagaaattctggggaagtgccaccccttgggccgtttcacagaaatggaagctgtcaacattgcagagacaccttcagatctctttaatgccattctgatcgaaacgccattagctccattcttccaagactgcatgtctgaaaatgctctagatgaactgaatattgaattgctacgcaataaactatacaagtcttaccttgaggcattctataaattctgtaagaatcatggtgatgtcacagcagaagttatgtgtcccattcttgagtttgaggccgacagacgtgcttttatcatcactcttaactcctttggcactgaattgagcaaagaagaccgagagaccctctatccaaccttcggcaaactctatcctgaggggttgcggctgttggctcaagcagaagactttgaccagatgaagaacgtagcggatcattacggagtatacaaacctttatttgaagctgtaggtggcagtgggggaaagacattggaggacgtgttttacgagcgtgaggtacaaatgaatgtgctggcattcaacagacagttccactacggtgtgttttatgcatatgtaaagctgaaggaacaggaaattagaaatattgtgtggatagcagaatgtatttcacagaggcatcgaactaaaatcaacagttacattccaattttataacccaagtaaggttctcaaatgtagaaaattataaatgttaaaaggaagttattgaagaaaataaaagaaattatgttatattatctagactacacaaaagtaagccacactatatcttcatgagttgcaaatccatggaaacacagtaaaccagccctgaaacaaagcatttccttgttttcagtggtattagatcttgtttccacatgtctgtctcattcttcactgggccttacaggttagttttaattaactctatggtatttttcttattcttgtttgatcatgttaaaaattggacctaataaaagtattttattcttgcttttccatgcttctctacaggtccaaatactgaatgtctcctttactttttctcttttaaatttttttctagacagggtctcactctgtcacctaggctacagtgcagtggtgtgatcacagctcactgcagcctcgacttcccaggctcaagtgatcctcccagctctcagcctccaaagtagctggcactacaagtgtacacccccacacaaggctaagttttgtattttttgtagagacagggtttcaacatattatccaggctggtgtcgaattcctgggctccagggatccacagtcccccttggcctcccaaagtgttgggattacatgcatgagccactgtgctgggcttcatttacattttaactgtctgttccttgcctagattcacagaaatccaaagctgtatgtagtcaacatggttcacaagtgttggaaaatgtgttttttgttttgttttgttttgtttcgttttgttttgagacagagtttccctctgtcgcccaggctagagtgcaatggcgtgatctcggctcactgcaacctccacctcccagattcaagcaactctctgcctcagcctcccgagtagctgggattacaagcacccaccactacactcagctaattttttgtatttttagtagagccggggtttcaccatcttggccaggctgatcttgaactcctgagctcatgatccacccgcctcagcctcccaaagtgctgggattacaggccccttgttcagccactgcacctggccccttattttgtttttgttttctaatatactttgatgtaatcagcttgagaaagcaacacaatttcaaatcctatcttctagatgcaagcagtgttaaatttgttaataaatttgcttttcacacctttctttaaataaaaggtatatctctc

SEQ ID NO: 55195 - DNA, 645 bp, Homo sapiens
tttataagtagatgcaacacctcatttatacctccttatctcatacagaagagctaagattggcagaaatgatttcacagaagccacttgcttggagcagactaccatgacaagccagtctcaggggatccaccagcttcttcaggcagaaaaacgggccaaggacaagctagaggaagccaagaagagaaaaggaaagcgattgaagcaagccaaggaggaagcaatggtagaaattgaccagtacagaatgcagagagataaagagtttcgactaaaacaatctaagataatgggctctcagaataatctctcagatgaaatagaagaacaaacactagggaagatacaagaacttaatggacactacaataagtatatggaaagtgtgatgaaccagctcttgagcatggtctgtgacatgaaaccagaaatccatgtgaactacagagccaccaactaaatgtacatcacagttttcaagaaaaaaaaaggtgtgtgagtgccacctggttgcttatggcttcgtatttttatgttgagaaatttgaaatgagaaccttaaatttacatttacaggaaatgtgacataactcatacatcggcactgaattaaacaaaacaaaatacaaaaaaaaaaaaaaa

SEQ ID NO: 55196 - DNA, 691 bp, Homo sapiens
tttataagtagatgcaacacctcatttatacctccttatctcatacagaagagctaagattggcagaaatgatttcacagaagccacttgcttggagcagactaccatgacaagccagtctcaggggatccaccagcttcttcaggcagaaaaacgggccaaggacaagctagaggaagccaagaagattctgcatctacttttcctaaaacgaagagactgggactgcttctggaaaaggaaagcgattgaagcaagccaaggaggaagcaatggtagaaattgaccagtacagaatgcagagagataaagagtttcgactaaaacaatctaagataatgggctctcagaataatctctcagatgaaatagaagaacaaacactagggaagatacaagaacttaatggacactacaataagtatatggaaagtgtgatgaaccagctcttgagcatggtctgtgacatgaaaccagaaatccatgtgaactacagagccaccaactaaatgtacatcacagttttcaagaaaaaaaaaggtgtgtgagtgccacctggttgcttatggcttcgtatttttatgttgagaaatttgaaatgagaaccttaaatttacatttacaggaaatgtgacataactcatacatcggcactgaattaaacaaaacaaaatacaaaaaaaaaaaaaaa

SEQ ID NO: 55197 - DNA, 3221 bp, Homo sapiens
atgggctacagtcgtcgtgcggatgacttagctgatagcgggatggatgcattcatggataatgactccctgaaatgggctagcacagacatccactttagcaaagtgtggtgcctacttggagcagcagagtacactgaatacaagtcccttagcagcagaattgcccttggaatttccagaaacatgtactctgcaatctgttgtttggataaaaatgtgttgctgctgctgaagggaaaggcagaagtggggaagacttttttcaaaagggggctcatgaagtttgatgtatgtgaaccatttccttgtgcccggtacgtagccagtactgaggagaaaaagatcatggaggaaacaaatacgcagattgcttggccatcaaaactgaagatcggagccaaatccaagaaagatccccatattaaggtttctggaaagaaagaagatgttaaagaagccaaggaaatgatcatgtctgtcttagacacaaaaagcaatcgagtcacactgaagatggatgtttcacatacagaacattcacatgtaatcggcaaaggtggcaacaatattaaaaaagtgatggaagaaaccggatgccatatccactttccagattccaacaggaataaccaagcagaaaaaagcaaccaggtatctatagcgggacaaccagcaggagtagaatctgcccgagttagaattcgggagctgcttcctttggtgctgatgtttgagctaccaattgctggaattcttcaaccggttcctgatcctaattccccctctattcagcatatatcacaaacgtacaatatttcagtatcatttaaacagcgttcccgaatgtatggtgctactgtcatagtacgagggtctcagaataacactagtgctgtgaaggaaggaactgccatgctgttagaacatcttgctgggagcttagcatcagctattcctgtgagcacacaactagatattgcagctcaacatcatctctttatgatgggtcgaaatgggagcaacatcaaacatatcatgcagagaacaggtgctcagatccactttcctgatcccagtaatccacaaaagaaatctaccgtctacctccagggcaccattgagtctgtctgtcttgcaaggcaatatctcatgggttgtcttcctcttgtgttgatgtttgatatgaaggaagaaattgaagtagatccacaattcattgcgcagttgatggaacagcttgatgtcttcatcagtattaaaccaaagcccaaacagccaagcaagtctgtgattgtgaaaagtgttgagcgaaatgccttaaatatgtatgaagcaaggaaatgtctcctcggacttgaaagcagtggggttaccatagcaaccagtccatccccagcatcctgccctgccggcctggcatgtcccagcctggatatcttagcttcagcaggccttggactcactggactaggtcttttgggacccaccaccttatctctgaacacttcaacaaccccaaactcactcttgaatgctcttaatagctcagtcagtcctttgcaaagtccaagttctggtacacccagccccacattatgggcacccccacttgctaatacttcaagtgccacaggtttttctgctataccacaccttatgattccatctactgcccaagccacattaactaatattttgttgtctggagtgcccacctatgggcacacagctccatctccccctcctggcttgactcctgttgatgtccatatcaacagtatgcagaccgaaggcaaaaaaatctctgctgctttaaatggacatgcacagtctccagatataaaatatggtgcaatatccacttcatcacttggagaaaaagtgctgagtgcaaatcacggggatccgtccatccagacaagtgggtctgagcagacatctcccaaatcaagccccactgaaggttgtaatgatgcttttgttgaagtaggcatgcctcgaagtccttcccattctgggaatgctggtgacttgaaacagatgatgtgtccctccaaggtttcctgtgccaaaaggcagacagtggaactattgcaaggcacgaaaaactcacacttacacagcactgacaggttgctctcagaccctgaactgagtgctaccgaaagccctttggctgacaagaaggctccagggagtgagcgcgctgcagagagggcagcagctgcccagcaaaactccgaaagggcccaccttgctccacggtcatcatatgtcaacatgcaggcatttgactatgaacagaagaagctattagccaccaaagctatgttaaagaaaccagtggtgacggaggtcagaacgcccacaaatacctggagtggcctgggtttttctaaatccatgccagctgaaactatcaaggagttgagaagggccaatcatgtgtcctataagcccacaatgacaaccacttatgagggctcatccatgtccctttcacggtccaacagtcgtgagcacttgggaggtggaagcgaatctgataactggagagaccgaaatggaattggacctggaagtcatagtgaatttgcagcttctattggcagccctaagcgtaaacaaaacaaatcaacggaacactatctcagcagtagcaattacatggactgcatttcctcgctgacaggaagcaatggctgtaacttaaatagctctttcaaaggttctgacctccctgagctcttcagcaaactgggcctgggcaaatacacagatgttttccagcaacaagagatcgatcttcagacattcctcactctcacagatcaggatctgaaggagctgggaataactacttttggtgccaggaggaaaatgctgcttgcaatttcagaactaaataaaaaccgaagaaagctttttgaatcgccaaatgcacgcacctctttcctggaaggtggagcgagtggaaggctaccccgtcagtatcactcagacattgctagtgtcagtggccgctggtagcagcaccctcttggcacatgcccgctgactaactgtaaagtggacacaggagatgtatgaacagccttcacagcacaccatccttagcactctgggtgtctggtatcaggaccaaagcattttattcgcacctgtactttatggcaaaaaggaagaagagagagaagatgttcttatgatgtcataca

SEQ ID NO: 55198 - DNA, 3221 bp, Homo sapiens; identical to SEQ ID NO: 55197

SEQ ID NO: 55199 - DNA, 2480 bp, Homo sapiens
agtgctgggaattgtgggaggagggcccagatcccactggagataccgaaggagatactctttagtattgggatcccagaaaccagtcctatatctggccagagggacactgggttgtggcatctctctagctgctaccgagaaggaacagggccccctggggcctataggccttgcccctgaccctgggaacacgcagctcaggcctgccccagtggccacaagtcagggaggccgcaaatttttaactagaaacattgatcattaatagggggttagaaagagttcaaactaagtctcactctgggacatagaccaattgtgcttcaggcctcctgcagagatgctgggtccccaagtctggtcttctgtgaggcaggggctaagcaggagcttgtccaggaatgtgggggtctgggcctcaggggaggggaagaaggtggacattgcgggtatctacccccctgtgaccacccccttcactgccactgcagaggtggactatgggaaactggaggagaatctgcacaaactgggcaccttccccttccgaggcttcgtggtccagggctccaatggcgagtttcctttcctgaccagcagtgagcgcctcgaggtggtgagccgtgtgcgccaggccatgcccaagaacaggctcctgctagctggctccggatgcgagtccactcaagccacagtggagatgaccgtcagcatggcccaggtcggggctgacgcggccatggtggtgaccccttgctactatcgtggccgcatgagcagtgcggccctcattcaccactacaccaaggttgctgatctctctccaatccctgtggtgctgtacagtgtcccagccaacacagggctggacctgcctgtggatgcagtggtcacgctttcccagcacccgaatattgtgggcatgaaggacagcggtggtgatgtgaccaggattgggctgattgttcacaagaccaggaagcaggattttcaggtgttggctggatcggctggctttctgatggccagctatgccttgggagctgtggggggcgtctgcgccctggccaatgtcctgggggctcaggtgtgccagctggagcgactgtgctgcacggggcaatgggaagatgcccagaaactgcagcaccgcctcattgagccaaacgctgcggtgacccggcgctttgggatcccagggctgaagaaaatcatggactggtttggctactatggaggcccctgccgcgcacccttgcaggagctgagccccgctgaggaggaggcactgcgcatggatttcaccagcaacggctggctctgagggcaggcagggtccatggctggcctgagcccatctcagcctcctgccttgcacttgcagcctgaagcggagagcacagggggatgagggtggcaggcagcggggagccgatagaggctcctttgcctgctgtggtcctccaggcagcctttcacaggcacgcccatgcatatctcctattctaacggcccctgacctctcccttttggatcctaaactgtgtctctggtctgaagactgggaaggagcaatttctcaatttatctttctactgtggatgctttcctacgccctgaggcacatgaagtcagaaaggaagggcagaggggcaagtaggcacagtaagggaattttcttttcttttttttttttttttgagacagagtttcactctgtcacccaggctggagtgcaatggcatgatctcgcctcctgggttcaagcgattctcctgcctcagcctcccgagtagctgggattacaggcgcctgccaccacgcccagctaatttttgtatttttagcagagatggggtttcaccgtgttggccaggctggtcttgaactcctgacctcaggtgatccaactgcctcggcctcccaaagtgctgggattacagctgtgagccactgcacccggccgggaatttatcaaaggggggactacttagatttggggcttcaaacctgagtctagcacaatgcagctggaggccagggctactcctacaaacccaagttctgactccttccagggaagtatcagcttaagaaacttgatcaggaaagtgacactggtctttcaaagagccctctttaccctcccatccctgccctctacactgcaagctgcattccagccacaacgcccttttctaaatctattttcattcatctcctattctggtctgtagccttgattccaaccattgaatgcacggagacagcccagtggcttgtcagattggtaaataatgacacctggtggataaatgttacattctagaagactattctggtcagcctaggtctgaaacactaaggagacttggcctgagatagggccatccacttgcctacaggcactctgcttttattattaaaaatagtcactttgttactataataaaatttaacagaaaaaaaaaaaaaaa

SEQ ID NO: 55200 - DNA, 2708 bp, Homo sapiens
agattagcagggtgactttcaccctgcaacagtcacgctggagtactctggtgaaggatcaagaatattaccagttttctgatgaagaaaggaatatatttggtcaccagcaatctgcctttgaccatcctcaaagccaagtttttcatcgctgtctagaaaaatacttcattcagaggacacatatgtcctctttgaatgtctcctttttgggagcagtaggagaaagaaacttcaagatgtagaaagaattaatagtgtaacggaaagaaagaaggcaaaaggaagtaaatgtggaggccatagaaatagtaataagaataaagaagaaaaacaggaaagaagagggaaaagccatagaaaataacagccagagcgagtaggaggagacagagagaacgagagagagaaaagctgataaattcctgagaaaagtttctcttcttaagaattctaggtcaagaagtaaaatatggcacagagcattgaaaggaggcaacggatgcccagtgcaagattctgaagaagcaggaattcagcccgatgggagtccgagttcatgtcgtggcggcctcagccctgctgtatttcatcctgttgcctgaccacagactgggtacatctctggtatatatggttgctagtggtaattggcgcgctgcttctcctgtgtggcctgacgtccctgtgcttccgctgctgctgtctgagccgccagcaaaatggggaagatgggggcccaccaccctgtgaagtgaccgtcattgctttcgatcacgacagcactctccagagcactatcacatctctgcagtcggtgtttggccctgcagctcggaggatcctggctgtggctcactcccacagctccctgggccagctgccctcctctttggacaccctcccagggtatgaagaagctcttcacatgagtcgcttcacagtagccatgtgcgggcagaaagcacctgatctacccccagtacctgaagaaaagcagctgcctccaacagagaaggagtcgactcgaatagttgactcttggaactgatgagagctgtcattttataaataggagtggagtgatgtccagagtctgtgggaaaatggaacacatattttctaaccctcagaagttttaagatggcatctaacaccatcattctatgggaaagatggttcttactcttcgttcacaggcctttatatcttccgatacagaatgctctaattgggaactctaattttgtatccaatggccaaaatctgcaagtaatctctagccacactgattactactaaaccaggaaagcatcaaggtatcttgaattcctttaactattgagtgcatatagaattcctgtacccacatgatactgcaagttgtgtctctctctgtcagctaatccactgcggttaactggaaaagaaagacaacagtgtcagcacagccatcgacattaatgcactgaatgcatgcatctttcctcctgagacagcaatcgattttacaccgaatgacaatgatcatcttagacagcacaacatacccactcggatatctaaaagctagggatggcattgctgatatgggcaaagagaacacagtatagtatttaagtgccaaatatcagtctttctttctctctggtcctacccctcagcagtatgaaaaactccatactgtgcagtcacagttggattaattcttcagttcctccgcactgcaaacacatatatgtgcgcacatgcatgtatacctgcaccctgttttaactctaaaggaatagtgttgctttacttctttcctgttttgcctggaccacttaaagccacaacacctctatagtgacacacgctagtctctagtggtggccctcactgccacctagaggagccatggtggaaaacacactctctcctttgagcctatctgcacatctctcgagttcttggagcaaaaactaaatgctgaactaagcctggttgagatgcttcccatggaccatgccgcagcacagtgctaatctatccacaaaacataccacctcccaaagtattattattggaaaatcgaggaagtgacgcacatttagggaaaaactactcaccttagaaaagtcactgaaatccttttttttttttttgagatggagttttgctcttgtagcccaggctgggatgcaatggcatggtctcagctcactgtaacctccacctcccggattcaagcaattcttctgcctcagcttcccgactagctgggattacagctgcctgccaccgtgcccagctaatttttgtatttttagtggagagggggtttcaccatgttggccagtctggtctagaactcctgacgtcaggtgatccgcccaccttggcctcccaaagtgctggaattagaggcctgaccccctgctcctggcctgaaatctttaaagccgttttttccctaaaaaacgggaaataataacacctcagaaggtttttgtgaagatcaaagaagctaaatatatgtggcatgatttgtaaagtgttatgcatatgtatgttattcttcctactgtcttctaaccttcccttgcctgctatgacttatctgagagccatgttcccatttatctttttgccaactatgttactgttgtcacacctgaaatggctttgtttttatcaataaatacttgttgattgtggtaaacagc

SEQ ID NO: 55201 - DNA, 1523 bp, Homo sapiens
tccggctcccgcagagcccacagggacctgcagatctgagtgccctgcccacccccgcccgccttccttcccccaccacgcctgggagggccctcactggggaggtggccgagaacgggtctggcctggggtgttcagatgctcacagcatggaaaagtccatctggctgctggcctgcttggcgtgggttctcccgacaggctcatttgtgagaactaaaatagatactacggagaacttgctcaacacagaggtgcacagctcgccagcgcagcgctggtccatgcaggtgccacccgaggtgagcgcggaggcaggcgacgcggcagtgctgccctgcaccttcacgcacccgcaccgccactacgacgggccgctgacggccatctggcgcgcgggcgagccctatgcgggcccgcaggtgttccgctgcgctgcggcgcggggcagcgagctctgccagacggcgctgagcctgcacggccgcttccggctgctgggcaacccgcgccgcaacgacctctcgctgcgcgtcgagcgcctcgccctggctgacgaccgccgctacttctgccgcgtcgagttcgccggcgacgtccatgaccgctacgagagccgccacggcgtccggctgcacgtgacagccgcgccgcggatcgtcaacatctcggtgctgcccagtccggctcacgccttccgcgcgctctgcactgccgaaggggagccgccgcccgccctcgcctggtccggcccggccctgggcaacagcttggcagccgtgcggagcccgcgtgagggtcacggccacctagtgaccgccgaactgcccgcactgacccatgacggccgctacacgtgtacggccgccaacagcctgggccgctccgaggccagcgtctacctgttccgcttccatggcgccagcggggcctcgacggtcgccctcctgctcggcgctctcggcttcaaggcgctgctgctgctcggggtcctggccgcccgcgctgcccgccgccgcccagagcatctggacaccccggacaccccaccacggtcccaggcccaggagtccaattatgaaaatttgagccagatgaacccccggagcccaccagccaccatgtgctcaccgtgaggagtccctcagccaccaacatccatttcagcactgtaaagaacaaaggccagtgcgaggcttggctggcacagccagtcctggttctcgggcaccttggcagcccccagctgggtggctcctcccctgctcaaggtcaagaccctgctcaaggaggctcatctggcctcctatgtggacaaccatttcggagctccctgatatttttgccagcatttcgtaaatgtgcatacgtctgtgtgtgtgtgtgtgtgtgagagagagagagagagagtacacgcattagcttgagcgtgaaacttccagaaatgttcccttgccctttcttacctagaacacctgctatagtaaagcagacaggaaactgttaaaaaaaaaaaaaaaaaa

SEQ ID NO: 55202 - DNA, 1686 bp, Homo sapiens
ccacgcgtccgggcgtaagccaggcgtgttaaagccggtcggaactgctccggagggcacgggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagtctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgtttttttttttaaaa

SEQ ID NO: 55203 - DNA, 2163 bp, Homo sapiens
cggcagccacagcaggaggactgacaggggcctgatggaggagtttgtggggctgcgtgaaggctcctcagggaaccctgtgactctgcaggagctgtggggcccctgtcccctcatccgccgaggcatccgaggtggcctggagtggctgaagcagaagctcttccgcctgggcgaggactggtacttcctgatgaccctcggggtgctcatggccctggtcagctgtgccatggacttggctgttgagagtgtggtccgagcgcaccagtggctgtacagggagattggggacagccacctgctccggtatctctcctggactgtgtaccctgtggccctcgtctctttctcttcgggcttctctcagagcatcacaccctcctctggaggttctggaatcccggaggtgaagaccatgttggcgggtgtggtcttggaggactacctggatatcaagaactttggggccaaagtggtgggcctctcctgcaccctggcctgtggcagcaccctcttcctcggcaaagtgggccctttcgtgcacctgtctgtgatgatggctgcctacctgggccgtgtgcgcaccacgaccatcggggagcctgagaacaagagcaagcaaaacgaaatgctggtggcagcggcggcagtgggcgtggccacagtctttggcgctcccttcagcggcgtcctgttcagcatcgaggtcatgtcttcccacttctctgtctgggattactggaggggcttctttgcggccacctgcggggccttcatgttccggctcctggcggtcttcaacagcgagcaggagaccatcacctccctctacaagaccagtttccgggtggacgttcccttcgacctgcctgagatcttcttttttgtggtgctggggggtctctgcggcatcctgggcagcgcttacctcttctgtcagcgaatcttctttggcttcatcaggaacaataggttcagctccaaactgctggccaccagcaagcctgtgtactccgctctggccaccttggttctcgcctccatcacctacccacccagcgccggccgcttcctagcttctcggctgtccatgaagcagcatctggactcgctgttcgacaaccactcctgggcgctgatgacccagaactccagcccaccctggcccgaggagctcgacccccagcacctgtggtgggaatggtaccacccgcggttcaccatctttgggacccttgccttcttcctggttatgaagttctggatgctgattctggccaccaccatccccatgcctgccgggtacttcatgcccatctttgtctatggagctgctatcgggcgcctctttggggagactctctcttttatcttccctgagggcatcgtggctggagggatcaccaatcccatcatgccaggggggtatgctctggcaggggctgcagccttctcaggggctgtgacccacaccatctccacggcgctgctggccttcgaggtgaccggccagatagtgcatgcactgcccgtgctgatggcggtgctggcagccaacgccattgcacagagctgccagccctccttctatgatggcaccgtcattgtcaagaagctgccatacctgccacggattctgggccgcaacatcggttcccaccgcgtgagggtggagcacttcatgaaccacagcatcaccacactggccaaggacacgccactggaggaggtggtcaaggttgtgacctccacagacgtggccgagtatcccttggtggagagcacagagtcccagatcctggtgggcatagtgcgaagggcccagctggtgcaggccctgaaggctgagcctccttcctgggctcctggacaccagcagtgtctccaggacatcttggctgcaggctgccccacagaaccagtgaccctgaagctgtccccagagacttccctgcatgaggcacacaacctctttgagctgttgaaccttcattccctctttgtgacgtcgcggggcagagctgtgggctgcgtgtcctgggtggagatgaagaaagcaatttccaacctgacaaatccgccagccccaaagtgagccggcccagcaagatgaaacagggcaccccagctgccctggtactgaggttgggctgagaccct

SEQ ID NO: 55204 - DNA, 1363 bp, Homo sapiens
atctccttcgcagtgcagctccttcaacctcgccatggcctctgccggaatgcagatcctgggagtcgtcctgacactgctgggctgggtgaatggcctggtctcctgtgccctgcccatgtggaaggtgaccgctttcatcggcaacagcatcgtggtggcccaggtggtgtgggagggcctgtggatgtcctgcgtggtgcagagcaccggccagatgcagtgcaaggtgtacgactcactgctggcgctgccacaggacctgcaggctgcacgtgccctctgtgtcatcgccctccttgtggccctgttcggcttgctggtctaccttgctggggccaagtgtaccacctgtgtggaggagaaggattccaaggcccgcctggtgctcacctctgggattgtctttgtcatctcaggggtcctgacgctaatccccgtgtgctggacggcgcatgccgtcatccgggacttctataaccccctggtggctgaggcccaaaagcgggagctgggggcctccctctacttgggctgggcggcctcaggccttttgttgctgggtggggggttgctgtgctgcacttgcccctcgggggggtcccagggccccagccattacatggcccgctactcaacatctgcccctgccatctctcgggggccctctgagtaccctaccaagaattacgtctgacgtggaggggaatgggggctccgctggcgctagagccatccagaagtggcagtgcccaacagctttgggatgggttcgtaccttttgtttctgcctcctgctatttttcttttgactgaggatatttaaaattcatttgaaaactgagccaaggtgttgactcagactctcacttaggctctgctgtttctcacccttggatgatggagccaaagaggggatgctttgagattctggatcttgacatgcccatcttagaagccagtcaagctatggaactaatgcggaggctgcttgctgtgctggctttgcaacaagacagactgtccccaagagttcctgctgctgctgggggctgggcttccctagatgtcactggacagctgccccccatcctactcaggtctctggagctcctctcttcacccctggaaaaacaaatgatctgttaacaaaggactgcccacctccggaacttctgacctctgtttcctccgtcctgataagacgtccaccccccagggccaggtcccagctatgtagacccccgcccccacctccaacactgcacccttctgccctgcccccctcgtctcaccccctttacactcacatttttatcaaataaagcatgttttgttagtgcaaaaaaaaaaaaaaaaaaaa

SEQ ID NO: 55205 - DNA, 3118 bp, Homo sapiens
gcgcgcccgccagccaggctctccgcgcccgccgcccgcgccgcgctggcccgggctctcccgcccgcgcttcatggctgcacacgagtgggactggttccaacgcgaggagctcatcgggcagattagcgacatccgagtgcagaacctgcaagttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgctgcacgaatacaaatcctcgtcgcatcgtatttttcggttgaacaacatagcgaaagcacttaagtttttggaagatagcaatgtaaaactggttagcattgatgcagcagaaatagcagatggcaacccttctttggttcttgggctgatatggaacataatcctcttcttccagattaaggagctcacaggcaacctcagcagaaactctccatcttccagcttgtcccctggctcagggggcacagactcagactcatccttcccacccacacccactgcagagaggagcgtggcaatatcggtgaaagaccagaggaaggctatcaaggccctgttggcgtgggtgcagaggaaaacgagaaagtatggcgtggcggtgcaggactttgcgggcagttggaggagtgggctggctttcctggcggtgatcaaggccattgaccccagcctggtggacatgaaacaggccctggaaaattccacacgagaaaatctagagaaggctttcagcatcgcacaggatgccctgcacatccccaggctcctggagccagaagacatcatggttgacacaccagacgagcagtctatcatgacttacgtggcacagtttctagaacgttttccggagttggaagccgaagatattttcgattcagataaagaagttcctatcgaatccacttttgttcgcatcaaagaaactccttctgaacaggagagcaaagtcttcgttctgactgaaaatggggagcgtacctacactgttaaccatgaaaccagccacccaccaccctccaaagtctttgtctgtgacaagcccgagagcatgaaggaattccgcctggatggtgtttccagccatgcgctgtcagacagctccaccgagttcatgcaccagattattgaccaggtcctgcaagggggcccaggtaagaccagcgacatcagtgagccatctccagaatcctccattttatcatccagaaaggagaacgggaggtccaactctttgccgatcaagaaaacagttcactttgaggctgacacctacaaggatcctttctgcagtaagaacctgtccctttgctttgaagggagcccaagagtggcaaaggaatcattgaggcaggatggacatgtcttggcagttgaggttgctgaggaaaaggaacagaaacaggaatcctcgaagattccagaatcctcctctgacaaggtcgctggtgacatttttttggtggagggcacaaacaataattctcagtcttcttcctgtaatggtgctttagagagtacagcccgccacgatgaagaaagtcactctctttcacccccaggagaaaatactgtgatggccgattccttccagatcaaggttaacctgatgactgtagaagctttagaggagggagactattttgaagccatcccattaaaagcctcaaaatttaacagcgacctaatagattttgcttctaccagccaggctttcaacaaagttccttcacctcatgagacaaaacctgacgaggatgctgaggcttttgagaatcatgctgaaaaactaggtaaaaggagtattaaatctgctcacaaaaagaaggattcgccagagcctcaagttaagatggacaaacatgaacctcatcaggactccggagaagaagctgaaggctgtccttcagccccagaagagacaccagtggataaaaagccagaggtgcatgaaaaggccaagagaaagtccacccgtcctcattatgaggaagagggagaagacgatgacctccagggtgtgggcgaggaattatcttccagccccccaagcagctgtgtcagcttggagacccttgggagtcacagcgaagaaggcctggatttcaagccctccccacccctctcaaaggtttccgtcattccccacgacctcttctatttcccacactatgaggttcccctggctgcagttttggaggcttatgtagaagacccggaggatctaaaaaatgaagaaatggatctcgaagagccagagggctatatgccagacctggactccagggaggaggaggccgatggctctcagagcagctccagttcctcggtgccaggagagagcctccccagtgccagcgaccaggtgctgtatctcagcaggggtggtgtgggtaccacaccagcctcagaacccgctccactggccccccatgaggaccaccagcaaagggagaccaaagagaatgaccccatggacagccatcagtcccaggaatccccaaacctggaaaacatagcaaaccccctagaagaaaatgtaacgaaagaatcaatcagtagtaaaaaaaaggaaaaaaggaaacatgtggaccacgtagaaagttcactatttgtagcaccaggaagtgttcaatcctcagatgacctagaagaagacagtagcgactacagcattccttccaggactagtcacagtgactccagcatttaccttcgacgacatactcataggtcttcggaatcggatcattttagctatgttcagttgaggaacgcagcagatctggatgacagaagaaaccgaatattaaccaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctg

SEQ ID NO: 55206 - DNA, 2657 bp, Homo sapiens
gcgcccggcaggcgttcagggaagcgcggccacgcctgggccggccaccatttcccgggcgccgcggcggcgccgactcgcgggcagcggcccctcagtgcgcccagccgggcccccgaacgccgggagcatgagcgcgggctcggagcgcggggcggcggcaacccccgggggtttgcccgcgccctgcgcctcgaaggtggagctgcggctcagctgccggcacctgctggaccgcgacccgctcaccaagtccgaccccagcgtggcgttgctgcagcaggcgcagggccagtgggtgcaggtgggcagaaccgaggtggtccggagcagcctgcatcccgtgttctccaaggtcttcacggtggactactacttcgaggaggtgcagaggctgcgctttgaggtgtacgacacgcatgggcccagcggcttcagctgtcaggaggacgatttcctggggggcatggagtgcaccctggggcagccagcccaaaagtggcttctgcaagtcgtgatgagagtgtctgttgatgtgctgggccctgctggacactgcgctaagcacttcctgtgctgcacggaatcctcacaccttgccaggacgggtccttcttttttattgaggtatgatgacctctgcctcccctgggcgactgctggcgccgtgaggtggtggacgtgcaggggtggccacacgcagggatggcagattgtggcccagaagaaggtgacccgcccgctgctgctcaagtttggcaggaacgctggcaagtccaccatcacggtgatcgccgaggacatctcggggaacaacggctacgtggagctctccttccgggccaggaagctggacgacaaggacctcttcagcaagtccgaccccttcctggagctctacagggtcaacgacgaccagggcttgcagctggtgtacaggacggaggtggtgaagaacaacctgaacccggtgtgggaggccttcaaagtctctctgagttccctctgcagctgcgaggagacaaggcctctaaagtgcctggtctgggattacgactctcgaggaaagcacgacttcatcggagaattctctaccaccttcgaggagatgcagaaggcctttgaggaggggcaggcccagtgggactgtgtgaaccccaaatacaagcagaagagacgcagttataagaactcaggagtggtcgtcctggctgacctcaagttccacagggtgtactccttcctggactatatcatgggcggctgccagatccacttcaccgtggccattgacttcaccgcctccaatggagacccgcggaacagctgctccctgcactacatcaacccctaccagccgaacgagtacctgaaggcactggtgtccgtgggcgagatctgccaggactatgacagtgacaagaggttttccgctttggggtttggagcccggatccctcccaagtatgaggtgtcccatgactttgccatcaatttcaaccctgaggacgatgagtgtgaaggcatccagggcgtggtggaggcctaccagaactgcctgcccagggtccagctctacggccccaccaacgtggcgcccatcatctccaaggtggcacgcgtggcggcggccgaggagagcaccgggaaagcctctcaatactacatcctgctgatcctgacggacggcgtggtgaccgacatggccgacacacgggaggccattgtgcgtgcctcacgcctgcccatgtccatcatcatcgtgggcgtgggcaacgccgacttcaccgacatgcaggtcctggacggcgacgacggcgtcctgcgctccccacggggtgagcccgcgctccgggacatcgtacagttcgtgcccttccgggagctcaagaacgcatcccctgcggcgctggccaagtgcgtgctggccgaggtcccgaagcaggtggtggagtactacagccacagaggcctgcccccgagaagcctgggcgtccctgccggagaggccagcccaggctgcacaccgtgaagatgtggagggcgtagggtgggggcagtgaggaatgggtccgtacagcctctgtctgcaacatgcttggggtcccttaagctccctccgacctcccagaagcctccagtccccaccaggccccactcccagtcctcctgggatcctgctggcttgggcccggctctggggcccccaaggccgaagggtgacaaaatacaggcccccatgcctggccctgcctgagccaggtgggtggagggagggagatcatgagggacttggagggagctgggagttcatccacgggagaccctgccccgatgagaaggggcagggactgggggctctgctttgcgtctaacctttgtgggggagggccagcaaggcagtccccccacgcccgagaaagcctgggggacccagacacctgtccccacagtcaaagcctggggacccagacatcctgtccccacagtcagcctcctgtccctgctggtgcccccacacccacctaccctgtgctttttgccgtcgggcctctgcacctgggtccatggggtctgcggggtctgcggggtctgcctggcctgtgggttctgccggtggggcttcaggagtaataaagtgtcaccctatccttgta

SEQ ID NO: 55207 - DNA, 2470 bp, Homo sapiens
gcgcccggcaggcgttcagggaagcgcggccacgcctgggccggccaccatttcccgggcgccgcggcggcgccgactcgcgggcagcggcccctcagtgcgcccagccgggcccccgaacgccgggagcatgagcgcgggctcggagcgcggggcggcggcaacccccgggggtttgcccgcgccctgcgcctcgaaggtggagctgcggctcagctgccggcacctgctggaccgcgacccgctcaccaagtccgaccccagcgtggcgttgctgcagcaggcgcagggccagtgggtgcaggtgggcagaaccgaggtggtccggagcagcctgcatcccgtgttctccaaggtcttcacggtggactactacttcgaggaggtgcagaggctgcgctttgaggtgtacgacacgcatgggcccagcggcttcagctgtcaggaggacgatttcctggggggcatggagtgcaccctggggcagattgtggcccagaagaaggtgacccgcccgctgctgctcaagtttggcaggaacgctggcaagtccaccatcacggtgatcgccgaggacatctcggggaacaacggctacgtggagctctccttccgggccaggaagctggacgacaaggacctcttcagcaagtccgaccccttcctggagctctacagggtcaacgacgaccagggcttgcagctggtgtacaggacggaggtggtgaagaacaacctgaacccggtgtgggaggccttcaaagtctctctgagttccctctgcagctgcgaggagacaaggcctctaaagtgcctggtctgggattacgactctcgaggaaagcacgacttcatcggagaattctctaccaccttcgaggagatgcagaaggcctttgaggaggggcaggcccagtgggactgtgtgaaccccaaatacaagcagaagagacgcagttataagaactcaggagtggtcgtcctggctgacctcaagttccacagggtgtactccttcctggactatatcatgggcggctgccagatccacttcaccgtggccattgacttcaccgcctccaatggagacccgcggaacagctgctccctgcactacatcaacccctaccagccgaacgagtacctgaaggcactggtgtccgtgggcgagatctgccaggactatgacagtgacaagaggttttccgctttggggtttggagcccggatccctcccaagtatgaggtgtcccatgactttgccatcaatttcaaccctgaggacgatgagtgtgaaggcatccagggcgtggtggaggcctaccagaactgcctgcccagggtccagctctacggccccaccaacgtggcgcccatcatctccaaggtggcacgcgtggcggcggccgaggagagcaccgggaaagcctctcaatactacatcctgctgatcctgacggacggcgtggtgaccgacatggccgacacacgggaggccattgtgcgtgcctcacgcctgcccatgtccatcatcatcgtgggcgtgggcaacgccgacttcaccgacatgcaggtcctggacggcgacgacggcgtcctgcgctccccacggggtgagcccgcgctccgggacatcgtacagttcgtgcccttccgggagctcaagaacgcatcccctgcggcgctggccaagtgcgtgctggccgaggtcccgaagcaggtggtggagtactacagccacagaggcctgcccccgagaagcctgggcgtccctgccggagaggccagcccaggctgcacaccgtgaagatgtggagggcgtagggtgggggcagtgaggaatgggtccgtacagcctctgtctgcaacatgcttggggtcccttaagctccctccgacctcccagaagcctccagtccccaccaggccccactcccagtcctcctgggatcctgctggcttgggcccggctctggggcccccaaggccgaagggtgacaaaatacaggcccccatgcctggccctgcctgagccaggtgggtggagggagggagatcatgagggacttggagggagctgggagttcatccacgggagaccctgccccgatgagaaggggcagggactgggggctctgctttgcgtctaacctttgtgggggagggccagcaaggcagtccccccacgcccgagaaagcctgggggacccagacacctgtccccacagtcaaagcctggggacccagacatcctgtccccacagtcagcctcctgtccctgctggtgcccccacacccacctaccctgtgctttttgccgtcgggcctctgcacctgggtccatggggtctgcctggcctgtgggttctgccggtggggcttcaggagtaataaagtgtcaccctatccttgtaaaaaaaaaaaaaaaaaaaaaaaaaaaaaaaaaaaaaaaaaaaaaaaaaaaaaaaaa

SEQ ID NO: 55208 - DNA, 1114 bp, Homo sapiens
acactgcgctgcccagaggccccgctgactcctgccagcctccaggtccccgtggtaccaaagctgaacatggacgtgaccatccagcacccctggttcaagcgcaccctggggcccttctaccccagccggctgttcgaccagtttttcggcgagggcctttttgagtatgacctgctgcccttcctgtcgtccaccatcagcccctactaccgccagtccctcttccgcaccgtgctggactccggcatctctgaggttcgatccgaccgggacaagttcgtcatcttcctcgatgtgaagcacttctccccggaggacctcaccgtgaaggtgcaggacgactttgtggagatccacggaaagcacaacgagcgccaggacgaccacggctacatttcccgtgagttccaccgccgctaccgcctgccgtccaacgtggaccagtcggccctctcttgctccctgtctgccgatggcatgctgaccttctgtggccccaagatccagactggcctggatgccacccacgccgagcgagccatccccgtgtcgcgggaggagaagcccacctcggctccctcgtcctaagcaggcattgcctcggctggctcccctgcagccctggcccatcatggggggagcaccctgagggcggggtgtctgtcttcctttgcttcccttttttcctttccaccttctcacatggaatgagggtttgagagagcagccaggagagcttagggtctcagggtgtcccagaccccgacaccggccagtggcggaagtgaccgcacctcacactcctttagatagcagcctggctcccctggggtgcaggcgcctcaactctgctgagggtccagaaggagggggtgacctccggccaggtgcctcctgacacacctgcagcctccctccgcggcgggccctgcccacacctcctggggcgcgtgaggcccgtggggccggggcttctgtgcacctgggctctcgcggcctcttctctcagaccgtcttcctccaacccctctatgtagtgccgctcttggggacatgggtcgcccatgagagcgcagcccgcggcaatcaataaacagcaggtgatacaagc

SEQ ID NO: 55209 - DNA, 2205 bp, Homo sapiens
gcgcacgccggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgcccagtactacggggagattggcatcgggacgcccccccagtgcttcacagtcgtcttcgacacgggctcctccaacctgtgggtcccctccatccactgcaaactgctggacatcgcttgctggatccaccacaagtacaacagcgacaagtccagcacctacgtgaagaatggtacctcgtttgacatccactatggctcgggcagcctctccgggtacctgagccaggacactgtgtcggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcagggacccagatgcgcagcctgggggtgagctgatgctgggtggcacagactccaagtattacaagggttctctgtcctacctgaatgtcacccgcaaggcctactggcaggtccacctggaccaggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgagtacatgatcccctgtgagaaggtgtccaccctgcccgcgatcacactgaagctgggaggcaaaggctacaagctgtccccagaggactacacgctcaaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctcaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 55210 - DNA, 3295 bp, Homo sapiens
tggagagggacaggaggaaacgcagcgccagcagcatctcatctaccctccttgacacctccccgtggctccagccagaccctagaggtcagccttgcggaccaacaggaggactcccagctttcccttttcaagaggtccccagacaccggccaccctcttccagcccctgcggccagtgcaaggaggcaccaatgctctgaggctgtcgcgtggtgcagcgtcgagcatcctcgccgaggtcctttctgctgcctgtcccgcctcaccccgctccatcacaccagctggccctctttgcttccttttcccagaatcgttaagccccgactcccactagcacctcgtaccaacctcgccccaccccatcctcctgccttcccgcgctccggtgtcccccgctgccatgagctcccccatcagcaagagccgctcgcttgccgccttcctgcagcagctgcgcagtccgaggcagcccccgagactggtgacatctacggcgtacacgtcccctcagccgcgagaggtgccagtctgcccgctgacagctggtggcgagactcagaacgcggccgccctgccgggccccaccagctggccactgctgggcagcctgctgcagattctctggaaagggggtctcaagaaacagcacgacaccctggtggagtaccacaagaagtatggcaagattttccgcatgaagttgggttcctttgagtcggtgcacctgggctcgccatgcctgctggaagcgctgtaccgcaccgagagcgcgtacccgcagcggctggagatcaaaccgtggaaggcctatcgcgactaccgcaaagaaggctacgggctgctgatcctggaaggggaagactggcagcgggtccggagtgcctttcaaaagaaactaatgaaaccaggggaagtgatgaagctggacaacaaaatcaatgaggtcttggccgattttatgggcagaatagatgagctctgtgatgaaagaggccacgtcgaagacttgtacagcgaactgaacaaatggtcgtttgaaagtatctgcctcgtgttgtatgagaagagatttgggcttctccagaagaatgcaggggatgaagctgtgaacttcatcatggccatcaaaacaatgatgagcacgtttgggaggatgatggtcactccagtcgagctgcacaagagcctcaacaccaaggtctggcaggaccacactctggcctgggacaccattttcaaatcagtcaaagcttgtatcgacaaccggttagagaagtattctcagcagcctagtgcagatttcctttgtgacatttatcaccagaatcggctttcaaagaaagaattgtatgctgctgtcacagagctccagctggctgcggtggaaacgacagcaaacagtctaatgtggattctctacaatttatcccgtaatccccaagtgcaacaaaagcttcttaaggaaattcaaagtgtattacctgagaatcaggtgccacgggcagaagatttgaggaatatgccgtatttaaaagcctgtctgaaagaatctatgaggcttacgccgagtgtaccatttacaactcggactcttgacaaggcaacagttctgggtgaatatgctttacccaaaggaacagtgctcatgctaaatacccaggtgttgggatccagtgaagacaattttgaagattcaagtcagtttagacctgaacgttggcttcaggagaaggaaaaaattaatccttttgcgcatcttccatttggcgttggaaaaagaatgtgcattggtcgccgattagcagagcttcaactgcatttggctctttgttggattgtccgcaaatacgacatccaggccacagacaatgagcctgttgagatgctacactcaggcaccctggtgcccagccgggaactccccatcgcgttttgccagcgataatacgcctcagatggtggtatttgctaacatcatatccaactcagggaagcggactgagtgctgggatccaaggcattctacagggttcactgctggtttacacttcacctgtgtcagcaccatcttcaggtgcttagaatggcctgggagcctgttctgtcttgcatcttccatgacatgaaagggaggctggcacttgtcagtcaggtagaggttacaaaccgtttcaggccctgcctaccacattcactgtttgaatctttaattcccaagaataagtttacatttcacaatgaatgacctacaacagctaaattttctggggctgggagtaatactgacaatccatttactgtagctctgcttaatgtactacttaggaaaatgtccctgcttaataatgtaagccaagctaaatgatggttaaagttatcaggcctcccatgaaattgcgttcttcctgcattgaaataaaaacattattgggaaactagagaacacctctatttttaaaaggactttaacgaagtcaaacaacttataagactagtgattcactggggcattattttgttagaggaccttaaaattgtttattttttaaatgtgattcctttatggcattagggtaaagatgaagcaataatttttaaattgtgtatgtgcatatgaagcacagacatgcatgtgtgtgtgtgtctgtgtgtgtgtgtccgtgtatgtgtgtgtgggttctaatggtaatttgcctcagtcatttttttaatatttgcagtacttgatttaggatctgtggtgcagggcaatgtttcaaagtttagtcacagcttaaaaacattcagtgtgactttaatattataaaatgatttcccatgccataatttttctgtctattaaatgggacaagtgtaaagcatgcaaaagttagagatctgttatataacatttgttttgtgatttgaactcctaggaaaaatatgatttcataaatgtaaaatgcacagaaatgcatgcaatacttataagacttaaaaattgtgtttacagatggtttatttgtgcatatttttactactgcttttcctaaatgcatactgtatataattctgtgtatttgataaatatttcttcctacattatatttttagaatatttcagaaatatacatttatgtctttatattgtaataaatatgtacatatctaggtatatgctttctctctgctgtgaaattatttttagaattataaattcacgtcttgtcagatttcatctgtataccttcaaattctctgaaagtaaaaataaaagtttttaaatattaaaaaaaaaaaaaaaaaaaaa

SEQ ID NO: 55211 - DNA, 2979 bp, Homo sapiens
agcaaaccaatcgcaagcctcgttgagtggaaggggtgggatcttccccggaagttttggttaaagcccctccaatcagcggctcggtgcggcaagtttgaatttcgtggaggctcgggttgtgagggttcctgcttcggagtcggcggtggtcgtccagaccgagtgttctttactttttgtttggttgaggtttcacgctagaaggtggctcaggatgtcttcatcacattttgccagtcgacacaggaaggatataagtactgaaatgattagaactaaaattgctcataggaaatcactgtctcagaaagaaaatagacataaggaatacgaacgaaatagacactttggtttgaaagatgtaaacattccaaccttggaaggtagaattcttgttgaattagatgagacatctcaagagcttgttccagaaaagaccaatgttaagccaagggcaatgaaaactattctaggtgatcaacgaaaacagatgctccaaaaatacaaagaagaaaagcaacttcaaaaattgaaagagcagagagagaaagctaaacgaggaatatttaaagtgggtcgttatagacctgatatgccttgttttcttttatcaaaccagaatgctgtgaaagctgagccaaaaaaggctattccatcttctgtacggattacaaggtcaaaggccaaagaccaaatggagcagactaagattgataacgagagtgatgttcgagcaatccgacctggtccaagacaaacttctgaaaagaaagtgtcagacaaagagaaaaaagttgtgcagcctgtaatgcccacgtcgttgagaatgactcgatcagctactcaagcagcaaagcaggttcccagaacagtctcatctaccacagcaagaaagccagtcacaagagctgctaatgaaaacgaaccagaaggaaaggtgccaagtaaaggaagacctgccaaaaatgtagaaacaaaacccgacaagggtatttcttgtaaagtcgatagtgaagaaaatactttgaattcacaaactaatgcaacaagtggaatgaatccagatggagtcttatcaaaaatggaaaacttacctgagataaatactgcaaaaataaaagggaagaattccttcgcacctaaggattttatgtttcagccactggatggtctgaagacctatcaagtaacacctatgactcccagaagtgccaatgcttttttgacacccagttacacctggactcctttaaaaacagaagttgatgagtctcaagcaacaaaagaaattttggcacaaaaatgtaaaacttactctaccaagacaatacagcaagattcaaataaattgccatgtcctttgggtcctctaactgtttggcatgaagaacatgttttaaataaaaatgaagctactactaaaaatttaaatggccttccaataaaagaagtcccatcacttgaaagaaatgaaggtcgaattgctcagccccaccatggtgtgccatatttcagaaatatcctccagtcagaaactgagaaattaacttcacattgcttcgagtgggacaggaaacttgaattggacattccagatgatgctaaagatcttattcgcacagcagttggtcaaacaagactccttatgaaggaaaggtttaaacagtttgaaggactggttgatgattgtgaatataaacgaggtataaaggagactacctgtacagatctggatggattttgggatatggttagttttcagatagaagatgtaatccacaaattcaacaatctgatcaaacttgaggaatctgggtggcaagtcaataataatatgaatcataatatgaacaaaaatgtctttaggaaaaaagttgtctcaggtatagcaagtaaaccaaaacaggatgatgctggaagaattgcagcgagaaatcgcctagctgccataaaaaatgcaatgagagagagaattaggcaggaagaatgtgctgaaacagcagtttctgtgataccaaaggaagttgataaaatagtgttcgatgctggatttttcagagttgaaagtcctgttaaattattctcaggactttctgtctcttctgaaggcccttctcaaagacttggaacacctaagtctgtcaacaaagctgtatctcagagtagaaatgagatgggcattccacaacaaactacatcaccagaaaatgccggtcctcagaatacgaaaagtgaacatgtgaagaagactttgtttttgagtattcctgaaagcaggagcagcatagaagatgctcagtgtcctggattaccagatttaattgaagaaaaccatgttgtaaataagacagacttgaaggtggattgtttatccagtgagagaatgagtttgcctcttcttgctggtggagtagcagatgatattaatactaacaaaaaagaaggaatttcagatgttgtggaaggaatggaactgaattcttcaattacatcacaggatgttttgatgagtagccctgaaaaaaatacagcttcacaaaatagcatcttagaagaaggggaaactaaaatttctcagtcagaactatttgataataaaagtctcactactgaatgccaccttcttgattcaccaggtctaaactgcagtaatccatttactcagctggagaggagacatcaagaacatgccagacacatttcttttggtggtaacctgattactttttcacctctacaaccaggagaattttgaatttaaaaataaatccaaacattttccttcatattatcaatgcttatatattccttagactattgaaattttggagaaaatgtatttgtgttcacttctatagcatataatgttttaatattctgtgttcatcaaagtgtattttagatatactctttctcaagggaagtggggatattttgtacattttcaacacagaataaaaaatgtactgtgccttg

SEQ ID NO: 55212 - DNA, 2262 bp, Homo sapiens
ctccgacccgggcttttccttcgtaccctgcggccccctccgcacccctcacggagctcctcgggtcctgccccctcccagcgcttgcccgcgccgccccgcccccgtttttaaacctggcgcgcgggtaggtgagcgcgttagcccgagtggatctaggcgcgctcgtaggccggcgccgcagcaaggggcgcgggctccgccggcaccatggagcccgaagcggcggccggagcccggaaggcgcgggggcgcggctgtcactgccccggggacgctccctggaggcctccgccaccgcgcgggccggagagccccgcgccgtggcgaccttggatccagacacctggagatgctgagctgaccagaactggaaggccgcttgaacctagggctgaccaacacacttttggatcaaagggagcctttgggtttcagcatcctgtaagagtctatttacccatgtcaaagcgtcaagaatacctgcggagttccggggagcaagtactggccagtttcccagtgcaagccacgattgacttctacgacgatgagtctactgagtctgcttccgaagctgaagagccagaggaaggacccccacccctccatcttctgccccaggaggtgggaggtcggcaggaaaatggcccagggggaaagggcagagaccagggcatcaaccaagggcagcgatcctcaggagggggtgaccactggggggagggtccgctccctcaaggtgtctcctcaaggggtggcaagtgctcctcatccaaatgaatcagtctctgtctcctgggccctgctctgggacctgcccctcacgttctcttggggacacccgagccaggacactacgcatccctgctgagtgtgcagaggctagaggcttctcgggcagcccctggcctgcacactactcatgacagaaagtcagcttttacttttctttcccctggcaattcgtttttggtgcactcatgcatgcctttgagaaaggattctaggagaaagagaaggtctatgtcaacagagttgttatctcatagagccagttttcaaagctccttctgcattgtcactcactgatcaggtgatgaattcttcctagatagtcgcccactccacctcctacttaacctgagactcattatttagctatttctgcttttgtaaaaataattcagatattaaactccaattttaatctatcatccaagggtagatgtagttgcttagtagcattttggaaaaaaaagaaaaaaaggtttggtttggttttgtgacggagttttgctcttgtctcccaggctggagtgcagtgacacaatctcggctcactgcaacctccacttcttgggttcaagtgattctcctgtctcagcctcccaagtggctgggattgcaggcatgagctaccacgcctggctaattttttgtatttttagtagagactcggtttcaccatgttggtcaggctggctttgaactcctgacctcaggtgatccacccgccttggcctcccaaagtgctgggattacaggcgtgagccactgagcccggccaaaaaaaaatgtatttattaaaaaaaaatttttttaacccgccgaataattcccataagagtaacaaaaaggaccagcctgaccagcgtggagaaactctgtctctactaaaaatacaaaattagccaggcgtgatggctcatgcctgtgatcccagctactcgggaggctgaggcaggagaatggctggaacccgggaggcggaggttgccgtgagtcgagatcgcaccattgcattccagcctgggcaacaagagcgaaactccgtctcaaaaaaaaaaaaaaaaaaaaaaagaaagaaaagagtaacagaaagatagggatttttaggagacaattagataaaaatgtatgtgatgactgtataaggaggcctgtgtgtatgaatttatagggagtagaaccgtctctcttcttagttggtgactgtttggggcctggtattttaatagatgaacactacttttttaattttttatttttttaaccctacccttaacccatgaacactatttttaattaaagtatctgatgtaaaattattttgagtttttaatattttgataaacgtgtattcctgaaactttttgacttacttatcttacatgtggtgtcttcctgtatatagtacattatatcaatttctacttgaaataaatattttgaaaaaaaaaaaaaaaaaaaaaaaaaaaa

SEQ ID NO: 55213 - DNA, 1660 bp, Homo sapiens
aggtgagcggcggccaatgggcgagcgcggggcaggtgcccgctaactcgcgcctcgcagcgctgggcggccggggctgggcagggcagtgcggggacaccgggggctggggtcggtcccagcgggactccgaaaggagggagacgagctcaaccctcgggccttactggcagctcgcagcctagcacggagcccgcgcctgtgcgggcgcctggagctgcccgctccgccgcagcagccgccgcgcctggccgtacgctgtggccggaccccgcggtcgctcgctcacacacccctcgccgctccgcgcctggctcgcccgcgggggccgagcgcgagcgggcgggcgggggaggtgaggggtgcgggcgggtgtgcatgtgcctggctgggtgcacaccccgcaaggcggcggcgccaggacgcggagcgctccccagagcacggctgcctcgcacagctcccgcggctgcgaccatgttccagcccgcggccaagcgcggctttaccatagagtccttggtggccaaggacggcggcaccggcgggggcactggcggcgggggcgcgggctcccatctcctggcggcggccgcctccgaggaaccgctccggcccacggcgctcaactaccctcaccccagcgcggccgaggcggccttcgtgagtggcttccctgccgcggccgccgcgggcgcgggccgctcgctctacggtgggcccgagctcgtgttccccgaggccatgaaccaccccgcgctgaccgtgcatccggcgcaccagctgggcgcctccccgctgcagcccccgcactccttcttcggcgcccagcaccgggaccctctccatttctacccctgggtcctgcggaaccgcttcttcggccaccgcttccaggccagcgacgtgccccaggacgggctgcttctgcacggccccttcgcacgcaagcccaagcggatccgcacggccttctcgccctcgcagctgctgcggctggagcgcgccttcgagaagaaccactacgtggtgggcgccgagcggaagcagctggccggcagtctcagcctctccgagacgcaggtgaaggtgtggttccagaaccggaggacaaagtacaaacggcagaagctggaggaggaagggcctgagtccgagcagaagaagaagggctcccatcacatcaaccggtggcgcattgccacgaagcaggccaatggggaggacatcgatgtcacctccaatgactagggtgggcaaccacaaacccacgagggcagagtgctgcttgctgctggccaggcccctgcgtgggcccaagctggactctggccactccctggccaggctttggggaggcctggagtcatggccccacagggcttgaagcccggggccgccattgacagagggacaagcaatgggctggctgaggcctgggaccacttggccttctcctcggagagcctgcctgcctgggcgggcccgcccaccaccgcagcctcccagctgctctccgtgtctccaatctcccttttgttttgatgcatttctgttttaatttattttccaggcaccactgtagtttagtgatccccagtgtcccccttccctatgggaataataaaagtctctctcttaatgaaaaaaaaaaaaaaaa

SEQ ID NO: 55214 - DNA, 1483 bp, Homo sapiens
cttagtggtgtcggggtctagtggacagagaagactcttggccaggcagatggcttctcggtggcagaacatggggacctccgtgcgccggagatctctccagcaccaggagcagctggaggacagcaaggagctgcagcctgtggtcagccatcaggagacctctgtaggggccctggggtccctgtgcagacagttccaaaggaggctgcccctgagaaccgtcaacctcaacctccgcgcagggccctcctggaaacgcctggaaaccccagagccaggtcagcagggcctccaggctgcagctcgctcagctaagagtgctttgggtgccgtgtcccagagaatccaggagtcctgccaaagtggcaccaagtggctggtggagacccaggtgaaggccaggaggcggaagagaggagcacagaagggcagtggatccccaactcacagcctgagccagaagagcacccggctgtctggagccgcccctgcccactcagccgcagacccctgggagaaggagcatcaccgcctctctgtccggatgggctcacatgcccacccattacggcgatcaaggcgggaggctgccttccggagcccctactcctcaacagagcccctctgctctcccagcgagtctgacagtgacctagagcctgtgggggcgggaattcagcatctccagaagctgtcccaagagctagatgaagccattatggcggaagagagtggtgacatcgtctctctcattcatgactgaggaagtgcctgcaggaaacaagccctgtctgaccgccaaggcttcatactcaaggatgtctatgcttccccgtgtgcttcctggaaaaaacccccgggagtcgtcagtacccctgggccactgctaacaagcacctaacaaggggcccagagccccctgctccagccacatctggacccatcagtgactgcctgccatagcctgagagtgtcttggggagaccttgcagagggggagaattgttccttctgctttcctaggggactcttgagcttagaaactcatcgtacacttgaccttgagccttctatttgcctcatctataacatgaagtgctagcatcagatatttgagagctcttagctctgtacccgggtgcctggtttttggggagtcatccgcagagtcactcacccactgtgtttctggtgccaaggctcttgagggccccactctcatccctcctttccctaccagggactcggaggaaggcataggagatatttccaggcttacgaccctgggctcacgggtacctatttatatgctcagtgcagagcactgtggatgtgccaggaggggtagccctgttcaagagcaatttctgccctttgtaaattatttaagaaacctgctttgtcattttattagaaagaaaccagcatgtgactttcctagataacactgctttctcataataaagactatttgcatttg

SEQ ID NO: 55215 - DNA, 2137 bp, Homo sapiens
  misc_feature 2108: n = A,T,C or G
cctggatcttgtttctggactgagatggatggagaggccacagtgaagcctggagaacaagtgcctttgtggacacatggatggccccctgatgacccatctccttcctttgctgcaggttcttctttcgcccttccacaaaaaagaccccatccgagatggctgtgggagggctctctcccctccaggacccatctccgggccatgggaacactcaggccttcctcgcccctctgctggcgggaggagagctcctttgcagctccaaattcattgaagggctcaaggctggtgtcaggggagcctggaggagctgtcaccatccagtgccattatgccccctcatctgtcaacaggcaccagaggaagtactggtgccgtctggggcccccaagatggatctgccagaccattgtgtccaccaaccagtatactcaccatcgctatcgtgaccgtgtggccctcacagactttccacagagaggcttgtttgtggtgaggctgtcccaactgtccccggatgacatcggatgctacctctgcggcattggaagtgaaaacaacatgctgttcttaagcatgaatctgaccatctctgcaggtcccgccagcaccctccccacagccactccagctgctggggagctcaccatgagatcctatggaacagcgtctccagtggccaacagatggaccccaggaaccacccagaccttaggacaggggacagcatgggacacagttgcttccactccaggaaccagcaagactacagcttcagctgagggaagacgaaccccaggagcaaccaggccagcagctccagggacaggcagctgggcagagggttctgtcaaagcacctgctccgattccagagagtccaccttcaaagagcagaagcatgtccaatacaacagaaggtgtttgggagggcaccagaagctcggtgacaaacagggctagagccagcaaggacaggagggagatgacaactaccaaggctgataggccaagggaggacatagagggggtcaggatagctcttgatgcagccaaaaaggtcctaggaaccattgggccaccagctctggtctcagaaactttggcctgggaaatcctcccacaagcaacgccagtttctaagcaacaatctcagggttccattggagaaacaactccagctgcaggcatgtggaccttgggaactccagctgcagatgtgtggatcaccagcatggaggcagcatctggggaaggaagcgctgcaggggacctagatgctgccactggagacagaggtccccaagcaacactgagccagaccccggcagtaggaccctggggaccccctggcaaggagtcctccgtgaagcgagcaacatgcccaggtttaagtactcttaaagaaatcaaagtcagtgctgtccttacccagaaccctcacagtctgctctgtgtctctgcagctcaggaggcagaaagggtcaccttaattcagatgacacattttctggaagtgaacccccaagcagaccagctgccccatgtggaaagaaagatgctccaggatgactctcttcctgctggggccagcctgactgccccagagagaaatccaggaccctgagggacagagagatgaactgctcagttaccatgggagaaggaccaagatcaaaggccttcaggaccccagcctctttccatcatccttcctccacctgtgggaagagaagctgatgcagccggtgctccacccatggaagaaaggctggctgtccttgggcccaagaaagtcaagcattatccacgtccaaaggtgacaagatgactcaaaggagacttcaagaacagtgtatgaaacactggaagaggtcacctaggaaaagcatgaaatttccattcctgaatgtttgaaaatagaagaggcttccaatcagtgtggaaagtgacaaatcccctatcaacactcccagcccttgctgggggctccttttctgactactgttagcactcagcctcccattcacatgtattatatttaagtgtaccagccttgccttctcaagtagattctaagctccttttaaggcagtaattgcattntatctgtctcatgatgcccccagagaact

SEQ ID NO: 55216 - DNA, 3473 bp, Homo sapiens
ctcgccagcggtccgcagggctggagacccacgccgtggagaggaccagcctcaggtcgccccgcctgggcccgcgccccgacctcgctgcccccgcctcgcctctctgcccgtggcgcttacggccaccttggcctcgggggcagggcatgggcggcccccgccagatcgcccagcgccagtactaactgccctcgctctggccttcgagcccgaagcctcttctgcgcgcacaacctaggcagtaatcctaaactagcgggcaccacagaccagctgcagccaccccaacccagggatcacttccggacccctcgaccgcccggcaccagcgcgcaagggacccttcagccggagaccagagtccagtcccggtcacgaggccaccgccgctgcccgcctcgagaagcaccacgcgggctgagccgtcggctagcgggtcactcccgagcctctgtctgcaccgcgccagccccagaccacggacgctgagcctccagcgcgtgccagcctgggccgctgggctctcggggccagcccgcgacgatcccctgagctctccgcagaagggccgagcgtccgttccggggacgccaggcccgcccccgccccccgacagccgcggggatccagagcccgggggtgcgggacgcccgcgccatgactgccgagagcgggccgccgccgccgcagccggaggtgctggctaccgtgaaggaagagcgcggcgagacggcagcaggggccggggtcccaggggaggccacgggccgcggggcgggcgggcggcgccgcaagcgccccctgcagcgcgggaagccgccctacagctacatcgcgctcatcgccatggccatcgcgcacgcgcccgagcgccgcctcacgctgggcggcatctacaagttcatcaccgagcgcttccccttctaccgcgacaaccccaaaaagtggcagaacagcatccgccacaacctcacactcaacgactgcttcctcaagatcccgcgcgaggccggccgcccgggtaagggcaactactgggcgcttgaccccaacgcggaggacatgttcgagagcggcagcttcctgcgccgccgcaagcgcttcaagcgctcggacctctccacctacccggcttacatgcacgacgcggcggctgccgcagccgccgccgccgccgccgccgccgccgccgccatcttcccaggcgcggtgcccgccgcgcgccccccctacccgggcgccgtctatgcaggctacgcgccgccgtcgctggccgcgccgcctccagtctactaccccgcggcgtcgcccggcccttgccgcgtcttcggcctggttcctgagcggccgctcagcccagagctggggcccgcaccgtcggggcccggcggctcttgcgcctttgcctccgccggcgcccccgctaccaccaccggctaccagcccgcaggctgcaccggggcccggccggccaacccctccgcctatgcggctgcctacgcgggccccgacggcgcgtacccgcagggcgccggcagtgcgatctttgccgctgctggccgcctggcgggacccgcttcgcccccagcgggcggcagcagtggcggcgtggagaccacggtggacttctacgggcgcacgtcgcccggccagttcggagcgctgggagcctgctacaaccctggcgggcagctcggaggggccagtgcaggcgcctaccatgctcgccatgctgccgcttatcccggtgggatagatcggttcgtgtccgccatgtgagccagcgtagggacgaaaactcatagacacatcggctgttcacacgttccccgcaatctgagaacgaacaggaatggagagaggactcaactgggacccacgtggaaaagaccgagcaggccacagaggctcggtctccccgcgcacagcgtaggcacccggtgtactctgtaaacgggaggaggtggggcgaggcagccagagcccttggactggcacagggaccctcgatggagcgaagccctcaaacgggatgctttctggtattctatcggggagggtccttggcggtaaccagagggcagcgtagtgtcaacaccagagaccaggatccaaattgtggggaatcagtttcagccttccatgtgctgccggaactcgggcctttttacgcggttcgtcctctagtgcctttaactgcgttactacaataaaaggctgcggcagcgcctttcttcttaaagtgaggaggacaaatttgcaaaagaaataggcttttcttcttttttaaattggagaaatctctgctctggttgacctgggctggttttccctgtctctgagaacttgagacctagctccgagttgaactgtgcgtcagcactccagtcccatcacctgaaccttcagtctcccccatctgttacactagagggctgcaggactctatccaccgcccccgggttatcattcagggccccatcatcttggatgctgccctgcgtatttggcagcaatggtgggccacccagggcctctgagtagccacccaaagcctagccgctgttctagggaacggaaaagagttcatggccaagcgtctaacctaaagtcccaggattggctccaggcagcaattatatcataacttattgaacttttgagcaggacgtgctggtaatttcatggctgttactgcccagtcataaatctgcttttccattataaggcagagagaagtacattcgttcatttgtccactgtttcttgtcatcacgcagccctggacccaaagggtgaactaaagtttaaggagatgagaggattcaaggagcccgttggtgacgcctttcagtagctggggagggctcttccatccccagcaccccctgctacacctcagcagcctcccccatgcaaaaaggaaagagaaaaattaagttagggcagtcagtaaagtgagctttagaaagaaactggaattttaacttcattttgtatcttgcttaagtagcaggctcactaaaattagagaaagtccaataactctccccctttcccttgagaaatctttaagtttcgattctggagcaaaaactttcagcattaaatatttcagaggctccattcacagctttcagataaactggagtgttcagatggactgttttaataaaaatctttgagcaagtgagttatggcaagagaaactcagcctctttctgtataaacttaacagggaagggctggggtgtgaaaaagaagattgtatgaaaaccattggtaatttttattttttatttttgggactgcactatcctgttcacgaagacatgtgaacttggttcagtccaaatggggatttgtataaaccagtgctctccattagaaatatggtgcaagccacatatgtaattttaaatattctagtagccacattaataaagtaaaaagaaacaaaaaaaaaaaaa

SEQ ID NO: 55217 - DNA, 2294 bp, Homo sapiens
gggtgcaggtgccaggcaggtggctccggccagcccagccccagcatgagctccttcgacctgccggcgccctccccacctcgctgcagcccccagttccccagcatcggccaggagccccccgagatgaacctctactatgagaacttcttccacccacagggcgtgcccagccctcagcggccctccttcgaggggggcggcgagtatggggccacccccaacccctacctctggttcaacgggcccaccatgaccccgccaccctacctgcccggccccaacgccagccccttcctgccccaggcctatggagtgcagaggccgctgctgcccagcgtgtcggggcttggggggagcgacctgggctggctgcccatcccctcgcaggaggagctgatgaagctggtgcggccaccctattcctactcggctctcatcgccatggccatccacggggcacccgacaagcgcctcactctcagccagatctaccagtacgtggccgacaacttccccttctacaacaagagcaaggccggctggcagaactccatccgccacaacctgtcgctcaacgactgcttcaagaaggtgccccgcgacgaggacgacccgggcaaagggaattactggaccctggaccccaactgtgagaaaatgttcgacaatggaaatttccgcaggaaaaggaagagaaaatcagatgtttcctctagcacagcctccttggccttagagaagacagagagcagtctcccggtggacagccccaagaccacggagcctcaggacatcttggatggagcctcaccagggggcaccaccagctccccagagaagcggccctcccctcccccatcaggcgccccttgccttaacagcttcctttcctctatgacagcctatgtgagcggggggagccccacgagccaccccttggtcacaccaggactgagccctgagcccagtgacaagacggggcagaactcactgaccttcaactccttctccccgctcaccaacctcagcaaccacagcggtgggggtgactgggcgaaccccatgcccaccaacatgctcagctacggaggatctgtgctcagccaattcagccctcacttctacaacagtgtcaacaccagtggtgtcctctaccccagggagggcaccgaggtctaggtacagaacagctcctgagccaggtggacatgccagagagaaaagcagtagaggtcctccatgccagccccacggtggtccatgactgcggaactgcccagacataagcaggagcctccgaggaatccaccctctttctagaacactggttaaggcttctgtttatcacacataggcccacacacagactcaccaactttgcaatagaaatactggtgcctgcagagcagcactaacagtggcaggtgctgtactaggctctgtactggccacacttactattgacagtcaccccgtaaggttcacaaaccaccccattgaacagatgaggaactgaggctcaaggaggttaagtaacatttccagggttatataaactagtaaatggcagagctaagagtcaaatccaggtctatgtgatcctcagagattggaggccaggatggagaattggttgagtagccaaggaaggtcagtgtgaaaagcttgctatggcaaatatagcgaaatctctccactgccttctgtccaccaacatttagtgccagcctaggcacaacttgtcctggtccaagtccttattctgcttgccccaacttacctgcagacactccttttgctaccactcaaggaaggaagtcaccagtggccttagtgcaggaaactcagccctggtggccctgcagaacaatgcatctgacatgtgcgatgcatccccatggagagacagcattgctccccagccctccagaaaccttgagcagatccagggatcagtgagaggagtggtgtgtacccctaaatcctcccaccccagcactgcccatctgtaaaatcttgtaaagcccagtttcctgtgtgcatgtcatggaccagtgagctggagatggctgaatcttccaagagaaacaaggttggataagcgcttccttttttttagcccaggagaggtggatgtttgtctgagaaaacaatggcctcaagggaggggccttgggcccaccctcacagggggtctctgtgtgatctcttgggatttctccttgtttttgtgagtacctgggaagtgttgtttgttttcttattttctttttaattaaaaaacaaacaaa

SEQ ID NO: 55218 - DNA, 2040 bp, Homo sapiens
gggtgcaggtgccaggcaggtggctccggccagcccagccccagcatgagctccttcgacctgccggcgccctccccacctcgctgcagcccccagttccccagcatcggccaggagccccccgagatgaacctctactatgagaacttcttccacccacagggcgtgcccagccctcagcggccctccttcgaggggggcggcgagtatggggccacccccaacccctacctctggttcaacgggcccaccatgaccccgccaccctacctgcccggccccaacgccagccccttcctgccccaggcctatggagtgcagaggccgctgctgcccagcgtgtcggggcttggggggagcgacctgggctggctgcccatcccctcgcaggaggagctgatgaagctggtgcggccaccctattcctactcggctctcatcgccatggccatccacggggcacccgacaagcgcctcactctcagccagatctaccagtacgtggccgacaacttccccttctacaacaagagcaaggccggctggcagaactccatccgccacaacctgtcgctcaacgactgcttcaagaaggtgccccgcgacgaggacgacccggcctatgtgagcggggggagccccacgagccaccccttggtcacaccaggactgagccctgagcccagtgacaagacggggcagaactcactgaccttcaactccttctccccgctcaccaacctcagcaaccacagcggtgggggtgactgggcgaaccccatgcccaccaacatgctcagctacggaggatctgtgctcagccaattcagccctcacttctacaacagtgtcaacaccagtggtgtcctctaccccagggagggcaccgaggtctaggtacagaacagctcctgagccaggtggacatgccagagagaaaagcagtagaggtcctccatgccagccccacggtggtccatgactgcggaactgcccagacataagcaggagcctccgaggaatccaccctctttctagaacactggttaaggcttctgtttatcacacataggcccacacacagactcaccaactttgcaatagaaatactggtgcctgcagagcagcactaacagtggcaggtgctgtactaggctctgtactggccacacttactattgacagtcaccccgtaaggttcacaaaccaccccattgaacagatgaggaactgaggctcaaggaggttaagtaacatttccagggttatataaactagtaaatggcagagctaagagtcaaatccaggtctatgtgatcctcagagattggaggccaggatggagaattggttgagtagccaaggaaggtcagtgtgaaaagcttgctatggcaaatatagcgaaatctctccactgccttctgtccaccaacatttagtgccagcctaggcacaacttgtcctggtccaagtccttattctgcttgccccaacttacctgcagacactccttttgctaccactcaaggaaggaagtcaccagtggccttagtgcaggaaactcagccctggtggccctgcagaacaatgcatctgacatgtgcgatgcatccccatggagagacagcattgctccccagccctccagaaaccttgagcagatccagggatcagtgagaggagtggtgtgtacccctaaatcctcccaccccagcactgcccatctgtaaaatcttgtaaagcccagtttcctgtgtgcatgtcatggaccagtgagctggagatggctgaatcttccaagagaaacaaggttggataagcgcttccttttttttagcccaggagaggtggatgtttgtctgagaaaacaatggcctcaagggaggggccttgggcccaccctcacagggggtctctgtgtgatctcttgggatttctccttgtttttgtgagtacctgggaagtgttgtttgttttcttattttctttttaattaaaaaacaaacaaaaaaaaaaaaaaaaaaaaaaaaaaaaaaaaaa

SEQ ID NO: 55219 - DNA, 2762 bp, Homo sapiens
ccgccccgccccgccttgccccaacccacgatggtctgggagctgcgcccagggcttggcgctggcggccccgcaacagcaccgagcgtttcggtcggcgggcggcggtagcgccccctctcagagccccgctcactcccacctcggctcgctccgagtcggcctgtctgtcgggcccgccctccccgctcactccctccgccctcgtgctcctcccggggtgcttggcacagcctcggattcctccctctcgctgctcgagtcagtttccctatcggcggcagcgggcaaggcggcggcggcggcggcggcagccgcggtggcggcgtggggaacatctcggcagccaccgcgcttctcccgctggagcgggcgtccagcttggctgccctcggtccttccctgccacgtttcgggtcgccctgcaccccccacccaggctcgcttctcttcgaagcgggaagggcgccttgcaggatcctgccgcccctccaaccggatcctgggtctagagctccccagagcgaggcgctcgccaggactcctgccccgccaaccctgaccgccggggggtgcccccgggacgtagcgccgcggagaggaagcggcaaaggggaccatgcggcgcctgactcgtcggctggttctgccagtcttcggggtgctctggatcacggtgctgctgttcttctgggtaaccaagaggaagttggaggtgccgacgggacctgaagtgcagacccctaagccttcggacgctgactgggacgacctgtgggaccagtttgatgagcggcggtatctgaatgccaaaaagtggcgcgttggtgacgacccctataagctgtatgctttcaaccagcgggagagtgagcggatctccagcaatcgggccatcccggacactcgccatctgagatgcacactgctggtgtattgcacggaccttccacccactagcatcatcatcaccttccacaacgaggcccgctccacgctgctcaggaccatccgcagtgtattaaaccgcacccctacgcatctgatccgggaaatcatattagtggatgacttcagcaatgaccctgatgactgtaaacagctcatcaagttgcccaaggtgaaatgcttgcgcaataatgaacggcaaggtctggtccggtcccggattcggggcgctgacatcgcccagggcaccactctgactttcctcgacagccactgtgaggtgaacagggactggctccagcctctgttgcacagggtcaaagaggactacacgcgggtggtgtgccctgtgatcgatatcattaacctggacaccttcacctacatcgagtctgcctcggagctcagaggggggtttgactggagcctccacttccagtgggagcagctctccccagagcagaaggctcggcgcctggaccccacggagcccatcaggactcctatcatagctggagggctcttcgtgatcgacaaagcttggtttgattacctggggaaatatgatatggacatggacatctggggtggggagaactttgaaatctccttccgagtgtggatgtgcgggggcagcctagagatcgtcccctgcagccgagtggggcacgtcttccggaagaagcacccctacgttttccctgatggaaatgccaacacgtatataaagaacaccaagcggacagctgaagtgtggatggatgaatacaagcaatactattacgctgcccggccattcgccctggagaggcccttcgggaatgttgagagcagattggacctgaggaagaatctgcgctgccagagcttcaagtggtacctggagaatatctaccctgaactcagcatccccaaggagtcctccatccagaagggcaatatccgacagagacagaagtgcctggaatctcaaaggcagaacaaccaagaaaccccaaacctaaagttgagcccctgtgccaaggtcaaaggcgaagatgcaaagtcccaggtatgggccttcacatacacccagcagatcctccaggaggagctgtgcctgtcagtcatcaccttgttccctggcgccccagtggttcttgtcctttgcaagaatggagatgaccgacagcaatggaccaaaactggttcccacatcgagcacatagcatcccacctctgcctcgatacagatatgttcggtgatggcaccgagaacggcaaggaaatcgtcgtcaacccatgtgagtcctcactcatgagccagcactgggacatggtgagctcttgaggacccctgccagaagcagcaagggccatggggtggtgcttccctggaccagaacagactggaaactgggcagcaagcagcctgcaaccacctcagacatcctggactgggaggtggaggcagagccccccaggacaggagcaactgtctcagggaggacagaggaaaacatcacaagccaatggggctcaaagacaaatcccacatgttctcaaggccgttaagttccagtcctggccagtcattccctgattggtatctggagacagaaacctaatgggaagtgtttattgttccttttcctacaaaggaagcagtctctggaggccagaaagaaaagccttctttttcactaggccaggactacattgagagatgaagaatggaggttgtttccaaaagaaataaagagaaacttagaagttgtctctggaaaaaaaaaaaaaaaaaaaaaaaaaaaaaaaaaaaaaaaaaaaaaaaaaaa

SEQ ID NO: 55220 - DNA, 1642 bp, Homo sapiens
tttcagcctcacctgcagctgcgcctccttgcacctgcgcctgtgctttttctcccagcactgcggacgcgactcgagggtgacgctcgctccgctcgtcccgctcgtcatggcctacccgggatacggaggagggtttggaaattttagcattcaggtgccaggaatgcagatgggacagccagtgccagaaacaggcccagctatactcctcgatggatactctgggccagcatattcagacacttattcctcagctggtgactccgtgtatacttacttcagtgctgttgctggacaggatggtgaagtggatgctgaagaacttcagagatgtttgacacagtctggaattaatggaacttactctcccttcagtttggaaacctgcagaattatgattgccatgttggatagagatcacacaggaaaaatgggatttaatgcattcaaagagctatgggcagctcttaatgcctggaaggaaaacttcatgactgttgatcaagatggaagtggcacagtagaacatcatgagttgcgtcaagccattggtcttatgggttataggttgagtcctcaaacattaactactattgttaaacgttatagcaagaatggcagaattttctttgatgattatgttgcttgctgtgtgaagcttcgagcattgacagatttctttaggaaaagagaccacttgcaacaagggtctgcgaatttcatatatgacgattttttgcagggcactatggcaatttgaatgcttagaattttaaacctgaagagacactgtgaattcttttgtttggaagaagtgaactggactactttaaaacttttaagggttttctatgttcttcctacctgttaaacctcttccctttctgtgtgtttttattttagcagatagttcaaagcaataaaagatttcttttttaatttgaggtattactgcttttggaaaagttattttataaatatgtgcatattgtcataaaatattgtatgattaattgatttaaataatgcttagccttaattttagataatgtaaatttagaggaatgtactttacaagatagattgtataagaagccaaataatgaaagcctagggaaaaaactaatttatacttatctgaaggttacaaattagacttttaaattttctttgtagttggtggtgtttgagggttggctagaaatgaaagcctggattttgtgccatgtttgtaatatagtttgttccttgatcaaataatcagagaaaagaaacttaaagatctttgtctgtgaagaagaaaattatctccctagttcaatctgtagtgaaataagactacagaaggcattgttttttccttttttattttttgtattatatatttttcttaaatatgttttattgtcttctctaagcaaaaagttcttaataaacatagtatttctctctgcgtcctatttcattagtgaagacatagttcacctaaaatggcatcctgctctgaatctagactttttagaaatggcatatgtttttgatgatatgtcaacattcaaaattgtcctaattaaattgttgtttaaatgtaatgtcaactctttataaacttaaaaataaacaagtaattaaccactca

SEQ ID NO: 55221 - DNA, 3783 bp, Homo sapiens
cccgcgagcgtccatccatctgtccggccgactgtccagcgaaaggggctccaggccgggcgcacgtcgacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcgagcattgatgaattgatcgagaagacggtccctgccaacatccgtttgaaaagacccttgaaaatggaagaccctgtttgtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttcgaatctaccatggttcccatgggctggagcatattgctaggagggtacataatgccactttgattttgtcagaaggtctcaagcgagcagggcatcaactccagcatgacctgttctttgataccttgaagattcattgtggctgctcagtgaaggaggtcttgggcagggcggctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcatgaaaccagagaacaaattctggccaacgattgcccggattgatgacatatatggagatcagcacctggtttgtacctgcccacccatggaagtttatgagtctccattttctgaacaaaagagggcgtcttcttagtcctctctccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttttcctctttttctgtgtgaggttttttttttttttaatctgcatttattagtattctaataaaagcattttgatcggaaaaaaaaaaaaaaaaaaaaa

SEQ ID NO: 55222 - DNA, 4493 bp, Homo sapiens
atcgtctgccgctttggtgacttctgacagctctctccatggaaggaggcggcggccgcgatgagccttcagcctgccgggcaggggacgtgaacatggatgaccctaagaaggaagacattcttcttttggccgatgaaaaatttgacttcgatctttcattgtcttcttcgagtgcaaatgaagatgatgaagtcttcttcggaccctttggacataaagaaagatgtattgctgccagcttggaattaaataatccggttcccgaacagcctccgttgcccacatctgagagtccctttgcctggagccctctggccggggagaagttcgtggaggtgtacaaagaagctcacttactggctttacacattgagagcagcagccggaaccaggcagcccaagctgccaagcctgaagaccctcggagccagggcgtggaaagattcatacaggagtcaaaattaaaaataaacctctttgagaaagaaaaggaaatgaagaaaagccccacgtctcttaaaagggagacatactacctgtcagacagccccttgctggggccccctgtgggtgagcctcggctcttggcctcctccccggccctgcccagctctggtgcccaggcccgcctcacccgggcgccggggcctccgcactctgctcatgctttgcccagggaatcatgcactgctcatgctgcaagtcaggcagcgactcagaggaagcccgggaccaaattgctgctgcctcgagcggcctctgttagaggaagaagcatccctggggctgcggagaagcccaagaaagagattccagctagtccttccaggacaaaaatcccagctgagaaggaatcccaccgggatgttctccctgacaaacctgccccgggtgctgtcaatgtgccggccgccggaagccacttgggccagggcaagcgggcgatccctgttccaaacaagttggggctgaagaagaccctgttaaaagcacccggctctaccagcaatctcgcaaggaagtcctcctcggggcctgtttggagcggggcatccagtgcgtgcacatccccagcagtgggcaaagctaaatcaagtgaatttgcaagtattcctgcaaatagctcccggcctctgtcaaacatcagcaagtcaggcagaatgggacccgccatgctgcggccagctctgcctgcaggccctgtgggggcatcctcctggcaggccaagcgggtcgatgtttctgagctggcagcggagcagctcacggcacccccctcagcatcccccacccaaccccagactccggaaggtggcggccagtggctgaactccagttgcgcttggtcagaatcttctcaattgaataagactagaagtatcagacggcgagattcctgtctaaattccaagacaaaggttatgcctactcctacaaatcaatttaaaattcctaagttttctattggtgactccccggacagctcaacaccaaagctttcgcgggcacagcggccgcagtcgtgcacgtcagttggcagggtcactgtccacagcaccccggttagacgctcatctgggccagcaccacaaagcctgctgagcgcacggcgtgtgtcagccttgcccacacccgccagccggcgctgctctggccttccaccgatgacccccaaaacgatgcccagggccgtgggctctcccctgtgtgtgccagctcggagacgttcctctgagccccgcaagaactctgcaatgagaactgaaccaacaagggagagcaacagaaagacagattccaggctggtggatgtgtcccctgacaggggttctcctccttcccgtgtgcctcaggcacttaacttttctccagaggaaagcgattctactttctccaaaagtactgccacagaagtagctcgggaggaagccaagccgggtggagatgcagcccctagtgaggctcttcttgtagatatcaaactggaaccactcgcggtcactccagatgctgcaagccagcccctcattgaccttcctctcatcgacttctgcgataccccagaagcacacgtggctgtaggatctgaaagcaggcctctgatcgacctcatgacaaacactccagacatgaataaaaatgtggccaaaccttcaccggtggtgggacagctcatagacctgagctcccctctgatccagctgagccctgaggctgacaaggagaacgtggattccccactcctcaagttctaagccgaaccaaatcctttgccttgaaagaacagccctaaagtggttttcaaccctcagaaacaagctttaggctggtcgcagtggcttacacttgtaaccctagaacttgggaggctgaggtgggcggattacttgagcccaggagttcgggaccagcctgggaaatatagtgaaactcctgtccctacaaaaaatacaaaaattagccgggtgtggtagtgcatgcctgtagtcccagctacttgggaggctgaagtgggaggatggcctgagctcaaggagatgcaggctgcagtgggctgtgattgtgccactgcactccagcctgggcaccaatgtgagaacctgtcttggaaaaaaaaaaaaagaaacatgttttagtagaagttttatttgaaaaagaaaaataagcataaatatattcccagtgctggagagggtgggctgagggactggggccagcacggaccacccaaggcctctgcttcccgccgccaccctcctcgctgccattctctgggctggaatgtgaagcctcagtcactctaaatgaagaattttcttttgaatgttttgtatgtaaaatagcaagtggctatttttaaagttaagtttgtataaatagttagatattctagatttacattaaattgtaaaataaatggacttattgaagcatatcttgatttttaagcttatcttgattttcaaacatgcatagctatttttatcactctaatcagtaaggctactatctagactcgaatgctttcatacaagtgattttcaaaaattagtcaataaaaattgatgtcagtgcaggcccaggcccgcccccagatacactagtttctaggtctggggccagcctagtaattgttactaggcacacaggtgatgctgactcgatggcctgagacacaccccttgagaagaagctgctctggggagacgagggtatgagtggaaagaggatgggcgaggaggccgggcttacctggacactaaggtgatggacggcgtctgctgggcaggcctcggggaggacccctcagctttgctctcagcaggggcccgacaagctcagtgggcagtggcaggaactgagtgccactggaaagcccattccctttatttagaaaacgagctccaggaagccgctactttgtgtccatttctcttgaggaaacttaccaccttggttgagcggcttcatggcagacagcagcgagccagcggccggactctgtatttcggaccccactccagtgctccctgggtcataccaggatctgcctctgtccacaaagatgagggaaaatgatgactgtgctgtgctctctacttcctgcggttactgcgtgattctaaagctgccactcggaacagcgagtcctctgccgtcgagagcagggaggggtagggtggacaggcgatgccgtggaaagacgtctcggtggaaactgccatggtggaaaggtggcgcgcttctcacggctgagttgctgcgcctgcagacggaagctccccacaggcagagctgcttggatgtgtgagtcatgaagccagagaagccccgctccatgagcagtgactccccaggccctgtgacctccctcctgtcttgcagctcctcctggcaccagtccccagggctctcctgttggtagttcctgcttttcttcttggaaattcctcgtggacctcgagatctttaccctaaaatagttctgttgaatttcaccctggcaatgtaaattgatagcttatcttcacagatgccagacaatggacaactcaccatcagtcctctgctcacctgagacaaatgcatgtctgattgcttcctctgccctattgtttatgtgaaaatgcagattcactgagccagactaaggcatcagtgactgttcctctacctgcctctcacatggagattgtgtattcagtgaaaggctgatcaaagacccaaaggaatgcaacagtttatctcttatctacctatgacctgcgagctgcccaccacccccagttgttgcgcctttccagacagaaccagtgtacatcttacacgtattaattgatgtcctgtgtctccctaatatgtatcaaagcaagctgtgcctcgaccaccttgggcacatatcctcaggacatcatcctgaggctgtgtcactggcatgtccttaaccttggcaaaataaactttctaaattgaaaaaaaaaaaaaaaaaa

SEQ ID NO: 55223 - DNA, 1440 bp, Homo sapiens
gttacccagcattgtgagtgacagagcctggatctgaacgctgatcccataatgcatcctcaagtggtcatcttaagcctcatcctacatctggcagattctgtagctggttctgtaaaggttggtggagaggcaggtccatctgtcacactaccctgccactacagtggagctgtcacatcaatgtgctggaatagaggctcatgttctctattcacatgccaaaatggcattgtctggaccaatggaacccacgtcacctatcggaaggacacacgctataagctattgggggacctttcaagaagggatgtctctttgaccatagaaaatacagctgtgtctgacagtggcgtatattgttgccgtgttgagcaccgtgggtggttcaatgacatgaaaatcaccgtatcattggagattgtgccacccaaggtcacgactactccaattgtcacaactgttccaaccgtcacgactgttcgaacgagcaccactgttccaacgacaacgactgttccaacgacaactgttccaacaacaatgagcattccaacgacaacgactgttccgacgacaatgactgtttcaacgacaacgagcgttccaacgacaacgagcattccaacaacaacaagtgttccagtgacaacaacggtctctacctttgttcctccaatgcctttgcccaggcagaaccatgaaccagtagccacttcaccatcttcacctcagccagcagaaacccaccctacgacactgcagggagcaataaggagagaacccaccagctcaccattgtactcttacacaacagatgggaatgacaccgtgacagagtcttcagatggcctttggaataacaatcaaactcaactgttcctagaacatagtctactgacggccaataccactaaaggaatctatgctggagtctgtatttctgtcttggtgcttcttgctcttttgggtgtcatcattgccaaaaagtatttcttcaaaaaggaggttcaacaactaagtgtttcatttagcagccttcaaattaaagctttgcaaaatgcagttgaaaaggaagtccaagcagaagacaatatctacattgagaatagtctttatgccacggactaagacccagtggtgctctttgagagtttacgcccatgactgcagaagactgaacaggtatcagcacatcagatgtcttttagactccaagacaatttttctgtttcagtttcatctggcattccaacatgtcagtgatactgggtagagtaactctcccactccaaactgtgtatagtcaacctcatcattaatgtagtcctaatttgttttgctaaaactggctcaatccttctgatcattgcagagttttctctcaaacatgaacactttagaattgtatgttctctttagaccccataaatcctgtat

SEQ ID NO: 55224 - DNA, 1375 bp, Homo sapiens
ggagcgcggacggctgggctgctgctgggcggccgcggggcagcggagggcgccggcactccggtccccgccgctccccgtccccgctgctcctagcccctgccgcgtccccggcggagcgggcatggcgccacccgcggcgcctggccgggaccgtgtgggccgtgaggatgaggacggctgggagacgcgaggggaccgcaaggcccggaagcccctggtggagaagaagcggcgcgcgcggatcaacgagagcctgcaggagctgcggctgctgctggcgggcgccgaggtgcaggccaagctggagaacgccgaagtgctggagctgacggtgcggcgggtccagggtgtgctgcggggccgggcgcgcgagcgcgagcagctgcaggcggaagcgagcgagcgcttcgctgccggctacatccagtgcatgcacgaggtgcacacgttcgtgtccacgtgccaggccatcgacgctaccgtcgctgccgagctcctgaaccatctgctcgagtccatgccgctgcgtgagggcagcagcttccaggatctgctgggggacgccctggcggggccacctagagcccctggacggagtggctggcctgcggggggcgctccgggatccccaatacccagccccccgggtcctggggacgacctgtgctccgacctggaggaggcccctgaggctgaactgagtcaggctcctgctgaggggcccgacttggtgcccgcagccctgggcagcctgaccacagcccaaattgcccggagtgtctggaggccttggtgaccaatgccagccagagtcctgcgggggtgggcccggccctccctggatctcctccctcctcccaggggttcagatgtggtggggtagggccctggaagtctcccaggtcttccctccctcctctgatggatggcttgcagggcagcccctggtaaccagcccagtcaggccccagccccgtttcttaagaaacttttagggaccctgcagctctggagtgggtggagggagggagctacgggcaggaggaagaattttgtagagctgccagcgctctcccaggttcacccacccagccttcaccagccctgtgcgggctctgggggcagaggtggcaggaatggtgctgggcactagtgttccaggcagccctgggctaaacaaaagcttgaacttgccacttcagcggggagatgagaggcaggtgcactcagctgcactgcccagagctgtgatgctctgtacatcttgtttgtagcacacttgagtttgtgtattccattgacatcaaatgtgacaattttactaaataaagaattttggagttagttacccttgaaaaaaaaaaaaaaaaaa

SEQ ID NO: 55225 - DNA, 2711 bp, Homo sapiens
attttgcaaggagagctgagacgggctgctccactgtactttgttggctgagaagttgagcagggggtgggggtgggagggtggggggctgggggggtcgcgtccgaaagccctcacaccggtccgggtgccacctctccctgcttgggcgccgccgcgcgagcgcttcccttccccctgcaagcgcccggataatgtctgagaatgtccatttctgggacgcttagcagctattatgtcgactcgatcataagtcacgagagtgaggacgcgcctccagccaagtttccttctggccagtacgcgagctcgcggcagccgggccacgcggagcacctggagttcccctcgtgcagcttccagcccaaagcgccggtgttcggcgcctcctgggcgccgctgagcccgcacgcgtccgggagcctgccgtccgtctaccacccttacatccagccccagggcgtcccgccggccgagagcaggtacctccgcacctggctggagccggcgccgcgcggcgaagcggccccggggcagggccaggcggcggtgaaggcggagccgctgctgggcgcgcctggggagctgctcaaacagggcacgcccgagtacagtttggaaacttcggcgggcagggaggccgtgctgtctaatcaaagacccggctacggggacaataaaatttgcgaaggaagcgaggacaaagagaggccggatcaaaccaacccctccgccaactggctgcacgctcgctcttcccggaaaaagcgctgtccctacaccaaataccagacgctggagctagagaaggagtttctgttcaatatgtacctcaccagggaccgtaggcacgaagtggccagactcctcaatctgagtgagagacaagtcaaaatctggtttcagaaccggcggatgaaaatgaagaaaatgaataaggagcagggcaaagagtaaagattaaagattacccccagtcctccctagctcttccccatctcactcttagttatgtgacgactgcaaagccagtgctgtctgggatgtattcaagtgaatggggaagggagtctctcttccaagtcctttatctgcacctagaacctccctcctttcctttgcccttacctgtctctctcttctctctaggtgtcaggagaaagttttgttgatttagaagatagaaatagttggttcctaagaatgtgatgggccacaaggaaagagagaccccagtcaagctcctagtatgccctgtaatttttctgggaagtcctagcccctcacttccagcttgcctgtttcttctctacacccacccaaaagtcacccagggacactccaactctacacagctcagcagacatccacacacagtaatggggtgagctcacaaccaccattcagtcaagtgaggtgacactccagttgcagaccatcgcacaccaaatttggcaaaacagccctcagactgtcaggcaagcccgggttctacccctaatgcaaatacccaccagggagatgtctagaggcagactcctgagtgaggtgttgcagcccaaaggctgcagcattgccataccattcccatggagttgccaactattctcaggccaagggccatggggaagatggagcaaacctagcccccaagccggtgggctagaaagtacaagaaaaggcagcacgtggttttatgaagctatcttaggtggagctactccccacctcccaccaacatatacattttgttgcaggaaatgtttaattccgcatgatgtttccctctccttccaacaaaagaaggtcaaactgtgggtcgtagagccttgacaatgttgtcctcctgttcatctgtgcaccacttgacagactgtagcttctcttgctctcgaccggccctgcattcttccgcaccctccctagctctgaaatcaactctcttcggtcgtatccaccttgcacccgcaagtcaagccgccccttgtagaaaaatccctccaccttccgttccccgctaggtcaaccccactgtagacaggaaagccaggccaggagagtccgaatgagaatttattgtgaatcgattcccaagctcccttccgggacaagtggtctgggacagggaggagcaacggccccagcgcgcaacgctctgcgcgttcctccgaatcccgtcggcttctcgacccacgcagagaagccccgggcttggcggctctagccccagcgccaaaggagacccgccccagggccgggcttggcctcctgcttcatgggcctggatgcagatctgcgtggctggtgcgtgcgcgcgcttctgggaaacagtcccgcgtgcaaaggaaaggggcaaaatggcacctaagcatcagatggaagcttactctctgcttccgttcctccccctgctcccctacttctcagtccccttcaatttgtagactcttgctcctgcttctcctgatcctgcaaggggacattccagtagaagttttttgctttgtcggtggctgtcgtgaaattgtgcttgtgtttcgtgatttctttgggggtgattgtctcgcttgttttcagttgtcgattatatgggagggttctgggtgggagtggggagggcgaggggcctagagctctaattgtttgttttggaagaaaaaaagaaaaagaacaaaaaatatatatcactctagaaaataaaaaaaaaaaaa

SEQ ID NO: 55226 - DNA, 4637 bp, Homo sapiens
aggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgcaattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggccagtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcgccgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccagcgccaaaacaagccaaagagcctcccaccagagccgggaggaaaaggcccctgcaatgtggtgacacctcccctttcacacctggatccatcttgagagccacagtcactggattgactttgctgtcaaaactactgacagggagcagcccccgggccgctggctggtgggcccccaattgacacccatgccagagaggtggggatcctgcctaaggttgtctacgggggcacttggaggacctggcgtgctcagacccaacagcaaaggaactagaaagaaggacccagaaggcttgctttcctgcatctctgtgaagcctctctccttggccacagactgaactcgcagggagtgcagcaggaaggaacaaagacaggcaaacggcaacgtagcctgggctcactgtgctggggcatggcgggatcctccacagagaggaggggaccaattctggacagacagatgttgggaggatacagaggagatgccacttctcactcaccactaccagccagcctccagaaggccccagagagaccctgcaagaccacggagggagccgacacttgaatgtagtaataggcagggggccctgccaccccatccagccagaccccagctgaaccatgcgtcaggggcctagaggtggagttcttagctatccttggctttctgtgccagcctggctctgcccctcccccatgggctgtgtcctaaggcccatttgagaagctgaggctagttccaaaaacctctcctgacccctgcctgttggcagcccactccccagccccagccccttccatggtactgtagcaggggaattccctccccctccttgtgccttctttgtatataggcttctcaccgcgaccaataaacagctcccagtttgt

SEQ ID NO: 55227 - DNA, 4495 bp, Homo sapiens
aggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgcaattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggccagtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcgccgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccagcgccaaaacaagccaaagagcctcccaccagagccgggaggaaaaggcccctgcaatgtggtgacacctcccctttcacacctggatccatcttgagagccacagtcactggattgactttgctgtcaaaactactgacagggagcagcccccgggccgctggctggtgggcccccaattgacacccatgccagagaggtggggatcctgcctaaggttgtctacgggggcacttggaggacctggcgtgctcagacccaacagcaaaggaactagaaagaaggacccagaaggcttgctttcctgcatctctgtgaagcctctctccttggccacagactgaactcgcagggagtgcagcaggaaggaacaaagacaggcaaacggcaacgtagcctgggctcactgtgctggggcatggcgggatcctccacagagaggaggggaccaattctggacagacagatgttgggaggatacagaggagatgccacttctcactcaccactaccagccagcctccagaaggccccagagagaccctgcaagaccacggagggagccgacacttgaatgtagtaataggcagggggccctgccaccccatccagccagaccccagctgaaccatgcgtcaggggcctagaggtggagttcttagctatccttggctttctgtgccagcctggctctgcccctcccccatgggctgtgtcctaaggcccatttgagaagctgaggctagttccaaaaacctctcctgacccctgcctgttggcagcccactccccagccccagccccttccatggtactgtagcaggggaattccctccccctccttgtgccttctttgtatataggcttctcaccgcgaccaataaacagctcccagtttgt

SEQ ID NO: 55228 - DNA, 3789 bp, Homo sapiens
cccagagccgcctccccctgttgctggcatcccgagcttcctcccttgccagccaggacgctgccgacttgtctttgcccgctgctccgcagacggggctgcaaagctgcaactaatggtgttggcctccctgcccacctgtggaagcaactgcgctgattgatgcgccacagacttttttcccctcgacctcgccggcgtaccctcccacagatccagcatcacccagtgaatgtacattagggtggtttcccccccagcttcgggctttgtttgggtttgattgtgtttggctcttcgctaagctgatttatgcagcagaagccccaccggctggagagaaacaaaagctcttttctttgtcccggagcaggctgcggagcccttgcagagccctctctccagtcgccgccgggcccttggccgtcgaaggaggtgcttctcgcggagaccgcgggacccgccgtgccgagccgggagggccgtaggggccctgagatgccgagcggtgcccgggcccgcttacctgcaccgcttgctccgagccgcggggtccgcctgctaggcctgcggaaaacgtcctagcgacactcgcccgcgggccccgaggtcgcccgggaggccgagcccgcgtccggaaggcagccaggcggcgggcgcggggcgggctgttttgcattatgtgcggctcggccctggctttttttaccgctgcatttgtctgcctgcaaaacgaccggcgaggtcccgcctcgttcctctgggcagcctgggtgttttcacttgttcttggactgggccaaggtgaagacaatagatgtgcatcttcaaatgcagcatcctgtgccaggtgccttgcgctgggtccagaatgtggatggtgtgttcaagaggatttcatttcaggtggatcaagaagtgaacgttgtgatattgtttccaatttaataagcaaaggctgctcagttgattcaatagaatacccatctgtgcatgttataatacccactgaaaatgaaattaatacccaggtgacaccaggagaagtgtctatccagctgcgtccaggagccgaagctaattttatgctgaaagttcatcctctgaagaaatatcctgtggatctttattatcttgttgatgtctcagcatcaatgcacaataatatagaaaaattaaattccgttggaaacgatttatctagaaaaatggcatttttctcccgtgactttcgtcttggatttggctcatacgttgataaaacagtttcaccatacattagcatccaccccgaaaggattcataatcaatgcagtgactacaatttagactgcatgcctccccatggatacatccatgtgctgtctttgacagagaacatcactgagtttgagaaagcagttcatagacagaagatctctggaaacatagatacaccagaaggaggttttgacgccatgcttcaggcagctgtctgtgaaagtcatatcggatggcgaaaagaggctaaaagattgctgctggtgatgacagatcagacgtctcatctcgctcttgatagcaaattggcaggcatagtggtgcccaatgacggaaactgtcatctgaaaaacaacgtctacgtcaaatcgacaaccatggaacacccctcactaggccaactttcagagaaattaatagacaacaacattaatgtcatctttgcagttcaaggaaaacaatttcattggtataaggatcttctacccctcttgccaggcaccattgctggtgaaatagaatcaaaggctgcaaacctcaataatttggtagtggaagcctatcagaagctcatttcagaagtgaaagttcaggtggaaaaccaggtacaaggcatctattttaacattaccgccatctgtccagatgggtccagaaagccaggcatggaaggatgcagaaacgtgacgagcaatgatgaagttcttttcaatgtaacagttacaatgaaaaaatgtgatgtcacaggaggaaaaaactatgcaataatcaaacctattggttttaatgaaaccgctaaaattcatatacacagaaactgcagctgtcagtgtgaggacaacagaggacctaaaggaaagtgtgtagatgaaacttttctagattccaagtgtttccagtgtgatgagaataaatgtcattttgatgaagatcagttttcttctgagagttgcaagtcacacaaggatcagcctgtttgcagtggtcgaggagtttgtgtttgtgggaaatgttcatgtcacaaaattaagcttggaaaagtgtatggaaaatactgtgaaaaggatgacttttcttgtccatatcaccatggaaatctgtgtgctgggcatggagagtgtgaagcaggcagatgccaatgcttcagtggctgggaaggtgatcgatgccagtgcccttcagcagcagcccagcactgtgtcaattcaaagggccaagtgtgcagtggaagaggcacgtgtgtgtgtggaaggtgtgagtgcaccgatcccaggagcatcggccgcttctgtgaacactgccccacctgttatacagcctgcaaggaaaactggaattgtatgcaatgccttcaccctcacaatttgtctcaggctatacttgatcagtgcaaaacctcatgtgctctcatggaacaacagcattatgtcgaccaaacttcagaatgtttctccagcccaagctacttgagaatatttttcatcattttcatagttacattcttgattgggttgcttaaagtcctgatcattagacaggtgatactacaatggaatagtaataaaattaagtcctcatcagattacagagtgtcagcctcaaaaaaggataagttgattctgcaaagtgtttgcacaagagcagtcacctaccgacgtgagaagcctgaagaaataaaaatggatatcagcaaattaaatgctcatgaaactttcaggtgcaacttctaaaaaaagatttttaaacacttaatgggaaactggaattgttaataattgctcctaaagattataattttaaaagtcacaggaggagacaaattgctcacggtcatgccagttgctggttgtacactcgaacgaagactgacaagtatcctcatcatgatgtgactcacatagctgctgactttttcagagaaaaatgtgtcttactactgtttgagactagtgtcgttgtagcactttactgtaatatataacttatttagatcagcatagaatgtagatcctctgaagagcactgattacactttacaggtacctgttatccctacgcttcccagagagaacaatgctgtgagagagtttagcattgtgtcactacaagggtacagtaatccctgcactggacatgtgaggaaaaaaataatctggcaagtatattctaaggttgccaaacacttcaacagttggtggttgaatagacaagaacagctagatgaataaatgattcgtgtttcactctttcaagaggtgaacagatacaaccttaatcttaaaagattattgctttttaaagtgtgtagttttatgcatgtgtgtttatggtttgcttatttttgcaagatggatactaattccagcattctctcctctttgcctttatgttttgttttcttttttacaggataagtttatgtatgtcacagatgactggattaattaagtgctaagttactactgccataaaaaactaataatacaatgtcactttatcagaatactagttttaaaagctgaatgttaa

SEQ ID NO: 55229 - DNA, 1382 bp, Homo sapiens
cattatgctaacagcataaacatgcagggggtgggagcagggtcacaaaagtgagtgttgtcaattctacttggaatgaaaggttgaaataatttaaacagtacgggaaatgcagagcaattttctcctctggtgacaatatagtgtccaacacttggaagtgatttttaagaatgtttatttaaattaaaaggatggatttccaaggaaaaaaaataaggaaaaggaaagaaaaaactgaacagaaaacgcaaaagtatcagtttggtcactaacctttgcaaggatacctttttattttctttaagattcctgttgtttatacacagattttaagtttactcctactgctgacccaagtgaaattccttctccagtcacagtgtcaacctctaccccccaactgcaacgagagttttgaggggcatcaatcacaccgagaagtcacagcccctcaaccactgaggtgtgggggggtagggatctgcatttcttcatatcaaccccacactatagggcacctaaatgggtgggcggtgggggagaccgactcacttgagtttcttgaaggcttcctggcctccagccacgtaattgcccccgctctggatctggtctagcttccggattcggtggccagtccgcggggtgtagatgttcctgacggccccaaagggtgcctgaacgccgccggtcacctccttcaggaagacttcgaagctggacaccttcttctcatggatgacgacgcggcgccccgcgtagaaggggtccccgttgcggtacacaagcacgctcttcacgacgggctgagacaggtggctggacctggcgctgctgccgctcatcttccccgctggccgccgcctcagctcgctgcttcgcgtcgggaggcacctccgctgtcccagcggcctcaccgcacccagggcgcgggatcgcctcctgaaacgaacgagaaactgacgaatccacaggtgaaagagaagtaacggccgtgcgcctaggcgtccacccagaggagacactaggagcttgcaggactcggagtagacgctcaagtttttcaccgtggcgtgcacagccaatcaggacccgcagtgcgcgcaccacaccaggttcacctgctacgggcagaatcaaggtggacagcttctgagcaggagccggaaacgcgcggggccttcaaacaggcacgcctagtgagggcaggagagaggaggacgcacacacacacacacacacaaatatggtgaaacccaatttcttacatcatatctgtgctaccctttccaaacagcctaatttttcttttctctcttcttgcacctttacccctcaatctcctgcttcctcccaaattaaagcaattaagttcctgg

SEQ ID NO: 55230 - DNA, 2332 bp, Homo sapiens
gtctgcatagaaagaccaacaaccagcaccacttccttgctttttccagccatgaatgcttccagtcggaatgtgtttgacacgttgatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttcagtgtgttgattaatatagtaaatttctgaaactgtg

SEQ ID NO: 55231 - DNA, 2446 bp, Homo sapiens
gttgcatacagatgagttggcagccggtctgagctggcccacagactcataaaatcaacagggcctcgggtaccctcacctagcatatccaaactcttgcatcaaaggtgcagggacttgctcacatcgagaatctggttgctttcttggagaccaagaaaatgagtttttgtttctacatttactccagcaatccatgagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttcagtgtgttgattaatatagtaaatttctgaaactgtg

SEQ ID NO: 55232 - DNA, 2579 bp, Homo sapiens
gttgcatacagatgagttggcagccggtctgagctggcccacagactcataaaatcaacagggcctcgggtaccctcacctagcatatccaaactcttgcatcaaaggtgcagggacttgctcacatcgagaatctggttgctttcttggagaccaagaaaatgagtttttgtttctacatttactccagcaatccatgaggactttataggaattttgcaccattctgaatggatacatttggatttctcaacatttgttcagcttcctaatgactgttgtgacaattgctctataccagtgaatgccaactgtttatctctgctctgaacagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttcagtgtgttgattaatatagtaaatttctgaaactgtg

SEQ ID NO: 55233 - DNA, 2616 bp, Homo sapiens
gttgcatacagatgagttggcagccggtctgagctggcccacagactcataaaatcaacagggcctcgggtaccctcacctagcatatccaaactcttgcatcaaaggtgcagggacttgctcacatcgagaatctggttgctttcttggagaccaagaaaatgagtttttgtttctacatttactccagcaatccatgaggtttcttctctactgtgccttcatccccatcctgggccctgacaaagacagtgtgacaagttctgagccccacaggtggaatcccaaaccaagcagctcttgctggtcaccccaagatctacttatacatgaagttttgaaaatcatctcctgaacctcttctgacagagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttcagtgtgttgattaatatagtaaatttctgaaactgtg

SEQ ID NO: 55234 - DNA, 2749 bp, Homo sapiens
gttgcatacagatgagttggcagccggtctgagctggcccacagactcataaaatcaacagggcctcgggtaccctcacctagcatatccaaactcttgcatcaaaggtgcagggacttgctcacatcgagaatctggttgctttcttggagaccaagaaaatgagtttttgtttctacatttactccagcaatccatgaggactttataggaattttgcaccattctgaatggatacatttggatttctcaacatttgttcagcttcctaatgactgttgtgacaattgctctataccagtgaatgccaactgtttatccctgctctgaacaggtttcttctctactgtgccttcatccccatcctgggccctgacaaagacagtgtgacaagttctgagccccacaggtggaatcccaaaccaagcagctcttgctggtcaccccaagatctacttatacatgaagttttgaaaatcatctcctgaacctcttctgacagagatcagggtgttgacagaaagtatgttcaaacatcttcggaaatgggtcgtcactcgcttttttgggcattctcggcaaagagcaaggctagtctccaaagatggaaggtgcaacatagaatttggcaatgtggaggcacagtcaaggtttatattctttgtggacatctggacaacggtacttgacctcaagtggagatacaaaatgaccattttcatcacagccttcttggggagttggtttttctttggtctcctgtggtatgcagtagcgtacattcacaaagacctcccggaattccatccttctgccaatcacactccctgtgtggagaatattaatggcttgacctcagcttttctgttttctctggagactcaagtgaccattggatatggattcaggtgtgtgacagaacagtgtgccactgccatttttctgcttatctttcagtctatacttggagttataatcaattctttcatgtgtggggccatcttagccaagatctccaggcccaaaaaacgtgccaagaccattacgttcagcaagaacgcagtgatcagcaaacggggagggaagctttgcctcctaatccgagtggctaatctcaggaagagccttcttattggcagtcacatttatggaaagcttctgaagaccacagtcactcctgaaggagagaccattattttggaccagatcaatatcaactttgtagttgacgctgggaatgaaaatttattcttcatctccccattgacaatttaccatgtcattgatcacaacagccctttcttccacatggcagcggagacccttctccagcaggactttgaattagtggtgtttttagatggcacagtggagtccaccagtgctacctgccaagtccggacatcctatgtcccagaggaggtgctttggggctaccgttttgctcccatagtatccaagacaaaggaagggaaataccgagtggatttccataactttagcaagacagtggaagtggagacccctcactgtgccatgtgcctttataatgagaaagatgttagagccaggatgaagagaggctatgacaaccccaacttcatcttgtcagaagtcaatgaaacagatgacaccaaaatgtaacagtggcttttcaacgggagtaaagcaaagtctctaaagctcctagtacctagaagcattatgaagcagtcaacaatttaggggtacgaaagtaggatgagagccttcaaagtctaccagcacaaagacccctgagccccgcaattgtgatcccacaagacatgcatctccacaaggctactgtattagaacgtgcaatgcatttatatgaaactggtgtatggaagacataggtgctctcttgaaatcttaaatatgattatttgagctcatataaggtggattggagcagataaaattatcaaaagtttcatgaacaggccaaacaaaatattttttaaagtttccttaaagaagttatgaactttagaaaggatcaggggacaataataatctcattttgattctactgataagaatgactccacttttaatgtggacttttactcatggaaaaattgtctcctaatttggggagatgaaccaaccaatcaatgacaagaaaacgcttacacaaagaacaatttgaggctctaagcttctcatgtggtacgtttagacagaggctaaatctgcacactagaatcttgatgataccttcctgcaagacagaatgctttagttaaaagtggtgatgatatttctttcaatctgtattggatggcttaaagggctataaatctgtttataaagagcatttcctgctcttcgaagacagcaatgaggagttggaaggtgcaaagtcagtagagaagggaatgtatcattaatgcacctgagaagaaacagtttcatgtgttcctccacctagagtttgtactggaatgctatttctaaagaagaagtgggaaagagagaggaatgggatggagccccacagtcagaatgttactatgtctttctttccctgacagcccatcttcctaaaagggaccagcttatggaaggctcgaccttgaggggaaagttttactgtgaaagtcttcttcagatccccacctgcatcattccgaatgtgtcctggaaaaaaactggtactcaaagctgcttaggaatcaaaatgttttcagtgtgttgattaatatagtaaatttctgaaactgtg

SEQ ID NO: 55235 - DNA, 2867 bp, Homo sapiens
ggtgtttggagagcccggactggatgcccactagaatcctgtgctgtgaacagtgagagagttttcttcattttgaggaaccctaaacacctatctttcccaaggcaacctgtctggactgagcatttctctgacttgacataacttcccatccagccaggagtctgcactcttcagtctttgcaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtccaaaa

SEQ ID NO: 55236 - DNA, 2919 bp, Homo sapiens
ctcctctgcccaatgtctcccaatctctttcctttctctcttcagttcctccaggtaattcttactcaaacttgtaccaacttgtttttgactgacagtgaacagtgagagagttttcttcattttgaggaaccctaaacacctatctttcccaaggcaacctgtctggactgagcatttctctgacttgacataacttcccatccagccaggagtctgcactcttcagtctttgcaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtccaaaa

SEQ ID NO: 55237 - DNA, 2732 bp, Homo sapiens
cagatctctgggatcttcagctgagattgggccccagcacctggactcaaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgtcaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttagataaacagacatttagcaatcctgacattaaaaggaaatgtatttctatacaagattattagctgtaatacaagatatttatttaaccaatgaccttatggctgagagttgaattgtggttcagtattcattgatctcactgctttaaaacatgctctttttgttcaagcaggaaaaatattatatctaattatgtctatgtggtaatacctaaaaagaggtagagagactctatgttcacaaaatatagtaatttcatttttacctttcttcagtggactgaattgtatggaaggaaattgatcagatctgtaattcacaactgtggaaacctacacaaatggggctgatgccattgtttcctctattttattttatttatttttgaatccactatctctttccattcaaaatatttccattcaaaatgtggttcacagacccgccacatcagcaccatccgagagcttattagtaatgtgtagattctcatgtcccagccagacttacagaattggggtctgtatcttaacaagaaccccagatgatttgtgtacaaatgaaagttcgaaagctgtgctctggacagtgttctcaaagcaactttctgaagccgtgtggaaaactgactctgtgtgggtcccgtatccctgtggcatccagacctggcctctcttcatttcattattattggccaatatttctttcagccatttcatttcttatctattaaaatggcttgcccataaaggaactgcataggattatcccctgacattccaagagcaaaataaagctcttgagagtaattgttgtctcagtcatgcttgctgattacagttagcacaaaagaaaaattcagctgcctgacaatacaggaaatgttctcagatgctgatgtttgtaaggtccggtggggccatgaggaagaagaggagctgaaggtaagaaactcataaacaagatgactctttgatgcatgaacaagatttgaaaatctcaagcctgtaaagaatacccctgctatttaaataaagctcataccaagaggtaacattttgccccgggccaaattcaggggtctagtgccctgcattcctttgaggcaaaaaataaatgggctatgactggttaaatgtccaaaa

SEQ ID NO: 55238 - DNA, 4021 bp, Homo sapiens
tgtctggagcttttctttcctttattattaactaaagagcattctctaccattgcccagctgaaagcacctagctcatagattctctgtggggagagtgaataaagaatgggggattgaggcacagagtgttaaaatagtgagacacaggattctaactggcagactggcactttatctcaattcttaactgctgtgttgcctctcactttaaagacatccacattccaccctgggccttgcccgtctggtgagcccaatctctgctggtcagtcacgcagttgaggtcagggaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgcaaaaaaaaaaaaaaaaaaa

SEQ ID NO: 55239 - DNA, 3926 bp, Homo sapiens
tgtctggagcttttctttcctttattattaactaaagagcattctctaccattgcccagctgaaagcacctagctcatagattctctgtggggagagtgaataaagaatgggggattgaggcacagagtgttaaaatagtgagacacaggattctaactggcagactggcactttatctcaattcttaactgctgtgttgcctctcactttaaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgcaaaaa

SEQ ID NO: 55240 - DNA, 4025 bp, Homo sapiens
gagaactcagtggcctttgtctgtggtgaatgtatccggaaaggcaaagaagagagagattctcctgtggggtttctcatctccatggcggtaggtgctgacagcttcagaagggtactaacagggccaagagaaaagggccctgagatgctcagctacggtgctcttacaagatgaaaaggacatggggttcagatctgcacttcatcatctttcactaagacatccacattccaccctgggccttgcccgtctggtgagcccaatctctgctggtcagtcacgcagttgaggtcagggaaggagtaactcaagatgattttgatgttgcagttttaaatttcactttgacttgagctgggaaatcctttggcctattataccatggatgctaaaaatggttctaactgaaaacccaaaccaagaaatagcaacaagtctagaattcttactactacaaaactcacctggatccctaagggcacagcaaagaatgagctattacggcagcagctatcatattatcaatgcggacgcaaaatacccaggctacccgccagagcacattatagctgagaagagaagagcaagaagacgattacttcacaaagatggcagctgtaatgtctacttcaagcacatttttggagaatggggaagctatgtggttgacatcttcaccactcttgtggacaccaagtggcgccatatgtttgtgatattttctttatcttatattctctcgtggttgatatttggctctgtcttttggctcatagcctttcatcatggcgatctattaaatgatccagacatcacaccttgtgttgacaacgtccattctttcacaggggcctttttgttctccctagagacccaaaccaccataggatatggttatcgctgtgttactgaagaatgttctgtggccgtgctcatggtgatcctccagtccatcttaagttgcatcataaatacctttatcattggagctgccttggccaaaatggcaactgctcgaaagagagcccaaaccattcgtttcagctactttgcacttataggtatgagagatgggaagctttgcctcatgtggcgcattggtgattttcggccaaaccacgtggtagaaggaacagttagagcccaacttctccgctatacagaagacagtgaagggaggatgacgatggcatttaaagacctcaaattagtcaacgaccaaatcatcctggtcaccccggtaactattgtccatgaaattgaccatgagagccctctgtatgcccttgaccgcaaagcagtagccaaagataactttgagattttggtgacatttatctatactggtgattccactggaacatctcaccaatctagaagctcctatgttccccgagaaattctctggggccataggtttaatgatgtcttggaagttaagaggaagtattacaaagtgaactgcttacagtttgaaggaagtgtggaagtatatgcccccttttgcagtgccaagcaattggactggaaagaccagcagctccacatagaaaaagcaccaccagttcgagaatcctgcacgtcggacaccaaggcgagacgaaggtcatttagtgcagttgccattgtcagcagctgtgaaaaccctgaggagaccaccacttccgccacacatgaatatagggaaacaccttatcagaaagctctcctgactttaaacagaatctctgtagaatcccaaatgtagtcctaaattgcaattatgagggctaccactgaatcattttatctttcagccaatcaagtcgttgtaaacgtggcttttttgaaagtgttatggctatgttttatgatgatgctgggtaagtagagtaagttaaacttggtaaaagataatctaaaaattccatagttctcagttattaaaatttttcttgttcgccaattttgtattaagaatgctattaagcctaattgattaaaatttatcttttttattatcttacatgcttgtatcttcagttggaggtgtagtattcaaaaacggggaatgaaggcaggaaggaggctggaataaataaaaataaaaatagacaagtaagacagcataaataatacatttttaaacatgtcaacattgataatacaatgaagatttaccataaaaagtatcatatctaaccaagatatgcaaaagatgcattcagtaagctgtaacgttgagaaatgtaactgtgaaatcagctcaccagttcaagtcactaggtttgccacttggaccgtcttggtttcagcgagcatagcgagtggctgtaagaaattgtccatgccaccaattccactgctacttgcccaggtagtgatcagtgagagttagaagcaattttttctctaaccgatgaggcagaagaaaagttaacagtatttaaagcagcatttctctcttaacgttcctgggagactccaacaaatggagaccagaaacaaggcaaccacgaccttgctaggttctctgaggaggggactttctatgttcacgtcccaccttcttcgaggacatgaccaagggacaggatcatacagatgaggtgaggggatggttagcagcgataaacattctcagacccttggagagaaaccgttgctagcttgctggtcccgaaagattgcaactttggctgctacagaaaggatagaacctttttggggggagggtggggagggagatatttatttgtgcccagaagcagttatgtatgcttcttgtcttggttactgtacaagatacaaatgactcgagttgtggattgcaagaaactcttttattaaacttggaacaaccatttaaatgaaggattttgtgagatagaattcaattaaagcgatttgaatgcacagtaagtggataatctgagtacaatgaaatttcttaagttttagaacatgagataaagttgtatactctactttcatgttaaaatgttaatcatgattactttaagcccacatccactgagtaaagagtcactttaaactttataaatcaaagagatattaggaacattcagaattatttgtgttttgtttttgttttacattgttgctgcactggcaataagtatgtggcactgtttttatttgtttatgttatttaaatacacacccagacacacacacacacagtttttgctttttctggaaaatctttctttctcttctctctccatgaaaattaaaacacacaagtgaatgaagtaattacatagtccaagattagaaatacaagtaaaatatataggtataggtagatagagtgcctttctgtttcttttcttttcttttttctttttttgttcttccttcctttcttccctcctccccctcatccttccctttctccttcttttcccttttttttttttttttgacctgggagtaataaagttactttttaaatgcacgtatgcaatcttttattcctcttgttttatggataagagatttgttcaggtcaaaagttgcaaaactgttctgaagcttaatattagagacccaagtaagattgtttttagtcttgcttgaggaatgcacactccatttaaaaaattgtgcgctctgtagatttggattttacagcagcaattacttggctaaattagagtactgcaatcttgtaagtagaaaacagccaccatgacaataaacaaaaacacttaaaaatatttttagcttgttttacctacatctagtttcatttcatcttgctttgctttgttgactctgctaccgctgatgtttgccttgtcaatatcagaataggggcatcagtgtcccgtgaaatacattttgttgtgctatgagcctctgtaatcaaatgcttgtactcagaagagagtgtaaaatcagcatttctatgtaacatatatctctaattatctgtgtaattttataacatactttgacaaccccagtgagttacttaataataaagatcttaaaataatgcaaaaaaaaaaaaaaaa

SEQ ID NO: 55241 - DNA, 2566 bp, Homo sapiens
ttataattttatttatctaaaatctgtcttcctccctagacagtaagctctctgaagtcaagaaccatagttgttttgttcactactgtatactcagcacctaatagtacttggcacataagtactcagggactatttgtcaaatgcaagaacatatgcccctaaagcagaagtcaggaaaaccagaaaaaatgcctttaagtattacagaaatgccacaggcctccacttaaattgaaaagcaagctaacccctcttgataaaaatgtggattgagatcaagaagcagcttctctgctccttctggaatctccacctggtttagcctgctgcctccactcctgcctccaccatgtccatcagggtgatccagaagtcctacaaggtgtccacctttggcccccaggctttcagcagccacccctacactagtgggcccagtgcctgcaccagctccttgagcttctccctagtggggagcttcactgtgcagcttctggggtggcctgggcggaggctatggtggggccagcagtatgcgaggcatcaccaccatcacggtaaaccagagcctgctgagcccccttaacctggaggtggactccaacatccaggctgtatacacccaggagaaggagcagatcaagaccctcaacaacaagtttgcctccttcacagaccaggtatggttcctggagcagcagaacaaggtgctggagaccaagtggagccttctgcagcagcacaagatggctgggagcaacatggacaacatgttcgggagctatatcaacaaccttaggcggctgctggagccaggagaagctgaggctggaagcggagcttggcaacatgcaggggctggtggaggacttcaggaacaagtatgaggatgagatcaataagcctacagagatggagaattaatttgtcctcatcaagaaggatgtggatgaaacttacatgaacaacgtagagctggagtctcacctggaagggccgactgtatgaagtggagatccgggagctgcagtcccagatctccaacatgtctgtggtgctgtccatggacagcagccactcctggacatggacagcatcatcactgaggtaaagaggcagtacaaggaggttgccaactgcagccgggctgaggctgagagcacgtaccagatcaagtatgtggagctgcagacgctggctaggaagcacagggatgacctgcggcatacaaagactcagatctccaagatgaaccggaacatcagccagctccaggctgagattgagggcctccaaggccagggggcttccctggaggccaccatcccagatgctgagcatcgtggggagctggccgttaaggatgccaatgccaagctctccaagctggaggccactctgcaacgtgtgagtaccaggagctgatgaaagtcaagctggcctggaaatggaggtcgccacctacagaaagctgcgggagagctaggagagccagctggagtctgggatgcagaacatgagtatccatacgaagaccaccagcggctatgcaggtgatctgagctcggcctatgtgggcctcacaactcgtgacctcagctatggcctgggctccagctttggctctggcacaggcttcagctccttcaggtgcaccagctccaccagggccgtggttgtgaagaagatcgagacccgcgatgggaagctggtgtctgagtcctctgacttcctgcccaagtgaacaactgtggcagctcctcctagtctgcccctcccgtggctgccacagactccaggagggaggctgctgtgtggggaagcacagacaacaggagaccccccacctgaggctcaacccacccgtgggggagtttactgtctggggaccccccttgcccatgcttccagctagaaaacaattgtggttttttttttggtccaaaataaaacctcagctagctccaccacaaaaaaaaaaaaaaaaattgtggattgagtcgttattgcttctagtttactgagttccttctatttatataaattcttgatttgatatcaagctcattctggggtgaaagtttagggaataaatcagacatacatttcagggcaaaaccccctatgtatttaaaagtagttgtgacacacttcgttaaacaattatccttaattataattcttagtctattggcttaaatttattacttgaaattgtcactactcgtttgccaagtttacatgtttagtgtctatacttacagttcttcccagatagaagatacataatttatcaaatgggcaaagaagtccttcagggagttggtaatagctctacatgctgattggtaattgaattagcaagatatggtagatctaactgattagaaggtttcaatttaacttgctgaactaaggaagtaaaatgcagaattattaaccatttcaatattatcttaatttgggatgtgataattaattaccacaaactgagtggcttaaacaaacatttatttctcacagttagggaggacgtgaagtccattattaaggccgatctggt

SEQ ID NO: 55242 - DNA, 2566 bp, Homo sapiens; identical to SEQ ID NO: 55241

SEQ ID NO: 55243 - DNA, 1883 bp, Homo sapiens
gttccatcctctgccatctactccactgttcagacacctcctaacctccgtcatgacctgtggcttcaactccataggctgtgggttccgccctggaaacttcagctgtgtctctgcctgcgggccccggccaagccgctgctgcatcaccgccgccccctaccgcggcatctcctgctaccgcggcctcaccgggggctttggcagccacagcgtgtgcgggggcttccgcgccggctcctgcggacgcagcttcggctaccgctccgggggcgtgtgcggacccagccccccatgcatcaccaccgtgtcggtcaacgagagcctcctcacgcccctcaacctggagatagaccccaacgcgcagtgcgtgaagcaggaggagaaggagcagatcaagtccctcaacagcagattcgcggccttcatcgacaaggtgcgcttcctggagcagcagaacaagctgctggagacaaagctgcagttctaccaaaactgcgagtgctgccagagtaacctggagcccctgtttgctggctacatcgagactctgcggcgggaggccgagtgcgtggaggctgacagtgggaggctggcctcagagctcaaccacgtgcaggaggtgctggagggctacaagaagaagtatgaagaagaagtagcacttcgagccacagcagagaacgagtttgtggctctaaagaaggatgtggactgtgcctacctccgcaagtcagacctggaggccaacgtggaggccctgatccaggagattgacttcctgaggcggctgtacgaggaggagatccgcattctccaatcccacatctcagacacctccgtggttgtcaagctggacaacagccgggacctgaacatggactgcatcgttgccgagatcaaggcacagtatgatgacattgccacccgtagccgggctgaggccgagtcctggtatcgcagcaagtgtgaggagatgaaggccacagtgatcaggcacggggagaccctgcgccgcaccaaggaggagatcaacgagctgaaccgcatgatccagaggctgacagccgaggtggagaatgccaagtgccagaactccaagctggaagctgcggtggcccagtctgagcagcagggtgaggcggccctcagtgatgcccgctgcaagctggccgagctggagggcgccctgcagaaggccaagcaagacatggcctgcctgatcagggagtaccaggaggtgatgaactccaagctaggcctggatatcgagatcgccacctacaggcgcctgctggagggcgaggagcagaggctgtgtgaaggtgttgaagctgtgaatgtctgtgtcagcagctcccggggtggggttgtgtgcggggacctctgcgtgtcgggctcccggccggtgacgggcagcgtctgcagtgccccctgcaacgggaacctggtggtgagcactggtttgtgcaagccctgtggccagctgaacaccacctgtggagggggctcctgcggccaggggaggtattaagtggcccaaaagagagccaggggagccccttctgcctgccagacgtgccactgccccaccaccagctgaaaacagcagcacatcgctggcttttccccttgtgttctgagaatacaccatcggctcattcccaccagtggctcctccccacctttcatcccactggaaaggggtctgtggctggggaatagacccattccttcccctgtctcagccttcagcccctcccggggagaagggccttgcttccctggaagaagcactgtgagactgttccccctgcctctctggcctcttgtctccccttttccaataaacttgggacctgcaaaaaaaaaaaaaaaaaaaa

SEQ ID NO: 55244 - DNA, 4525 bp, Homo sapiens
gcgcggtgccgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacaggtccctggagagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggc

SEQ ID NO: 55245 - DNA, 4513 bp, Homo sapiens
gcgcggtgccgccgggaaagatggtcgtggcgctgcggtacgtgtggcctctcctcctctgcagcccctgcctgcttatccagatccccgaggaatatgaaggacaccatgtgatggagccacctgtcatcacggaacagtctccacggcgcctggttgtcttccccacagatgacatcagcctcaagtgtgaggccagtggcaagcccgaagtgcagttccgctggacgagggatggtgtccacttcaaacccaaggaagagctgggtgtgaccgtgtaccagtcgccccactctggctccttcaccatcacgggcaacaacagcaactttgctcagaggttccagggcatctaccgctgctttgccagcaataagctgggcaccgccatgtcccatgagatccggctcatggccgagggtgcccccaagtggccaaaggagacagtgaagcccgtggaggtggaggaaggggagtcagtggttctgccttgcaaccctcccccaagtgcagagcctctccggatctactggatgaacagcaagatcttgcacatcaagcaggacgagcgggtgacgatgggccagaacggcaacctctactttgccaatgtgctcacctccgacaaccactcagactacatctgccacgcccacttcccaggcaccaggaccatcattcagaaggaacccattgacctccgggtcaaggccaccaacagcatgattgacaggaagccgcgcctgctcttccccaccaactccagcagccacctggtggccttgcaggggcagccattggtcctggagtgcatcgccgagggctttcccacgcccaccatcaaatggctgcgccccagtggccccatgccagccgaccgtgtcacctaccagaaccacaacaagaccctgcagctgctgaaagtgggcgaggaggatgatggcgagtaccgctgcctggccgagaactcactgggcagtgcccggcatgcgtactatgtcaccgtggaggctgccccgtactggctgcacaagccccagagccatctatatgggccaggagagactgcccgcctggactgccaagtccagggcaggccccaaccagaggtcacctggagaatcaacgggatccctgtggaggagctggccaaagaccagaagtaccggattcagcgtggcgccctgatcctgagcaacgtgcagcccagtgacacaatggtgacccaatgtgaggcccgcaaccggcacgggctcttgctggccaatgcctacatctacgttgtccagctgccagccaagatcctgactgcggacaatcagacgtacatggctgtccagggcagcactgcctaccttctgtgcaaggccttcggagcgcctgtgcccagtgttcagtggctggacgaggatgggacaacagtgcttcaggacgaacgcttcttcccctatgccaatgggaccctgggcattcgagacctccaggccaatgacaccggacgctacttctgcctggctgccaatgaccaaaacaatgttaccatcatggctaacctgaaggttaaagatgcaactcagatcactcaggggccccgcagcacaatcgagaagaaaggttccagggtgaccttcacgtgccaggcctcctttgacccctccttgcagcccagcatcacctggcgtggggacggtcgagacctccaggagcttggggacagtgacaagtacttcatagaggatgggcgcctggtcatccacagcctggactacagcgaccagggcaactacagctgcgtggccagtaccgaactggatgtggtggagagtagggcacagctcttggtggtggggagccctgggccggtgccacggctggtgctgtccgacctgcacctgctgacgcagagccaggtgcgcgtgtcctggagtcctgcagaagaccacaatgcccccattgagaaatatgacattgaatttgaggacaaggaaatggcgcctgaaaaatggtacagtctgggcaaggttccagggaaccagacctctaccaccctcaagctgtcgccctatgtccactacacctttagggttactgccataaacaaatatggccccggggagcccagcccggtctctgagactgtggtcacacctgaggcagccccagagaagaaccctgtggatgtgaagggggaaggaaatgagaccaccaatatggtcatcacgtggaagccgctccggtggatggactggaacgccccccaggttcagtaccgcgtgcagtggcgccctcaggggacacgagggccctggcaggagcagattgtcagcgaccccttcctggtggtgtccaacacgtccaccttcgtgccctatgagatcaaagtccaggccgtcaacagccagggcaagggaccagagccccaggtcactatcggctactctggagaggactacccccaggcaatccctgagctggaaggcattgaaatcctcaactcaagtgccgtgctggtcaagtggcggccggtggacctggcccaggtcaagggccacctccgcggatacaatgtgacgtactggagggagggcagtcagaggaagcacagcaagagacatatccacaaagaccatgtggtggtgcccgccaacaccaccagtgtcatcctcagtggcttgcggccctatagctcctaccacctggaggtgcaggcctttaacgggcgaggatcggggcccgccagcgagttcaccttcagcaccccagagggagtgcctggccaccccgaggcgttgcacctggagtgccagtcgaacaccagcctgctgctgcgctggcagcccccactcagccacaacggcgtgctcaccggctacgtgctctcctaccaccccctggatgaggggggcaaggggcaactgtccttcaaccttcgggaccccgaacttcggacacacaacctgaccgatctcagcccccacctgcggtaccgcttccagcttcaggccaccaccaaagagggccctggtgaagccatcgtacgggaaggaggcactatggccttgtctgggatctcagattttggcaacatctcagccacagcgggtgaaaactacagtgtcgtctcctgggtccccaaggagggccagtgcaacttcaggttccatatcttgttcaaagccttgggagaagagaagggtggggcttccctttcgccacagtatgtcagctacaaccagagctcctacacgcagtgggacctgcagcctgacactgactacgagatccacttgtttaaggagaggatgttccggcaccaaatggctgtgaagaccaatggcacaggccgcgtgaggctccctcctgctggcttcgccactgagggctggttcatcggctttgtgagtgccatcatcctcctgctcctcgtcctgctcatcctctgcttcatcaagcgcagcaagggcggcaaatactcagtgaaggataaggaggacacccaggtggactctgaggcccgaccgatgaaagatgagaccttcggcgagtacagtgacaacgaggagaaggcctttggcagcagccagccatcgctcaacggggacatcaagcccctgggcagtgacgacagcctggccgattatgggggcagcgtggatgttcagttcaacgaggatggttcgttcattggccagtacagtggcaagaaggagaaggaggcggcagggggcaatgacagctcaggggccacttcccccatcaaccctgccgtggccctagaatagtggagtccaggacaggagatgctgtgcccctggccttgggatccaggcccctccctctccagcaggcccatgggaggctggagttggggcagaggagaacttgctgcctcggatccccttcctaccacccggtccccactttattgccaaaacccagctgcaccccttcctgggcacacgctgctctgccccagcttgggcagatctcccacatgccaggggcctttgggtgctgttttgccagcccatttgggcagagaggctgtggtttgggggagaagaagtaggggtggcccgaaagggtctccgaaatgctgtctttcttgctccctgactgggggcagacatggtggggtctcctcaggaccagggttggcaccttccccctcccccagccactccccagccagcctggctgggactgggaacagaactcggtgtccccaccatctgctgtcttttctttgccatctctgctccaaccgggatgggagccgggcaaactggccgcgggggcaggggaggccatctggagagcccagagtccccccactcccagcatcgcactctggcagcaccgcctcttcccgccgcccagcccaccccatggccggctttcaggagctccatacacacgctgccttcggtacccaccacacaacatccaagtggcctccgtcactacctggctgcggggcgggcacacctcctcccactgcccactggccggc

SEQ ID NO: 55246 - DNA, 3868 bp, Homo sapiens
atgaacctctgaaaactgccggcatctgaggtttcctccaaggccctctgaagtgcagcccataatgaaggtcttggcggcaggagttgtgcccctgctgttggttctgcactggaaacatggggcggggagccccctccccatcacccctgtcaacgccacctgtgccatacgccacccatgtcacaacaacctcatgaaccagatcaggagccaactggcacagctcaatggcagtgccaatgccctctttattctctattacacagcccagggggagccgttccccaacaacctggacaagctatgtggccccaacgtgacggacttcccgcccttccacgccaacggcacggagaaggccaagctggtggagctgtaccgcatagtcgtgtaccttggcacctccctgggcaacatcacccgggaccagaagatcctcaaccccagtgccctcagcctccacagcaagctcaacgccaccgccgacatcctgcgaggcctccttagcaacgtgctgtgccgcctgtgcagcaagtaccacgtgggccatgtggacgtgacctacggccctgacacctcgggtaaggatgtcttccagaagaagaagctgggctgtcaactcctggggaagtataagcagatcatcgccgtgttggcccaggccttctagcaggaggtcttgaagtgtgctgtgaaccgagggatctcaggagttgggtccagatgtgggggcctgtccaagggtggctggggcccagggcatcgctaaacccaaatgggggctgctggcagaccccgagggtgcctggccagtccactccactctgggctgggctgtgatgaagctgagcagagtggaaacttccatagggagggagctagaagaaggtgccccttcctctgggagattgtggactggggagcgtgggctggacttctgcctctacttgtccctttggccccttgctcactttgtgcagtgaacaaactacacaagtcatctacaagagccctgaccacagggtgagacagcagggcccaggggagtggaccagcccccagcaaattatcaccatctgtgcctttgctgccccttaggttgggacttaggtgggccagaggggctaggatcccaaaggactccttgtcccctagaagtttgatgagtggaagatagagaggggcctctgggatggaaggctgtcttcttttgaggatgatcagagaacttgggcataggaacaatctggcagaagtttccagaaggaggtcacttggcattcaggctcttggggaggcagagaagccaccttcaggcctgggaaggaagacactgggaggaggagaggcctggaaagctttggtaggttcttcgttctcttccccgtgatcttccctgcagcctgggatggccagggtctgatggctggacctgcagcaggggtttgtggaggtgggtagggcaggggcaggttgctaagtcaggtgcagaggttctgagggacccaggctcttcctctgggtaaaggtctgtaagaaggggctggggtagctcagagtagcagctcacatctgaggccctgggaggtcttgtgaggtcacacagaggtacttgagggggactggaggccgtctctggtccccagggcaagggaacagcagaacttagggtcagggtctcagggaaccctgagctccaagcgtgctgtgcgtctgacctggcatgatttctatttattatgatatcctatttatattaacttattggtgctttcagtggccaagttaattcccctttccctggtccctactcaacaaaatatgatgatggctcccgacacaagcgccagggccagggcttagcagggcctggtctggaagtcgacaatgttacaagtggaataagcttacgggtgaagctcagagaagggtcggatctgagagaatggggaggcctgagtgggagtggggggccttgctccacccccatcccctactgtgacttgctttagcgtgtcagggtccaggctgcaggggctgggccaatttgtggagaggccgggtgcctttctgtcttgcttccagggggctggttcacactgttcttgggcgccccagcattgtgttgtgaggcgcactgttcctggcagatattgtgccccctggagcagtgggcaagacagtccttgtggcccaccctgtccttgtttctgtgtccccatgctgcctctgaaatagcgccctggaacaaccctgcccctgcacccagcatgctccgacacagcagggaagctcctcctgtggcccggacacccatagacggtgcggggggcctggctgggccagaccccaggaaggtggggtagactggggggatcagctgcccattgctcccaagaggaggagagggaggctgcagacgcctgggactcagaccaggaagctgtgggccctcctgctccacccccatcccactcccacccatgtctgggctcccaggcagggaacccgatctcttcctttgtgctggggccaggcgagtggagaaacgccctccagtctgagagcaggggagggaaggaggcagcagagttggggcagctgctcagagcagtgttctggcttcttctcaaaccctgagcgggctgccggcctccaagttcctccgacaagatgatggtactaattatggtacttttcactcactttgcacctttccctgtcgctctctaagcactttacctggatggcgcgtgggcagtgtgcaggcaggtcctgaggcctggggttggggtggagggtgcggcccggagttgtccatctgtccatcccaacagcaagacgaggatgtggctgttgagatgtgggccacactcacccttgtccaggatgcagggactgccttctccttcctgcttcatccggcttagcttggggctggctgcattcccccaggatgggcttcgagaaagacaaacttgtctggaaaccagagttgctgattccacccggggggcccggctgactcgcccatcacctcatctccctgtggacttgggagctctgtgccaggcccaccttgcggccctggctctgagtcgctctcccacccagcctggacttggccccatgggacccatcctcagtgctccctccagatcccgtccggcagcttggcgtccaccctgcacagcatcactgaatcacagagcctttgcgtgaaacagctctgccaggccgggagctgggtttctcttccctttttatctgctggtgtggaccacacctgggcctggccggaggaagagagagtttaccaagagagatgtctccgggcccttatttattatttaaacatttttttaaaaagcactgctagtttacttgtctctcctccccatcgtccccatcgtcctccttgtccctgacttggggcacttccaccctgacccagccagtccagctctgccttgccggctctccagagtagacatagtgtgtggggttggagctctggcacccggggaggtagcatttccctgcagatggtacagatgttcctgccttagagtcatctctagttccccacctcaatcccggcatccagccttcagtcccgcccacgtgctagctccgtgggcccaccgtgcggccttagaggtttccctccttcctttccactgaaaagcacatggccttgggtgacaaattcctctttgatgaatgtaccctgtggggatgtttcatactgacagattatttttatttattcaatgtcatatttaaaatatttattttttataccaaatgaatcacttttttttttaagaaaaaaaagagaaatgaataaagaatctactcttcg

SEQ ID NO: 55247 - DNA, 1300 bp, Homo sapiens
gccatctctctgacctcagtgctgctggactcagttccaagatctaactgtcaaatgctttaggggaaacgggaagagaagtccctggagtaacccatgtgcgcagcctggcactgttttcacttgcctttggaaatgaaggtgcagaaaccatgggaggaacctgatgaaatgcctggtctaacaggaggatgcagagaaagttatgaagagaggatcctgaggaatttgctcctgggccatgaagatgggaagctgagtcagagtgcagttcttcacccaatcccacagccacacgtgcctgcttgctcacgggatcttcccactctcctcgggaaggcttccgagctgcttcctcaggatgtcctgtgatagcagcctgacctgtcaaagccatgcgaataccatctgttcagttatataacttgagatctgggaagaattctcaacgtaggatttgctgcccaaatcaaatcattttcagaaaggagattaagcattctttgctgggaaaaggagaaattaccagaaaaaattatcatttcactgagtataaacaaacctttgtccaaaatacacaaatgaaaatgacaaatttgcttcattaatatttgcttgcattaaaaatatacacagggctatgtatggttcaatatcttaagtgcaaagtaaaatcttaattaggaacaatggaattgttaatttaatgaatcttaattttgtttagatcattagcctgcagtataatgtcccaagcagaatttggggtggggagcttggtggtggaagaggaagtgctcatttctacagacatgacaagattattaacactaaagaatgacttttctttcatgggaggggaagatatctgacccaccagcagtcagacagaaaccctgacttgtgattttaacattaccttatatgacccatggtcaccttgtatgaccaaagaaaaccatttatgaaatagctgtccggagttcaagatttaaatggtaactttgtagactaggttttctctcatcatctaatttacttgccttaacgcttgtttctttgcccttattcctactggctctcgagtataatatcctgagaatttatgttgaacagcactaattttttcacttggagctagcacatgtttatgactagtacaagtttataactacaaaaaacagagattttgtcatcttaaactgaatttactgggaataaaatcagtcaattcagaaaagtataacaaaggaaataaaaatcaccacaactcctactacctgaagattaaatggttaaa

SEQ ID NO: 55248 - DNA, 1303 bp, Homo sapiens
gccatctctctgacctcagtgctgctggactcagttccaagatctaactgtcaaatgctttaggggaaacgggaagagaagtccctggagtaacccatgtgcgcagcctggcactgttttcacttgcctttggaaatgaaggtgcagaaaccatgggaggaacctgatgaaatgcctggtctaacaggaggatgcagagaaagttatgaagagaggatcctgaggaatttgctcctgggccatgaagatgggaagctgagtcagagtgcagttcttcacccaatcccacagccacacgtgcctgcttgctcacgggatcttcccactctcctcgggaaggcttccgagctgcttcctcaggatgtcctgtgatagcagcctgacctgtcaaagccatgcgaataccatctgttcagttatataacttgagatctgggaagaattctcaatgtaggatttgctgcccaaatcaaatcattttcagaaaggagattaagcattctttgctgggaaaaggagaaattaccagaaaaattatcatttcactgagtataaacaaacctttgtccaaaatacacaaatgaaaatgacaaatttgcttcattaatatttgcttgcattaaaaatatacacagggctaggtatggttcaatatcttaagtgcaaagtaaaatcttaattaggaacaatggaattgttaatttaatgaatcttaattttgtttagatcattagcctgcagtataatgtcccaagcagaatttggggtggggagcttggtggtggaagaggaagtgctcatttctacagacatgacaagattattaacactaaagaatgacttttctttcatgggaggggaagatatctgacccaccagcagtcagacagaaaccctgacttgtgattttaacattaccttatatgacccatggtcaccttgtatgaccaaagaaaaccatttatgaaatagctgtccggagttcaagatttaaatggtaactttgtagactaggttttctctcatcatctaatttacttgccttaacgcttgtttctttgcccttattcctactggctctcgagtataatatcctgagaatttatgttgaacagcactaattttttcacttggagctagcacatgtttatgactagtacaagtttataactacaaaaaacagagatttttgtcatcttaaactgaatttactgggaataaaatcagtcaattcagaaaagtataacaaaggaaataaaaatcaccacaactcctactacctgaagattaaatggttaaaatg

SEQ ID NO: 55249 - DNA, 3847 bp, Homo sapiens
actcacacacgtacacacacacattgacacacacacacattcacacactctcacacacactctcacatcacattgatctagggatttcctcaggttgaaacgggcctgaccatctgcaaatgggcaggtaagtccaaatgcagaactgatcttcacttagggcttcagacaaaatctcaattgatgtaaaagcccattaaccgcccccctcaaagtaaaacaacagcaacaacaacaaaaggtgtttcgaattagtttttgaaactaaaagtatttcaagaaattcactccatgaatgagtcatgacatggcacagtgggaagaacaacttcctggggccaagaaaacctgagctgaaagtcagtagtgcctgtgagcagcccctggacctggggcaactcactgacctctctgagcccagcttcttaggggcttgtgagcatcgtcccttgccagggcctctgcacaccgcctggtctggaacagggacaccttgggtgctcctccctccaagccttcccaccgccctggtgcacaaggcacctacagctctggagctctcagctacagctgaggtgctctgggctctcctgcggggccgaggggcttgtgacgctgggcctcttcctacagtcactcatatccacgtggaatgaggtttccaatatccataggcaaatatgatccacccacctgcctgcctaccttctgaagtcaccatttccctgacataattgcatcttacagatcttacagctgtttcctgtggcccacttgatggttggtggcaccttggcatgtccaccaggtagcacctcatgctgaacatcacagctggccccaggcaggcccttcccttcctcctcactctgtctacatcactggatcagggaagctggcttcattcaacccttccttctgtaggtcctgaaaggtgaggtgatggctgcttctccactccccacccctctttgttgtgtaagtgtgattggtcacacatcacagaaaactcatatagcagatatttgccacgtaacgtagaatttgaaagcacatctatgccataggaaacggctaattgccttgactcaggagtgcccccaagagcctgtctcattgggaatccttcagctgtcccaagaggaaaccattgcgttgacttttgtgacagtcatgtacttggttttaatgatgtttatcacttacttacaagttcttaagcaccagagttgagttgggcctctttctgcccctgggatcactgggcatgtcctcgtcagtgcctgatttcttttgctcagtgtgtttgggggatccttctatttcattgcctggtcttcgctcatttcctattgcagttccgtgcatggcccattacatgaacacaaccattgttttctctcttccattgttttctctcttctgctattgatggactcggggttgcttctgatctttggctcttaggaaggttgccccataaacatcctcttacctgtctccaggtgcacctgtgcacagtgcctgccagaaaagtacctgggggtggaactgagtttcttcactttggcaggtgctgcagacggtcagcttctcttctcaccagcagtgggagagccccctgtgctccagccctccccagagctggggatcatcagacctgagagccacaggtcctcgtccatgtgtagctgaccagatgtgaggatgctctgcccatgtttggggacagcttcttttcctctccccatctggctccccgctgctccctgtgtgcccaccccacctgccccggtgtttggctggcctcctcttcctgctgagccagtgcctctaaggagctgccagcagtggggatgcgccaggcctcctccagttctccagggcgcaggctttctgcagcgaccatcccgggtctcatcgagctctgcaccctgcacccgcagcgctgacctcacggagtctgcccctctgctgcagcttgccctggcctcctgcctgcctctttctgatcctgtcgtcttttgcctccttggcctccctcctggccttgctgctgtctcccttcctcagcttgtcttttggggaatctctaaccttccagaactccctctgcccatatggagccccgatctgggcagcaccacccctttgcaaaactcccctccgtccacacctccctggggcttgcaggcaccatccaaggaacagcaggactcaccatctcagtgagccagggcagggtagcccgggtctgaggcagcgtgggattgggagtctgagccatggcgtgggctatgggacctgggccaggcagcaaatgtctctaagctctcctgttctcatccataaaagaacataattataaggattcagtgagagaatatccacggcagtgtttgggagtgatgtgctacctggctcagaagtcactgtgaacatcattgtccctttctgtaatgtagctttctgtcatgcatctagctagtatgtaaggagaacctggtgcacacaggctgttacttcaccttatcttgttgtggagtgctcgtaactgcccgccaggaggtaggcaccgtgttcctctctgctttacagaagaggaaaccgaggcctaggaagggggctggccttggctgagatgtcacccctgatgacaggcaaagctgggaatctcatctctgtggccagactcccagcaccatcatgcacggctttctggagcaaaggcagaatgatgaggagatcacaggcacggaggcaggagtgtgaaagcatcagaatatgccaccccaaaggatgccgctttgacataaggattattttgagctgaaggcaactgagaaacagccagatgcagaaaaagctctctactccccatgctcccatctgcctcaagggagggcagaaatttatctttttttttttttgagacagagtctcactctgtcacccaggctggagtgcagtggagcgatcttggctcactgcaatttcagcctcctcggttcaagagatcctcatgcctcagatccccaagtagctgggatgacaggcatgcaccaccgcactcggctaatttttgtatttttagtagagacggggtttcgccgtgttggccaggctggtcttgaactcctgacttcctccttcaacacctgcctcggcctcccaaagtgctgggattacaggcatgagccacggtgcctggcccagaaattcatttttgtgaaggattcctcctcccctctcctgtaccagaaagaagccacaactcatcaccggagatggcaccaacctgaatagtcataacctttaacaacccttatcttccattatttcccccgtatgtatccctttccacatttgccatccctagaagctcaaaacatttttcctttgtcttgtcatgtctccacaatttttttattttttttgaaacagagtcttgctctgtcacccaggctggagtgcagtgacacgatctcgactcactgcaacctccgcctcccgggttcaagtgattctccagcctcagcctcctgagtagctgggattacaggcatgtgccaccatgcccagataatttttgtatttttagtagagatggggtttcaccatgttggtcaggcttctctcaatctcctgacctcgtgatcctcccgccttggcctcccaaagtgctgggattacagacatgagccaccatgctggccacatctccacaatttatggctctttgttaagatgttacacaggctccaaatgctaaccacctcagagagtcacatttctttgtgaatgcccacgcatatgtatataattaaatctgttcttttctcttgtt

SEQ ID NO: 55250 - DNA, 3852 bp, Homo sapiens
atgtgcggcccgcggcggctcgcagctcccggcagcagcctcggcagcttcggccgcgcctcgagaggcggccgcagaggctccagcggcggccgagcggccgagcccgggctgggagacaccatgcgccgcgtccttcggctgctcctcggttgcttcctcaccgagctgtgcgcccgcgtgtgccgggcgcaggagcgagcgggacacgggcagctggcgcaactgggcggcgtgttgctgctggcggggggcaaccgctccggggccgcctccggagaggccagcgagggcgctgaggcatcggacgcgcccccgacccgggcgcccacgccggacttctgccggggctacttcgatgtcatgggccagtgggacccgccgttcaactgcagctcgggcgacttcatcttctgctgcgggacttgtggcttccggttctgctgcacgtttaagaagcggcgactgaaccaaagcacctgcaccaactacgacacgccgctctggctcaacaccggcaagccccccgcccgcaaggacgaccccttgcacgaccccaccaaggacaagaccaacctgatcgtctacatcatctgcggggtggtggccgtcatggtgctcgtgggcatcttcaccaagctggggctggagaaagcgcaccggccccaaagggagcacatgtccaggctctatgacaatctgctgtttatggaggcacagatttctttccaagaggacgaacctgcccctggagagtggagtgtcggacttcaaacctggacagtctgagtgcacggatccttggccgctaggctgcactgcgtttgagtgcaaacctgcaggaattccagacttctcagatcacagagaagtacgcgatgccctgcaaacaacagctcatgcatcggggccagttcaagaagctaccgtaagatgaagtctaggaatgctttctatatcggccccggcaggcccagacgtcttggtggaggcgttggtgagaaatgaccttggggacagaagcacatatgtgaagctctctacacttgaagccagtagggaacacatgtcattattttgtccaccttcaaacagaattggaaatccaagtggcaaatggcagataagggtcctgtgtgtttttaaaacatgcttcagaagaactggcaccccttggaaagaaatagcaacaaataatgataaatgcacctcctcctcttgccttttgccttccagtttctctcctgcctctcatctttctatgcatttgtggttatcctaaggctttgaccagcttcccaggctggagaagtccatgtgtgcatgcatctactgttggccacagaaaagtcttaatttatttttctttgcagggtatgttgacttctctttgggcactgagtccttgcattttaaaaatcaacttcattgaagtataatttacacaataaaatgcacacattgtaagtgtgtagtttgatgagcttggacaaatgtctatacctgtgtaatcattactctagaaagctcactcatgcccattgcccttgcatttttgaaaaataattgatgcttcttgtgcaagaagaagtgctcaggaactctattcaagtgtttaaaagtcaacacatagattggacattgggatacctggaggctttgaagcaagataccgggactctgagttctgtttggaaatattggtgtcatatatttgtcattgtaattggaaagaaaagagatgcaccattttcttcttgttctttggataagctaagctcattcccatcttggagctgttgcactggcccttgtgtggctggtccctcctcatcaccagggtcccagctccaatgtcatcttctctgagaagccgtccctgaccaggcttagttgcttcccaccccagcctgacacactccagcccatcacccagtcagtgttatttgcttcatttttacattatggtctaaaattaacttgctagtttactggtttactagtttattatctgtctccttccattatccctctccttccctccttcccttccccttccttccttccttccttccttccttcgagacacagtcgtactctgtcaccccggctggagtgcagtggtgtgatcttgcctcactacaacccctgcctcctgggttttagcgattcttctgcctcagcctcccgagtagctgggactacaggcacccaccatgatgccaggctaatttttgtatttttattggagacagggtttcaccatgttggccaggctggtctcgaactcttgacctcaagtgatccacctgtctcggcctcccaaagtgctgggattacaggcatgagccactgcacctggcccttttattattcatagtaagacacacagggaccacaattgtctcttctactcagtagttggattctgagtgcctagttcagtatttggcaagtaagagttctgcatttgatatcctggtttacctggcacaacaaagtatctccaaattcattcattcattctttcattcattcgataggtatttactgaacatctaacttatgcccaacactgtgctgagagatatgagataaccatgaatagtacaaaagcaatccctgcccttgaagagcaaacagccaaatatcaggagacaggtaacacacaaggaaatgtacaagaaagttgagccagcacttttataagtactggttctagtactagctttcataagaaagtactggttctagtactagctttcagtactctcttgtgaaattttcaatattcagtcatttcaacctcaaaaatggcaacataattatgtttcaacataattgttgttttaaacaaacaattttgtttcaacataattctcctgaactgggtggaaggctatcaagaaaaagcttagcttcttcttcaggtaactgcaagagacagggttctctagagaaacagaacaaatatacaaagagattcattataaggaattggaagtccaaaatctccagagcctctgtacttgtacaagtctgaaggccgacaggcaggagaattctctctttttggggcaaaggtcagtgttttgttctatccaggctttcagatgattggttgaggctcactcacattagaagggcaatctgtcttactgccattagaatgcaacctgttttacttagcttactgatttcaatgttaatctatttcaagagcaccctcacagaaacacccagaataatgtttgatgaaatatctgggcaccctgtgacccagtcaagttgacacatgacactaaccatcacagtacgcttagggtcttgtcactcggagtgtggcctgtgaaccagcagcatttttatcttctgggagcttgggcacgatctcaggccccacctcctgcttattgattcagaatctgcattttaacaagatccccaggtgatctggatgcaccgtaacatctgagaagcactcaaactatgtgccgcaaacaaacgccaaattcttaggcatttgtgtggcttggagcacatagttggttctttctactgtctaattcattacattttttcagcacattcctgtctataaaatgtttttttgtatgcaccccaatatatgcacatttataagcatatgcatgaacccacgaacaatgattaggtacattatgaagcatacgtaaggacagaaatttcaaaccaagcttgagggtgaaataaatattatttgaaaacctgttgctaattgtgatgacttcatactatcattagttactatctcaatgcataatgtacagtgacgggtgaagtttatcattaataaaaaaaatctggatttta

SEQ ID NO: 55251 - DNA, 2078 bp, Homo sapiens
ttctgtttctctctgaccaccggtgcatgcagcccctgtcaagtaccgcctgcttgctcaaatcaatcacgaccctttcatgtgaaatctttagtgttgtgagcccttaaaagggacagaaattgtgcatttggggagcttggattttaaggcagtagcttgctgatgctcccagctgaataagtcccttctttctacaactcggtgtcttgagttttgtctgcggctcctcctgttacatttcttggctccctgaccgggaagcaacgtgactgacagacagctgaggcagccccttaggcaacttaagcctgccttgtggagtgcccctgtgggggactccagccagcctgagtgacatgatccaaagagccctcctgggtaggaaattgccccggtggaatccctcaccagagaagcaggtagcaggccctcgcagaggattaacacagtggctgaacaccaggaaggaactggcacttggagtccagacatctaaaatttggtatcgtgccttggatccaccacagtcagctgaaattatcagcccaggaccagtggaccaaccagcaggacatagaccatctgacccgaatgatcctgcaatgagaccacattgccagtggagatgacaacagcactgctctggtcactctggaagatgaccagtctatgcatggtggaagcttgagaaaatagcaagccctgctctagtcacaccaagaactgactagtctatgcacggccgaagcttgaagaatcgtcatcagatgaataaatgtggccagaaatcttaggcccagtaatcttctttgtattattcattatattgctcttgtgctattgtttaaccaaccccctaaatgcctttactgttcatgctggctgtaagaatgctactgtttgctttgtttgtgctgatccccatatctatgctagaaggaggacccgtattaggatgccgtcactgcatgcacactacatggataagaaacacagtaattgctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccggaaggcggagcttgcagtgagccgagatcgtgccactgtactccagcctgggcgacagagcgagactccgtctcaaaaaaaaaaaaaaaaaaaaagaaacacagtaattaagactttattataccatacatactataggtacctgggcacaagataggtcagggggtactgtacccctatttacatgcttaatcacatcataaggttgcaggtggtacttgaaatcatcactaatgagacagcaaatatgttagacttgctggcccagcaagccacagaaataaggatcaccatctattagaatagactggcttcagactgcctcctagcccaaaaagaaggattatgtggaaagttgagcctgatgaattgctgcctagaaattaatgataacaggaaagccatcatagaaatagctgccaggatgtggaagatagctcatgtcccagttcagacctggaacccagatggtctccagattccctcttaggaggttggttttcatcctttggtggttttaaaacagtaggggtagtgttggctatattaaaaggttgcttaatgttcccttgcctcttaggcctcctcatcagaaacatccaatcaatcacagaatccatcgttaacagaaccacctccactccactgatggctctaaacaagtatcaacccgtaccaaacagagaagaactgacttgtaatgaggaattaaatgatagtgatgccttctattgaattccatttacaggaggcatcaaaggggaagatgagatgggaaagaaagaaagaaagaaagaaagaaagaaagaaagaaagaaagaaagaaagaaagaaagaaagaaagaaagaaagagaaagaaagaaagaaaaagaaagaaaga

SEQ ID NO: 55252 - DNA, 412 bp, Homo sapiens
ttgggctgtccgccataccgggggacctggatcccctgacggcttacctagcagtgcccaggatggtggctgagggtaaagctgacagaactggaggtggaggaagtagcaggccagagaggactcgaagatccttagaaggagccatagacggaaccataggaggcgcccaggagctatgggctccagaagtttcctcctaaactgtggtctcagcgaggctcattgacactcaccggggtttcgacattctccctggctagggcctgttctggaaatagaccaagggggagatggagcccctggccgtgggacatccaatctgatggtgatgagaaggcatgatgcctcttgttctattcttttttgtttcttctttttttttaaataaaaaagaccagtaatgtgctga

SEQ ID NO: 55253 - DNA, 1845 bp, Homo sapiens
cttgccgatgctcccagctgaataaagccctgccttctacaactcagtgtctgagaggttttgtctgcggctcaccctgctacatttcttggttccctgactgggaaacgaggtgactgacggatggccgaggcagccccttaggcggcttaggcctgccctgtggagcatccgtgaggggaactccggccagcctgagtgacgtgatccaaagagcgctcccgggtaggcaattgccccaatggaacgccttgccagagcagcgtgtagcaggcccccacggaagattaacacagtggctgaacaccaggaaggaactggcacttggagtccggacatctacaacttggcccaaccaccgagaccacccttaaacatcagtagactgggagctgtacgtggatgggagcagctttgccaacccttgcaaagtgactctgaagaagacgacaagccttgttccggtcacacccggaagctgactggttcacgcatggccgaagcatgaggaaactcatcgcgggaataattttccttaaaatttggacttgtacagtaaggacttcaactgaccttatgctaagctgcctgatcagtggacaggtagctgtgtaattggacaggtagctgtgtaattggcaccattaagccatctttcttcttactgccaataaaaacaggtgaacttctaggcttcctagtctatgcttcccgtgaaaaatgaagcatagccataggtgattagaaaataatgaatggccccctgaaagaatcatacaatactatagacccaccacttaggcacaagatggctcatgaggatatcgaacccccatctacatgctcaaccgaatcatacagttacaagcggttttagaaattattactaataaaaccggtcaagccttgactgttcttgcccggcaagagactctgatgagaaattttatctatcaaaatatactagctcttgactacttgctagcagctgaaggagaagtttgtaaaaaatttaaccttactaattgttgtctacacataaatgattaagggcaagtagttaaaaatatagttaaagatataacaaaactggcacatgtacccatgcaagtgtggcatgggctcaatccgggagccatgtttgcaaattggttcccagcaatgaaaaaatttaaaactcttataataagagtaataatagtaatagaaacctgcttactgctcctttgtctgatacctgtatttctccaaatgataaaaaactttgtcacgaccttagttcaccaaaatgctttagcagaagcatactatataaatcactatcaatctattgcacaaaaagacataagtagcaaaaataagactcagaactcccactaataaaaactgagagtctcaaaggggggaaatgagggaagagagagagaccctctcatattgttttatattgttttatactcagtacctcttttaagaaaaagtgacaaggaagtaaaaccaaagacaggcagcctggtgccaggcctgaaaccaggcctgggcctgtctggcctaaacccagtagttaaaaatcaactcataacttagaaactgatgttattcatagattccagacattgtatagaagaacattgtgaaactccctgccctgttctgtttctctctgaccactggtgcatgcagcccctgtcatgtaccgcctgcttgctcaaatcaatcacgaccctttcatgtgaaatctttagtgttgtgagcccttaaaagggacagaaattgagtatttggggagcttggattttaaggcagtagcttgctgatgctcccagctgaataaagcccttcctt

SEQ ID NO: 55254 - DNA, 1224 bp, Homo sapiens
atgctacggtacattgctacgcttagacgcaccaggaaagctctggacgaggaagatgtaggttgttgccagcacctatgcacggacagacagaaagtcctctgcttccttcaggcccttgcttccacttccccggggcttccagctgagcctgcatttttctttgacttccccctcttgcctggcgttttcagcaaacacacacagaggattacggggagaaaactatcatattaccaagtggacatggctcctaaggtgccaactgaacacagcaacagcgacgaggcccgaggtgcagctgtctcgcctcgcctgtcttttgcaggcaccggcatgcacagaagatggctctccgggaggaagattcctttccattttgttctctctctgcctccgcaaggctcgcagccacctctcgggagtgcagggccagatcctgtgccagcggccttacacggccacagtcggattcgctgccgcagcagccgccacccccaggagccgccgggaccctcgcgtcgtcgccgccgcggcccagatccccacaccatgccgtcggagaagaccttcaagcagcggcgcaccttcgaacaaagagtagaagatgtccgacttattcgagagcagcatccaaccaaaatcccggtgataatagaacgatacaagggtgagaagcagcttcctgttctggataaaacaaagttccttgtacctgaccatgtcaacatgagtgagctcatcaagataattagaaggcgcttacagctcaatgctaatcaggccttcttcctgttggtgaacggacacagcatggtcagcgtctccacaccaatctcagaggtgtatgagagtgagaaagatgaagatggattcctgtacatggtctgtgcctcccaggagacgttcgggatgaaattgtcagtgtaaaaccagaaaaaatgcatctcttctagaattttttaaacccttaccaaggaaaaaaaaagggatgttaccaactgagatcgatcagttcatctaatcacagatcatcaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaaaaaaaaaaaaaaattgcctta

SEQ ID NO: 55255 - DNA, 1385 bp, Homo sapiens
caagaagcagcttctccgctccttctaggatctctgcctggttcggcccgcctgcctccactcctgcctccaccatgtccattaggggacccagaagtcctacaaggtgtccacctctggcccccgggccttcagcagccactcctacacaagtgggcccggtgcccacatcagctcctcaagcttctcccaagtgggcagcagctgctttcggggtggcctgggcggcggctgtggtggggccagcggcatgggaggcatcaccgcggtcacagtcaaccagagcctgctgagcccccttgtcctggaggtggaccccgacatccaggctgtgtgcacccaggagaaggagcagatcaagaccctcaacaacaagtttgcctccttcatagacaaggtacggttcctggagcagcagaacaagatgctggagaccaagtggagcctcctgcagcagcagaagacggccgggagcaacatggacaacatgttcaagagctacatcaacaaccttaggcggcagctggagactctgggctaggagaaactgaagctggaggcggagcttggcaacatgtaggggctggtggaggacttcaagaacaagtatgaggatgagatcaataagcgtgcagagatggagaatgaatttgtcctcatcaagaaggattgtggatgaagcttacattaacaaggtagagctggagtctcgcctggaagggctgactgatgagatcaacttcctcaggcagctgtatgaagaggagatccgggagctgcagtcctggatctcagacacatctgtggtgctgtccatggacaacagccgctccctggacatgaacagcgtcatcgctgaggtcaaggcacagtacgaggagatcgccaaccgcagccaggccgaggctgagagcatgtaccagatcaaggatgaggagctgcagagtctggctgggaagcatggggataacctgcggtgcacaaagactaagatctccgagatgaaccggaacatcagccggctccaggctgagaatgagggcctcaaaggccagagggctttcctggaggccgccattgcagatgccgagcagtgtggagagctggccattaaggatgctaacgccaagttgtcgagctggaggccgccctgcagcgggccaagcaggacatggcgtggcagctgcgtgagtaccaggagctgatgaacgtcaggctggccctggacatcgagatcgccacctacaagaagctgctggagggcgaggagagccggctggagtctgggatgcagaacatgagtattcatacgaagaccaccagcggctatgcaagtggtctgagctcggcctgtgggggcctcacaagccccggcctcagctacg

SEQ ID NO: 55256 - DNA, 1785 bp, Homo sapiens
agaagcagcttctccgctccttctaggatctccgcctggttcggcccgcctgcctccactcctgcctccaccatgtccatcagggtgatccagaagtcctacaaggtgtccacctctggcccccgggccttcagcagccgctcctacacgagtgggcccggtgcccacatcagctcctcgagcttctcctgagtgggcagcagcagctttcggggtggcctgggaggcggctatagtggggccagcggcatgggaggcatcaccgcagtcatggtcaaccagagcctactgagcccccttgtcctggaggtggaccccaacatccaggctgtgtgcacccaggagaaggagcagatcaagaccctcaacaacaagtttgcctccttcacagacaaggtacggttcctggagcagcagaacaagatgctggagaccaagtggagcctcctgcagcagcagaagatggctcggagcaacatggacaacatgttcgagagctacatcaacaaccttaggcggcagctggagactctgggccaggagaagctgaagctggaggcggagcttggcaacatgcagaggctggtggaggacttcaagaacaagtatgaggatgagatcaataagcatacagagatggagaatgaatttgtcctcatcaagaaggatgtggatgaagcttacatgaacaaggtagagctggagtctcgcctggaagggctgactgacgagatcaacttcctcaggcagctgtacgaaaaggagatccgggagctgcagtcccagatctcggacacatctgtggtgctgtccatggacaacagccgctccctggacatggacagcatcattgctgaggtcaaggcacagtacgaggatattgccaaccaaagacgggctgaggctgagagcatgtaccagatcaagtatgaggagctgcagagtctggctgggaagcacggggatgacctgtggcgcacaaagactgagatctctgagatgaactggaacatcagccagctccaggctgagattgagggcctcaaaggccagagggcttccctggaggccgccattgcagatgccgagcagcgtggagagctggccattaaggatgccaacgccaagttgtccgagctggaggctgccctgcagcgggccaagcaggacatggcacggcagctgcgtgagtaccaggagctgatgaacgtcaagctggccctggacatcgagatcgccacctacaggaagctgctggagggcaaagagagccggctgaagtctgggatgcagaacatgagtattcatacgaagaccaccagcggctatgcaggtggtctgagctcggcctatgggggcctcacaagccccggcctcagctacggcctgggctccagctttggctctggcgcaggctccagctccctcagccgcaccagttcctccagggccgtggttgtgaagaagatcgagacatgtgatgggaagctggtgtccgagtcctctgacatcctgcccaagtgaacagctgtggcagcccctcccagcctacccctcctgcgctgccccagagcctgagaaggaggccactattcagggtagcactgggaacaggagacccacctgaggctcagccctagccctcagcccacctggggagtttactacctggggaccccccttgcccatgcctccagctacaaaacaattcaattgcttttttttggtccaaaataaaacctcagctagctctgccaatgtcaaaaaaaaaaaaaaaaaaaaaaa

SEQ ID NO: 55257 - DNA, 1491 bp, Homo sapiens
aagcagcttctccgctccttctaggatctccgcctggttcggcccgcctgcctccactcctgcctccaccatgtccatcagggtgatccagaagtcctacaaggtgtccacctctggcccccgggccttcagcagccgctcctacacgagtgggcccggtgcccacatcagctcctcgagcttctcctgagtgggcagcagcagctttcggggtggcctgggaggcggctatagtggggccagcggcatgggaggcatcaccgcagtcatggtcaaccagagcctactgagcccccttgtcctggaggtggaccccaacatccaggctgtgtgcacccaggagaaggagcagatcaagaccctcaacaacaagatgtggatgaagcttacatgaacaaggtagagctggagtctcgcctggaagggctgactgacgagatcaacttcctcaggcagctgtacgaaaaggagatccgggagctgcagtcccagatctcggacacatctgtggtgctgtccatggacaacagccgctccctggacatggacagcatcattgctgaggtcaaggcacagtacgaggatattgccaaccaaagacgggctgaggctgagagcatgtaccagatcaagtatgaggagctgcagagtctggctgggaagcacggggatgacctgtggcgcacaaagactgagatctctgagatgaactggaacatcagccagctccaggctgagattgagggcctcaaaggccagagggcttccctggaggccgccattgcagatgccgagcagcgtggagagctggccattaaggatgccaacgccaagttgtccgagctggaggctgccctgcagcgggccaagcaggacatggcacggcagctgcgtgagtaccaggagctgatgaacgtcaagctggccctggacatcgagatcgccacctacaggaagctgctggagggcaaagagagccggctgaagtctgggatgcagaacatgagtattcatacgaagaccaccagcggctatgcaggtggtctgagctcggcctatgggggcctcacaagccccggcctcagctacggcctgggctccagctttggctctggcgcaggctccagctccctcagccgcaccagttcctccagggccgtggttgtgaagaagatcgagacatgtgatgggaagctggtgtccgagtcctctgacatcctgcccaagtgaacagctgtggcagcccctcccagcctacccctcctgcgctgccccagagcctgagaaggaggccactattcagggtagcactgggaacaggagacccacctgaggctcagccctagccctcagcccacctggggagtttactacctggggaccccccttgcccatgcctccagctacaaaacaattcaattgcttttttttggtccaaaataaaacctcagctagctctgccaatgtcaaaaaaaaaaaaaaaaaaaaaaa

SEQ ID NO: 55258 - DNA, 1276 bp, Homo sapiens
aagcagcttctccgctccttctaggatctccgcctggttcggcccgcctgcctccactcctgcctccaccatgtccatcagggacttcaagaacaagtatgaggatgagatcaataagcatacagagatggagaatgaatttgtcctcatcaagaaggatgtggatgaagcttacatgaacaaggtagagctggagtctcgcctggaagggctgactgacgagatcaacttcctcaggcagctgtacgaaaaggagatccgggagctgcagtcccagatctcggacacatctgtggtgctgtccatggacaacagccgctccctggacatggacagcatcattgctgaggtcaaggcacagtacgaggatattgccaaccaaagacgggctgaggctgagagcatgtaccagatcaagtatgaggagctgcagagtctggctgggaagcacggggatgacctgtggcgcacaaagactgagatctctgagatgaactggaacatcagccagctccaggctgagattgagggcctcaaaggccagagggcttccctggaggccgccattgcagatgccgagcagcgtggagagctggccattaaggatgccaacgccaagttgtccgagctggaggctgccctgcagcgggccaagcaggacatggcacggcagctgcgtgagtaccaggagctgatgaacgtcaagctggccctggacatcgagatcgccacctacaggaagctgctggagggcaaagagagccggctgaagtctgggatgcagaacatgagtattcatacgaagaccaccagcggctatgcaggtggtctgagctcggcctatgggggcctcacaagccccggcctcagctacggcctgggctccagctttggctctggcgcaggctccagctccctcagccgcaccagttcctccagggccgtggttgtgaagaagatcgagacatgtgatgggaagctggtgtccgagtcctctgacatcctgcccaagtgaacagctgtggcagcccctcccagcctacccctcctgcgctgccccagagcctgagaaggaggccactattcagggtagcactgggaacaggagacccacctgaggctcagccctagccctcagcccacctggggagtttactacctggggaccccccttgcccatgcctccagctacaaaacaattcaattgcttttttttggtccaaaataaaacctcagctagctctgccaatgtcaaaaaaaaaaaaaaaaaaaaaaa

SEQ ID NO: 55259 - DNA, 928 bp, Homo sapiens
agaagcagcttctccgctccttctaggatctccgcctggttcggcccgcctgcctccactcctgcctccaccatgtccatcagggtgatccagaagtcctacaaggtgtccacctctggcccccgggccttcagcagccgctcctacacgagtgggcccggtgcccacatcagctcctcgagcttctcctgagtgggcagcagcagctttcggggtggcctgggaggcggctatagtggggccagcggcatgggaggcatcaccgcagtcatggtcaaccagagcctactgagcccccttgtcctggaggtggaccccaacatccaggctgtgtgcacccaggagaaggagcagatcaagaccctcaacaacaagtttgcctccttcacagacaaggtacggttcctggagcagcagaacaagatgctggagaccaagtggagcctcctgcagcagcagaagatggctcggagcaacatggacaacatgttcgagagctacatcaacaaccttaggcggcagctggagactctgggccaggagaagctgaagctggaggcggagcttggcaacatgcagaggctggtggaggacttcaagaacaagtatgaggatgagatcaataagcatacagagatggagaatgaatttgtcctcatcaagaaggatgtggatgaagcttacatgaacaaggtagagctggagtctcgcctggaagggctgactgacgagatcaacttcctcaggcagctgtacgaaaaggagatcccacctgaggctcagccctagccctcagcccacctggggagtttactacctggggaccccccttgcccatgcctccagctacaaaacaattcaattgcttttttttggtccaaaataaaacctcagctagctctgccaatgtcaaaaaaaaaaaaaaaaa

SEQ ID NO: 55260 - DNA, 1558 bp, Homo sapiens
aagcagcttctccgctccttctaggatctccgcctggttcggcccgcctgcctccactcctgcctccaccatgtccatcagggtggaccccaacatccaggctgtgtgcacccaggagaaggagcagatcaagaccctcaacaacaagtttgcctccttcacagacaaggtacggttcctggagcagcagaacaagatgctggagaccaagtggagcctcctgcagcagcagaagatggctcggagcaacatggacaacatgttcgagagctacatcaacaaccttaggcggcagctggagactctgggccaggagaagctgaagctggaggcggagcttggcaacatgcagaggctggtggaggacttcaagaacaagtatgaggatgagatcaataagcatacagagatggagaatgaatttgtcctcatcaagaaggatgtggatgaagcttacatgaacaaggtagagctggagtctcgcctggaagggctgactgacgagatcaacttcctcaggcagctgtacgaaaaggagatccgggagctgcagtcccagatctcggacacatctgtggtgctgtccatggacaacagccgctccctggacatggacagcatcattgctgaggtcaaggcacagtacgaggatattgccaaccaaagacgggctgaggctgagagcatgtaccagatcaagtatgaggagctgcagagtctggctgggaagcacggggatgacctgtggcgcacaaagactgagatctctgagatgaactggaacatcagccagctccaggctgagattgagggcctcaaaggccagagggcttccctggaggccgccattgcagatgccgagcagcgtggagagctggccattaaggatgccaacgccaagttgtccgagctggaggctgccctgcagcgggccaagcaggacatggcacggcagctgcgtgagtaccaggagctgatgaacgtcaagctggccctggacatcgagatcgccacctacaggaagctgctggagggcaaagagagccggctgaagtctgggatgcagaacatgagtattcatacgaagaccaccagcggctatgcaggtggtctgagctcggcctatgggggcctcacaagccccggcctcagctacggcctgggctccagctttggctctggcgcaggctccagctccctcagccgcaccagttcctccagggccgtggttgtgaagaagatcgagacatgtgatgggaagctggtgtccgagtcctctgacatcctgcccaagtgaacagctgtggcagcccctcccagcctacccctcctgcgctgccccagagcctgagaaggaggccactattcagggtagcactgggaacaggagacccacctgaggctcagccctagccctcagcccacctggggagtttactacctggggaccccccttgcccatgcctccagctacaaaacaattcaattgcttttttttggtccaaaataaaacctcagctagctctgccaatgtcaaaaaaaaaaaaaaaaaaaaaaa

SEQ ID NO: 55261 - DNA, 1692 bp, Homo sapiens
agaagcagcttctccgctccttctaggatctccgcctggttcggcccgcctgcctccactcctgcctccaccatgtccatcagggtgatccagaagtcctacaaggtgtccacctctggcccccgggccttcagcagccgctcctacacgagtgggcccggtgcccacatcagctcctcgagcttctcctgagtgggcagcagcagctttcggggtggcctgggaggcggctatagtggggccagcggcatgggaggcatcaccgcagtcatggtcaaccagagcctactgagcccccttgtcctggaggtggaccccaacatccaggctgtgtgcacccaggagaaggagcagatcaagaccctcaacaacaagtttgcctccttcacagacaaggtacggttcctggagcagcagaacaagatgctggagaccaagtggagcctcctgcagcagcagaagatggctcggagcaacatggacaacatgttcgagagctacatcaacaaccttaggcggcagctggagactctgggccaggagaagctgaagctggaggcggagcttggcaacatgcagaggctggtggaggacttcaagaacaagtatgaggatgagatcaataagcatacagagatggagaatgaatttgtcctcatcaagaaggatgtggatgaagcttacatgaacaaggtagagctggagtctcgcctggaagggctgactgacgagatcaacttcctcaggcagctcatcattgctgaggtcaaggcacagtacgaggatattgccaaccaaagacgggctgaggctgagagcatgtaccagatcaagtatgaggagctgcagagtctggctgggaagcacggggatgacctgtggcgcacaaagactgagatctctgagatgaactggaacatcagccagctccaggctgagattgagggcctcaaaggccagagggcttccctggaggccgccattgcagatgccgagcagcgtggagagctggccattaaggatgccaacgccaagttgtccgagctggaggctgccctgcagcgggccaagcaggacatggcacggcagctgcgtgagtaccaggagctgatgaacgtcaagctggccctggacatcgagatcgccacctacaggaagctgctggagggcaaagagagccggctgaagtctgggatgcagaacatgagtattcatacgaagaccaccagcggctatgcaggtggtctgagctcggcctatgggggcctcacaagccccggcctcagctacggcctgggctccagctttggctctggcgcaggctccagctccctcagccgcaccagttcctccagggccgtggttgtgaagaagatcgagacatgtgatgggaagctggtgtccgagtcctctgacatcctgcccaagtgaacagctgtggcagcccctcccagcctacccctcctgcgctgccccagagcctgagaaggaggccactattcagggtagcactgggaacaggagacccacctgaggctcagccctagccctcagcccacctggggagtttactacctggggaccccccttgcccatgcctccagctacaaaacaattcaattgcttttttttggtccaaaataaaacctcagctagctctgccaatgtcaaaaaaaaaaaaaaaaaaaaaaa

SEQ ID NO: 55262 - DNA, 1499 bp, Homo sapiens
agaagcagcttctccgctccttctaggatctccgcctggttcggcccgcctgcctccactcctgcctccaccatgtccatcagggtgatccagaagtcctacaaggtgtccacctctggcccccgggccttcagcagccgctcctacacgagtgggcccggtgcccacatcagctcctcgagcttctcctgagtgggcagcagcagctttcggggtggcctgggaggcggctatagtggggccagcggcatgggaggcatcaccgcagtcatggtcaaccagagcctactgagcccccttgtcctggaggtggaccccaacatccaggctgtgtgcacccaggagaaggagcagatcaagaccctcaacaacaagtttgcctccttcacagacaaggtacggttcctggagcagcagaacaagatgctggagaccaagtggagcctcctgcagcagcagaagatggctcggagcaacatggacaacatgttcgagagctacatcaacaaccttaggcggcagctggagactctgggccaggagaagctgaagctggaggcggagcttggcaacatgcagaggctggtggaggacttcaagaacaagtatgaggatgagatcaataagcatacagagatggagaatgaatttgtcctcatcaagaaggatgtggatgaagcttacatgaacaaggtagagctggagtctcgcctggaagggctgactgacgagatcaacttcctcaggcagctgtacgaaaaggagatccgggagctgcagtcccagatctcggacacatctgtggtgctgtccatggacaacagccgctccctggacatggacagcatcattgctgaggtcaaggcacagtacgaggatattgccaaccaaagacgggctgaggctgagagcatgtaccagatcaagtatgaggagctgcagagtctggctgggaagcacggggatgacctgtggcgcacaaagactgagatctctgagatgaactggaacatcagccagctccaggctgagattgagggcctcaaaggccaggtggtctgagctcggcctatgggggcctcacaagccccggcctcagctacggcctgggctccagctttggctctggcgcaggctccagctccctcagccgcaccagttcctccagggccgtggttgtgaagaagatcgagacatgtgatgggaagctggtgtccgagtcctctgacatcctgcccaagtgaacagctgtggcagcccctcccagcctacccctcctgcgctgccccagagcctgagaaggaggccactattcagggtagcactgggaacaggagacccacctgaggctcagccctagccctcagcccacctggggagtttactacctggggaccccccttgcccatgcctccagctacaaaacaattcaattgcttttttttggtccaaaataaaacctcagctagctctgccaatgtcaaaaaaaaaaaaaaaaa

SEQ ID NO: 55263 - DNA, 1379 bp, Homo sapiens
ggctggcgggtttctatggtgatgcagcccaagtcccagagaccagggtcttggctgggatccccatcctggcagacctcctcacaggaccccaccactaccccaggttctcccatgaacgtgccctcctggagcctgggccactctgcgaggccgcatcaccctcacacccagaaaagcactcagtgcagccatttcgagctttgaaagggaacttggtgatcaaggtgcatgccaaggaaggcgccagctgtagttccagtggtggaaagggctcggacctgggagaggccgattgggggcacaatctgggcaccctgctcactgtaggagccctcaggccaggcccttcctcactctttgcctcccttttcccttcagataatcatcaagaaaaaagaaaacaagtgacaccccacgaagacagggacaatgctggtccagtttgtcactggctcttccatgggcagcccagagcccggcccaaaggagcactggccatgagcagctgcccagtacacgactgcccatcgtgggatcctgagcgcctggagcctgtggaaacgggctccagaggcgccctacgcctccggggaggagcccctggctctgcggcaggttttcgggccagcatctggggccccgcaggttacccctcacctgtcgggctcgggcacccggcatccctcccccgccccgcttacagcccgcggtgcccggagcccgacgcccggcatgggtggggctccggcagcaacgccggttaccgcgggccggaccgggccgggactccctgccctgcacaggatcgagaaggaaggagctcctccccagtgccccctcctaggctcaaggccatgacctcacaggcgaggaagcaaaatggaggggccctcatagacacagtggactggacaagggaagccccagactctgaccctgtgatgagcatgcagaagacgcagaagccacagacgacagtggggcagtaaggaagtgccagcaggcaggcggggtgggctcagccagacgtgtctttctctgttctcctttcaatctttctgtgtcttcatatctcaggtgtagcgcttggaaacagcacatagttgggttttggtttggtttgattctgtctaacaattcttgtctttttaaaaatcagctttgagacctgcctgggcaacacagcgagaccacgtctctacaaaaaaaattttaaaattaggcatggtggtgcatgtctgtagtcccaactactcaggaggctgaggtgggaggatcgctggagcccaagaggttgaggctacagtgagccatgatcacaccactacactccagcctgggtgacagagtgagaccctgtctcaaaaaaaaaaaaa

SEQ ID NO: 55264 - DNA, 1063 bp, Homo sapiens
tttccacactgtggaagctttgtactttcactctgctcaataaagcctgcagctttttctcactctcagtccatgtctctttcactcactgtggtcagcttccacaccatttctttggtgtggcttggcaagaacctcaggtgttacatcttggcgagccagacaggagactccagaaaaggtatctagatcatcatgcagatcaaagccatcaagctacaaatgatcttacaaatggaacctcaaatgagctcagctcacggcttctaccgaggacccctggatcaacccgctggtccctcaattaccctagaaaattcccctctggaggacaccaaactgcagggccccttcttcacccctaaccagcaggaagtagccagaacgactgccacacggttcccaacagcagttggggtgtcctgtttagaggcaggactgagaggaggtgccagctgggcttcctgggtcaagtaggggctcagaaagctgtgaaactcactcatttcctgcatcaggacttacttcagtcctggatgaataatattgaagatatacgcttaaaatattcctaacaccaggattcgtgcatgtgttttcttccccaagaaagctataaacagtgaaaaatttgctgtaagtttccctgtatcttctctccctctctcccttcccccgcccctgaaactaaaataaaggaatgttaactgctcatttttctgtgaccagtggaccttatctacactcccaattcagattccttgtaaacatactttgtaaagtcctgtaagatcctgtctcctttgccatgctgctgcaaggtcctaaagtagataaaacctaagttgcaattccggttttcctcaaaatctaagacatgtcacaaaataatttactgcctttgtttccggctcctgtaacaagcttcccacctcatgtatctcccgctttaaagagtttaaaaggcaatcacccaaaaccaacagtggctacccgttcaggacccctcccatgctgtggaagctttgtactttcactctgcttaataaagcttacagttttt

SEQ ID NO: 55265 - DNA, 2444 bp, Homo sapiens
acgcccatcctccaccctcggagttggattgggtatcccggagaagctacggctatctggccctttttaaacaaaccccggttccgggctgaagccgaggcggggaccctctcctgacgctgcgctctctgcgaggcaacctttcacgtccatcgcttgtcatcttaggatccccatgttattttagcccagattggctagttctggggaggcagcatggtgggacgattctgtcccgagtccccgccaggctttgttcgggtcgccgctaccagcgcggtctccctagatcctccatccggggaacctcgccccgggtgcgggtacccggggccgcgcagcgctgcctcgagggtgtatggatgcaccgcgccggcgagagagaccgggggctgggcctgggagaccctagcgggggcgggggcgaagaagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccgcgactaatttcaaaatgctttttattattattattttttagacagtctcactttgtcgcccaggccggagtgcagtggtgcgatctcagatcagtgtaccatttgcctcccgggctcaagcgattctcctgcctcagcctcccaagtagctgggattacaggcacctgccaccatgcccggctaatttttgtaattttagtagagacagggtttcaccatgttgcccaggctggtttcgaactcctgacctcaggtgatccacccgcctcggcctcccaaagtgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacttttttttctttaaaaaacaactatggatcagaatagccacatttggaatactttttgttatcagtcaatatttttagatagttagaacctggtcctaagcctaaaagtgggcttgattctgcagtaaatcttttacaactgcctcgaaacacagaaacctttttaaaaatagacactccccgaagtcttttgttcgcatggtcacacactgatgcttagatgttccagtaatctaatatggccacagtagtcttgatgaccaaagtcctttttttccatctttacaaaactacatgagaacaaacagatcgaaccgttttgaagctactgtgtgtgtgaatgaacactcttttgctttattccagaatgctgtacatctattttggattgtatattgtgtttgtgtatttacgctttgattcatagtaacttcttatggaattgatttgcattgaacacaaactgtaaataaaaagaaatggctgaaagaaaaaaaaaaaa

SEQ ID NO: 55266 - DNA, 1477 bp, Homo sapiens
acgcccatcctccaccctcggagttggattgggtatcccggagaagctacggctatctggccctttttaaacaaaccccggttccgggctgaagccgaggcggggaccctctcctgacgctgcgctctctgcgaggcaacctttcacgtccatcgcttgtcatcttaggatccccatgttattttagcccagattggctagttctggggaggcagcatggtgggacgattctgtcccgagtccccgccaggctttgttcgggtcgccgctaccagcgcggtctccctagatcctccatccggggaacctcgccccgggtgcgggtacccggggccgcgcagcgctgcctcgagggtgtatggatgcaccgcgccggcgagagagaccgggggctgggcctgggagaccctagcgggggcgggggcgaagaagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagagtagaattgcattgaccgcgactaatttcaaaatgctttttattattattattttttagacaaatgaaactctgtc

SEQ ID NO: 55267 - DNA, 2144 bp, Homo sapiens
acgcccatcctccaccctcggagttggattgggtatcccggagaagctacggctatctggccctttttaaacaaaccccggttccgggctgaagccgaggcggggaccctctcctgacgctgcgctctctgcgaggcaacctttcacgtccatcgcttgtcatcttaggatccccatgttattttagcccagattggctagttctggggaggcagcatggtgggacgattctgtcccgagtccccgccaggctttgttcgggtcgccgctaccagcgcggtctccctagatcctccatccggggaacctcgccccgggtgcgggtacccggggccgcgcagcgctgcctcgagggtgtatggatgcaccgcgccggcgagagagaccgggggctgggcctgggagaccctagcgggggcgggggcgaagaagatttattccagtgaaacaacaactggaacttcaagtaactcctcccagagtacttccaactctgggttggccccaaatccaactaatgccaccaccaaggcggctggtggtgccctgcagtcaacagccagtctcttcgtggtctcactctctcttctgcatctctactcttaagagactcaggccaagaaacgtcttctaaatttccccatcttctaaacccaatccaaatggcgtctggaagtccaatgtggcaaggaaaaacaggtcttcatcgaatctactaattccacaccttttattgacacagaaaatgttgagaatcccaaatttgattgatttgaagaacatgtgagaggtttgactagatgatggatgccaatattaaatctgctggagtttcatgtacaagatgaaggagaggcaacatccaaaatagttaagacatgatttccttgaatgtggcttgagaaatatggacacttaatactaccttgaaaataagaatagaaataaaggatgggattgtggaatggagattcagttttcatttggttcattaattctataaggccataaaacaggtaatataaaaagcttccatgattctatttatatgtacatgagaaggaacttccaggtgttactgtaattcctcaacgtattgtttcgacagcactaatttaatgccgatatactctagatgaagttttacattgttgagctattgctgttctcttgggaactgaactcactttcctcctgaggctttggatttgacattgcatttgaccttttatgtagtaattgacatgtgccagggcaatgatgaatgagaatctacccccagatccaagcatcctgagcaactcttgattatccatattgagtcaaatggtaggcatttcctatcacctgtttccattcaacaagagcactacattcatttagctaaacggattccaaagatgctgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacttttttttctttaaaaaacaactatggatcagaatagccacatttggaatactttttgttatcagtcaatatttttagatagttagaacctggtcctaagcctaaaagtgggcttgattctgcagtaaatcttttacaactgcctcgaaacacagaaacctttttaaaaatagacactccccgaagtcttttgttcgcatggtcacacactgatgcttagatgttccagtaatctaatatggccacagtagtcttgatgaccaaagtcctttttttccatctttacaaaactacatgagaacaaacagatcgaaccgttttgaagctactgtgtgtgtgaatgaacactcttttgctttattccagaatgctgtacatctattttggattgtatattgtgtttgtgtatttacgctttgattcatagtaacttcttatggaattgatttgcattgaacacaaactgtaaataaaaagaaatggctgaaagaaaaaaaaaaaa

SEQ ID NO: 55268 - DNA, 1845 bp, Homo sapiens
cttgccgatgctcccagctgaataaagccctgccttctacaactcagtgtctgagaggttttgtctgcggctcaccctgctacatttcttggttccctgactgggaaacgaggtgactgacggatggccgaggcagccccttaggcggcttaggcctgccctgtggagcatccgtgaggggaactccggccagcctgagtgacgtgatccaaagagcgctcccgggtaggcaattgccccaatggaacgcctcgccagagcagcgtgtagcaggcccccacggaagattaacacagtggctgaacaccaggaaggaactggcacttggagtccggacatctacaacttggcccaaccaccgagaccacccttaaacatcagtagactgggagctgtacgtggatgggagcagctttgccaacccttgcaaagtgactctgaagaagacgacaagccttgttccggtcacacccggaagctgactggttcacgcatggccgaagcatgaggaaactcatcgcgggaataattttccttaaaatttggacttgtacagtaaggacttcaactgaccttatgctaagctgcctgatcagtggacaggtagctgtgtaattggacaggtagctgtgtaattggcaccattaagccatctttcttcttactgccaataaaaacaggtgaacttctaggcttcctagtctatgcttcccgtgaaaaatgaagcatagccataggtgattagaaaataatgaatggccccctgaaagaatcatacaatactatagacccaccacttaggcacaagatggctcatgaggatatcgaacccccatctacatgctcaaccgaatcatacagttacaagcggttttagaaattattactaataaaaccggtcaagccttgactgttcttgcccggcaagagactctgatgagaaattttatctatcaaaatatactagctcttgactacttgctagcagctgaaggagaagtttgtaaaaaatttaaccttactaattgttgtctacacataaatgattaagggcaagtagttaaaaatatagttaaagatataacaaaactggcacatgtacccatgcaagtgtggcatgggctcaatccgggagccatgtttgcaaattggttcccagcaatgaaaaaatttaaaactcttataataagagtaataatagtaatagaaacctgcttactgctcctttgtctgatacctgtatttctccaaatgataaaaaactttgtcacgaccttagttcaccaaaatgctttagcagaagcatactatataaatcactatcaatctattgcacaaaaagacataagtagcaaaaataagactcagaactcccactaataaaaactgagagtctcaaaggggggaaatgagggaagagagagagaccctctcatattgttttatattgttttatactcagtacctcttttaagaaaaagtgacaaggaagtaaaaccaaagacaggcagcctggtgccaggcctgaaaccaggcctgggcctgtctggcctaaacccagtagttaaaaatcaactcataacttagaaactgatgttattcatagattccagacattgtatagaagaacattgtgaaactccctgccctgttctgtttctctctgaccactggtgcatgcagcccctgtcatgtaccgcctgcttgctcaaatcaatcacgaccctttcatgtgaaatctttagtgttgtgagcccttaaaagggacagaaattgagtatttggggagcttggattttaaggcagtagcttgctgatgctcccagctgaataaagcccttcctt

SEQ ID NO: 55269 - DNA, 1785 bp, Homo sapiens; identical to SEQ ID NO: 55256

SEQ ID NO: 55270 - DNA, 1491 bp, Homo sapiens; identical to SEQ ID NO: 55257

SEQ ID NO: 55271 - DNA, 1276 bp, Homo sapiens; identical to SEQ ID NO: 55258

SEQ ID NO: 55272 - DNA, 928 bp, Homo sapiens; identical to SEQ ID NO: 55259

SEQ ID NO: 55273 - DNA, 1558 bp, Homo sapiens; identical to SEQ ID NO: 55260

SEQ ID NO: 55274 - DNA, 1692 bp, Homo sapiens; identical to SEQ ID NO: 55261

SEQ ID NO: 55275 - DNA, 1499 bp, Homo sapiens; identical to SEQ ID NO: 55262

SEQ ID NO: 55276 - DNA, 1165 bp, Homo sapiens
aagcagcttctccgctccttctaggatctccgcctggttcggcccgcctgcctccactcctgcctccaccatgtccattaggtggaccccgacatccaggctgtgtgcacccaggagaaggagcagatcaagaccctcaacaacaagtttgcctccttcatagacaaggtacggttcctggagcagcagaacaagatgctggagaccaagtggagcctcctgcagcagcagaagacggccgggagcaacatggacaacatgttcaagagctacatcaacaaccttaggcggcagctggagactctgggctaggagaaactgaagctggaggcggagcttggcaacatgtaggggctggtggaggacttcaagaacaagtatgaggatgagatcaataagcgtgcagagatggagaatgaatttgtcctcatcaagaaggattgtggatgaagcttacattaacaaggtagagctggagtctcgcctggaagggctgactgatgagatcaacttcctcaggcagctgtatgaagaggagatccgggagctgcagtcctggatctcagacacatctgtggtgctgtccatggacaacagccgctccctggacatgaacagcgtcatcgctgaggtcaaggcacagtacgaggagatcgccaaccgcagccaggccgaggctgagagcatgtaccagatcaaggatgaggagctgcagagtctggctgggaagcatggggataacctgcggtgcacaaagactaagatctccgagatgaaccggaacatcagccggctccaggctgagaatgagggcctcaaaggccagagggctttcctggaggccgccattgcagatgccgagcagtgtggagagctggccattaaggatgctaacgccaagttgtcgagctggaggccgccctgcagcgggccaagcaggacatggcgtggcagctgcgtgagtaccaggagctgatgaacgtcaggctggccctggacatcgagatcgccacctacaagaagctgctggagggcgaggagagccggctggagtctgggatgcagaacatgagtattcatacgaagaccaccagcggctatgcaagtggtctgagctcggcctgtgggggcctcacaagccccggcctcagctacggcctgggcg

SEQ ID NO: 55277 - DNA, 1385 bp, Homo sapiens
caagaagcagcttctccgctccttctaggatctccgcctggttcggcccgcctgcctccactcctgcctccaccatgtccattaggtgacccagaagtcctacaaggtgtccacctctggcccccgggccttcagcagccactcctacacaagtgggcccggtgcccacatcagctcctcaagcttctcccaagtgggcagcagctgctttcggggtggcctgggcggcggctgtggtggggccagcggcatgggaggcatcaccgcggtcacagtcaaccagagcctgctgagcccccttgtcctggaggtggaccccgacatccaggctgtgtgcacccaggagaaggagcagatcaagaccctcaacaacaagtttgcctccttcatagacaaggtacggttcctggagcagcagaacaagatgctggagaccaagtggagcctcctgcagcagcagaagacggccgggagcaacatggacaacatgttcaagagctacatcaacaaccttaggcggcagctggagactctgggctaggagaaactgaagctggaggcggagcttggcaacatgtaggggctggtggaggacttcaagaacaagtatgaggatgagatcaataagcgtgcagagatggagaatgaatttgtcctcatcaagaaggattgtggatgaagcttacattaacaaggtagagctggagtctcgcctggaagggctgactgatgagatcaacttcctcaggcagctgtatgaagaggagatccgggagctgcagtcctggatctcagacacatctgtggtgctgtccatggacaacagccgctccctggacatgaacagcgtcatcgctgaggtcaaggcacagtacgaggagatcgccaaccgcagccaggccgaggctgagagcatgtaccagatcaaggatgaggagctgcagagtctggctgggaagcatggggataacctgcggtgcacaaagactaagatctccgagatgaaccggaacatcagccggctccaggctgagaatgagggcctcaaaggccagagggctttcctggaggccgccattgcagatgccgagcagtgtggagagctggccattaaggatgctaacgccaagttgtcgagctggaggccgccctgcagcgggccaagcaggacatggcgtggcagctgcgtgagtaccaggagctgatgaacgtcaggctggccctggacatcgagatcgccacctacaagaagctgctggagggcgaggagagccggctggagtctgggatgcagaacatgagtattcatacgaagaccaccagcggctatgcaagtggtctgagctcggcctgtgggggcctcacaagccccggcctcagctacg

SEQ ID NO: 55278 - DNA, 2078 bp, Homo sapiens; identical to SEQ ID NO: 55251

SEQ ID NO: 55279 - DNA, 1063 bp, Homo sapiens; identical to SEQ ID NO: 55264

SEQ ID NO: 55280 - DNA, 1385 bp, Homo sapiens
ggctggcgggtttctatggtgatgcagcccaagtcccagagaccagggtcttggctgggatccccatcctggcagacctcctcacaggaccccaccactaccccaggttctcccatgaacgtgccctcctggagcctgggccactctgcgaggccgcatcaccctcacacccagaaaagcactcagtgcagccatttcgagctttgaaagggaacttggtgatcaaggtgcatgccaaggaaggcgccagctgtagttccagtggtggaaagggctcggacctgggagaggccgattgggggcacaatctgggcaccctgctcactgtaggagccctcaggccaggcccttcctcactctttgcctcccttttcccttcagataatcatcaagaaaaaagaaaacaagtgacaccccacgaagacagggacaatgctggtccagtttgtcactggctcttccatgggcagcccagagcccggcccaaaggagcactggccatgagcagctgcccagtacacgactgcccatcgctgggatgctgagcgcctggagcctgtggaaacgggctccagaggcgccctacgcctccggggaggagcccctggctctgcggcaggttttcgggccagcatctggggcgccgcccaggtacccctcacctgtcgggctcgggcacccggcatccctcccccgccccgcttacagcccgcggtgcccggagcccgacgcccggcatgggtggggctccggcagcaacgccggttaccgcgggccggaccgggccgggcggcactccctgccctgcacaggatcgagaaggaaggagctcctccccagtgccccctcctaggctcaaggccatgacctcacaggcgaggaagcaaaatggaggggccctcatagacacagtggactggacaagggaagccccagactctgaccctgtgatgagcatgcagaagacgcagaagccacagacgacagtggggcagtaaggaagtgccagcaggcaggcggggtgggctcagccagacgtgtctttctctgttctcctttcaatctttctgtgtcttcatatctcaggtgtagcgcttggaaacagcacatagttgggttttggtttggtttgattctgtctaacaattcttgtctttttaaaaatcagctttgagacctgcctgggcaacacagcgagaccacgtctctacaaaaaaaattttaaaattaggcatggtggtgcatgtctgtagtcccaactactcaggaggctgaggtgggaggatcgctggagcccaagaggttgaggctacagtgagccatgatcacaccactacactccagcctgggtgacagagtgagaccctgtctcaaaaaaaaaaaaa

SEQ ID NO: 55281 - DNA, 819 bp, Homo sapiens
acgccgacgatggggtcatggcgccccgaaccctcctcctgctgctctcggggaccctggccctggccgagacctgggcgggctcccactccatgaggtatttcagcaccgccgtttcctggccgggccgcggggagcccagcttcattgccgtgggctacgtggacgacacgcagttcgtgcgggtcgacagtgacgccgtgagtctgaggatgaagacgcgggcgcggtgggtggagcaggaggggccggagtattgggacctacagacactgggcgccaaggcccaggcacagactgaccgagtgaacctgcggaccctgctccgctactacaaccagagcgaggcggaccccccccaagacacacgtgacccacccccctctctgaacatgaggcataacgaggtcctgggttctgggcttctaccctgcggagatcacattgacctggcagcgggatggggaggaccagacccaggacatggagctcgtggagaccaggcccacaggggatggaaccttccagaagtgggcggttgtggtagtgccttctggagaggaacagagatacacatgccatgtgcagcacaaggggctgcccaagcccctcatcctgagatgggtcacacatttctggaaacttctcgaggttccaagactaggaggttcctctaggacctcatggccctgctaccttcctggcctctcacaggacgttttcttcccgcagatagaaaaggagggagctactctcaggctgcaatgtgagacagctgccttgtgtgggactgagaggcaagatttgttcatgccttcc

SEQ ID NO: 55282 - DNA, 412 bp, Homo sapiens; identical to SEQ ID NO: 55252

SEQ ID NO: 55283 - DNA, 3852 bp, Homo sapiens
atgtgcggcccgcggcggctcgcagctcccggcagcagcctcggcagcttcggccgcgcctcgagaggcggccgcagaggctccagcggcggccgagcggccgagcccgggctgggagacaccatgcgccgcgtccttcggctgctcctcggttgcttcctcaccgagctgtgcgcccgcgtgtgccgggcgcaggagcgagcgggacacgggcagctggcgcaactgggcggcgtgttgctgctggcggggggcaaccgctccggggccgcctccggagaggccagcgagggcgctgaggcatcggacgcgcccccgacccgggcgcccacgccggacttctgccggggctacttcgatgtcatgggccagtgggacccgccgttcaactgcagctcgggcgacttcatcttctgctgcgggacttgtggcttccggttctgctgcacgtttaagaagcggcgactgaaccaaagcacctgcaccaactacgacacgccgctctggctcaacaccggcaagccccccgcccgcaaggacgaccccttgcacgaccccaccaaggacaagaccaacctgatcgtctacatcatctgcggggtggtggccgtcatggtgctcgtgggcatcttcaccaagctggggctggagaaagcgcaccggccccaaagggagcacatgtccaggctctatgacaatctgctgtttacggaggcacagatttctttccaagaggacgaacctgcccctggagagtggagtgtcggacttcaaacctggacagtctgagtgcacggatccttggccgctaggctgcactgcgtttgagtgcaaacctgcaggaattccagacttctcagatcacagagaagtacgcgatgccctgcaaacaacagctcatgcatcggggccagttcaagaagctaccgtaagatgaagtctaggaatgctttctatatcggccccggcaggcccagacgtcttggtggaggcgttggtgagaaatgaccttggggacagaagcacatatgtgaagctctctacacttgaagccagtagggaacacatgtcattattttgtccaccttcaaacagaattggaaatccaagtggcaaatggcagataagggtcctgtgtgtttttaaaacatgcttcagaagaactggcaccccttggaaagaaatagcaacaaataatgataaatgcacctcctcctcttgccttttgccttccagtttctctcctgcctctcatctttctatgcatttgtggttatcctaaggctttgaccagcttcccaggctggagaagtccatgtgtgcatgcatctactgttggccacagaaaagtcttaatttatttttctttgcagggtatgttgacttctctttgggcactgagtccttgcattttaaaaatcaacttcattgaagtataatttacacaataaaatgcacacattgtaagtgtgtagtttgatgagcttggacaaatgtctatacctgtgtaatcattactctagaaagctcactcatgcccattgcccttgcatttttgaaaaataattgatgcttcttgtgcaagaagaagtgctcaggaactctattcaagtgtttaaaagtcaacacatagattggacattgggatacctggaggctttgaagcaagataccgggactctgagttctgtttggaaatattggtgtcatatatttgtcattgtaattggaaagaaaagagatgcaccattttcttcttgttctttggataagctaagctcattcccatcttggagctgttgcactggcccttgtgtggctggtccctcctcatcaccagggtcccagctccaatgtcatcttctctgagaagccgtccctgaccaggcttagttgcttcccaccccagcctgacacactccagcccatcacccagtcagtgttatttgcttcatttttacattatggtctaaaattaacttgctagtttactggtttactagtttattatctgtctccttccattatccctctccttccctccttcccttccccttccttccttccttccttccttccttcgagacacagtcgtactctgtcaccccggctggagtgcagtggtgtgatcttgcctcactacaacccctgcctcctgggttttagcgattcttctgcctcagcctcccgagtagctgggactacaggcacccaccatgatgccaggctaatttttgtatttttattggagacagggtttcaccatgttggccaggctggtctcgaactcttgacctcaagtgatccacctgtctcggcctcccaaagtgctgggattacaggcatgagccactgcacctggcccttttattattcatagtaagacacacagggaccacaattgtctcttctactcagtagttggattctgagtgcctagttcagtatttggcaagtaagagttctgcatttgatatcctggtttacctggcacaacaaagtatctccaaattcattcattcattctttcattcattcgataggtatttactgaacatctaacttatgcccaacactgtgctgagagatatgagataaccatgaatagtacaaaagcaatccctgcccttgaagagcaaacagccaaatatcaggagacaggtaacacacaaggaaatgtacaagaaagttgagccagcacttttataagtactggttctagtactagctttcataagaaagtactggttctagtactagctttcagtactctcttgtgaaattttcaatattcagtcatttcaacctcaaaaatggcaacataattatgtttcaacataattgttgttttaaacaaacaattttgtttcaacataattctcctgaactgggtggaaggctatcaagaaaaagcttagcttcttcttcaggtaactgcaagagacagggttctctagagaaacagaacaaatatacaaagagattcattataaggaattggaagtccaaaatctccagagcctctgtacttgtacaagtctgaaggccgacaggcaggagaattctctctttttggggcaaaggtcagtgttttgttctatccaggctttcagatgattggttgaggctcactcacattagaagggcaatctgtcttactgccattagaatgcaacctgttttacttagcttactgatttcaatgttaatctatttcaagagcaccctcacagaaacacccagaataatgtttgatgaaatatctgggcaccctgtgacccagtcaagttgacacatgacactaaccatcacagtacgcttagggtcttgtcactcggagtgtggcctgtgaaccagcagcatttttatcttctgggagcttgggcacgatctcaggccccacctcctgcttattgattcagaatctgcattttaacaagatccccaggtgatctggatgcaccgtaacatctgagaagcactcaaactatgtgccgcaaacaaacgccaaattcttaggcatttgtgtggcttggagcacatagttggttctttctactgtctaattcattacattttttcagcacattcctgtctataaaatgtttttttgtatgcaccccaatatatgcacatttataagcatatgcatgaacccacgaacaatgattaggtacattatgaagcatacgtaaggacagaaatttcaaaccaagcttgagggtgaaataaatattatttgaaaacctgttgctaattgtgatgacttcatactatcattagttactatctcaatgcataatgtacagtgacgggtgaagtttatcattaataaaaaaaatctggatttta

SEQ ID NO: 55284 - DNA, 1224 bp, Homo sapiens; identical to SEQ ID NO: 55254

SEQ ID NO: 55285 - DNA, 2698 bp, Homo sapiens
gcgcgccatgtaaggtaaagtgactgattctatagcaatccaattgttcctttgtctgcccgtttacatataacaatgttgtcaatgtttgattgaaaatacctagcaggcgacacacacacctagctcctcaggcggagagcacccctttcttggccacccgggtatcccccagggggagtacggggctcaaaacacccttttggagaaacaaaggtggaagcaaatttcaggaagtaaaacttcctgaaataaaataaaatatcgaatgccttgagacccatacattttcaggttttcctaattaaagcaattactttccaccacccctccaacctggaatcaccaacttggttagagaaactgatttttcttttttctttttttttttcccaaaagagtacatctgatcattttagcctgcaactaatgatagagatattagggctagttaaccacagttttacaagactcctctccccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacaccttgctcctgcttctgctacgaccttctggggaacgcgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggtccgcttctcttacagtgtgatttggatcatggccatttctaaagcctttgaactgggattagttgccgggctgggccatcaggaatttgctcgtccatctcggggagacctggccttcagagatgacagcatttggccccaggaggagcctgcaattcggcctcggtcttcccagcgtgtgctgcccatgggaatacagcacagtaaggagctaaacagaacctgctgcctgaatgggggaacctgcatgctggagtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagctggcatctgcctttctatacaaagctactattaatcgacattgacctatttccagaaatacaattttagatattatgcaaatttcatgacccgtaaaggctgctgctacaatgtcctaactgaaagatgatcatttgttagttgccttaaaataatgaatacatttccaaaacggtctctaacatttccttacagaactaactacttcttacctctttgccctgccctctcccaaaaaactacttcttttttcaaaagaaagtcagccatatctccattgtgcccaagtccagtgtttcttttttttttttgagacggagtctcactctgtcacccaggctggactgcaatgacgcgatctcggttcactgcaacctccgcatccggggttcaagccattctcctgcctcagcctcccaagtagctgggattacaggcatgtgtcaccatgcccggctaattttttttgtatttttagtagagacgggggtttcaccatattggccagcctggtctcgaactcctgaccttgtgatccactcgcctcggcctctcgaagtgctgagattacacacgtgagcaactgtgcaaggcctggtgtttcttggtacatgtaattctaccaaggtcttcttaatatgttcttttaaatgattgaattacatcttcagattattaaagactaattctaatgtggaccttagaatacagttttgagtagagttgatcaaaatcaattaaaatagtctcttttaaaaggaaagaaaacatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatgtaagacaaggactcccctttttttcccaaaggcattgtaaaaagaatgaagtctccttagaaaaaaaattatacctcaatgtccccaacaagattgcttaataaattgtgtttcctccaagctattcaattcttttaactgttgtagaagagaaaatgttcacaatatatttagttgtaaaccaagtgatcaaactacatattgtaaagcccatttttaaaatacattgtatatacgtgtatgcacagtaaaaatggaaactatattgacctaaaaaaaaaaaaaaaaagaaaacacctagcaggcaaggaacatgctcttcagaactctgctcttcagagttccaaagaagggataaaacatcttttatcaccatcaa

SEQ ID NO: 55286 - DNA, 2699 bp, Homo sapiens
gcgcgccatgtaaggtaaagtgactgattctatagcaatccaattgttcctttgtctgcccgtttacatataacaatgttgtcaatgtttgattgaaaatacctagcaggcgacacacacacctagctcctcaggcggagagcacccctttcttggccacccgggtatcccccagggggagtacggggctcaaaacacccttttggaaaaacaaaggtggaagcaaatttcaggaagtaaaacttcctgaaataaaataaaatatcgaatgccttgagacccatacattttcaggttttcctaattaaagcaattactttccaccacccctccaacctggaatcaccaacttggttagagaaactgatttttcttttttcttttttttttttcccaaaagagtacatctgatcattttagcctgcaactaatgatagagatattagggctagttaaccacagttttacaagactcctctccccgcgtgtgggccattgtcatgctggtgggcgtcccgcccacctgaaaggtctccccgccccgactggggtttgttgttgaagaaggagaatccccggaaaggctgagtctccagctcaaggtcaaaacgtccaaggccgaaagccctccagtttcccctggacaccttgctcctgcttctgctacgaccttctggggaacgcgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggtccgcttctcttacagtgtgatttggatcatggccatttctaaagcctttgaactgggattagttgccgggctgggccatcaggaatttgctcgtccatctcggggagacctggccttcagagatgacagcatttggccccaggaggagcctgcaattcggcctcggtcttcccagcgtgtgctgcccatgggaatacagcacagtaaggagctaaacagaacctgctgcctgaatgggggaacctgcatgctggagtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagctggcatctgcctttctatacaaagctactattaatcgacattgacctatttccagaaatacaattttagatattatgcaaatttcatgacccgtaaaggctgctgctacaatgtcctaactgaaagatgatcatttgttagttgccttaaaataatgaatacatttccaaaacggtctctaacatttccttacagaactaactacttcttacctctttgccctgccctctcccaaaaaactacttcttttttcaaaagaaagtcagccatatctccattgtgcccaagtccagtgtttcttttttttttttgagacggagtctcactctgtcacccaggctggactgcaatgacgcgatctcggttcactgcaacctccgcatccggggttcaagccattctcctgcctcagcctcccaagtagctgggattacaggcatgtgtcaccatgcccggctaattttttttgtatttttagtagagacgggggtttcaccatattggccagcctggtctcgaactcctgaccttgtgatccactcgcctcggcctctcgaagtgctgagattacacacgtgagcaactgtgcaaggcctggtgtttcttggtacatgtaattctaccaaggtcttcttaatatgttcttttaaatgattgaattacatcttcagattattaaagactaattctaatgtggaccttagaatacagttttgagtagagttgatcaaaatcaattaaaatagtctcttttaaaaggaaagaaaacatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatgtaagacaaggactcccctttttttcccaaaggcattgtaaaaagaatgaagtctccttagaaaaaaaattatacctcaatgtccccaacaagattgcttaataaattgtgtttcctccaagctattcaattcttttaactgttgtagaagagaaaatgttcacaatatatttagttgtaaaccaagtgatcaaactacatattgtaaagcccatttttaaaatacattgtatatacgtgtatgcacagtaaaaatggaaactatattgacctaaaaaaaaaaaaaaaaagaaaacacctagcaggcaaggaacatgctcttcagaactctgctcttcagagttccaaagaagggataaaacatcttttatcaccatcaa

SEQ ID NO: 55287 - DNA, 14392 bp, Homo sapiens
gcagacctaaaggagcgttcgctagcagaggcgctgccggtgcggtgtgctacgcgcgcccacctcccggggaaggaacggcgaggccggggaccgtcgcggagatggatcgcgggccggcagcagtggcgtgcacgctgctcctggctctcgtcgcctgcctagcgccggccagtggccaagaatgtgacagtgcgcattttcgctgtggaagtgggcattgcatccctgcagactggaggtgtgatgggaccaaagactgttcagatgacgcggatgaaattggctgcgctgttgtgacctgccagcagggctatttcaagtgccagagtgagggacaatgcatccccagctcctgggtgtgtgaccaagatcaagactgtgatgatggctcagatgaacgtcaagattgctcacaaagtacatgctcaagtcatcagataacatgctccaatggtcagtgtatcccaagtgaatacaggtgcgaccacgtcagagactgccccgatggagctgatgagaatgactgccagtacccaacatgtgagcagcttacttgtgacaatggggcctgctataacaccagtcagaagtgtgattggaaagttgattgcagggactcctcagatgaaatcaactgcactgagatatgcttgcacaatgagttttcatgtggcaatggagagtgtatccctcgtgcttatgtctgtgaccatgacaatgattgccaagacggcagtgatgaacatgcttgcaactatccgacctgcggtggttaccagttcacttgccccagtggccgatgcatttatcaaaactgggtttgtgatggagaagatgactgtaaagataatggagatgaagatggatgtgaaagcggtcctcatgatgttcataaatgttccccaagagaatggtcttgcccagagtcgggacgatgcatctccatttataaagtttgtgatgggattttagattgcccaggaagagaagatgaaaacaacactagtaccggaaaatactgtagtatgactctgtgctctgccttgaactgccagtaccagtgccatgagacgccgtatggaggagcgtgtttttgtcccccaggttatatcatcaaccacaatgacagccgtacctgtgttgagtttgatgattgccagatatggggaatttgtgaccagaagtgtgaaagccgacctggccgtcacctgtgccactgtgaagaagggtatatcttggagcgtggacagtattgcaaagctaatgattcctttggcgaggcctccattatcttctccaatggtcgggatttgttaattggtgatattcatggaaggagcttccggatcctagtggagtctcagaatcgtggagtggccgtgggtgtggctttccactatcacctgcaaagagttttttggacagacaccgtgcaaaataaggttttttcagttgacattaatggtttaaatatccaagaggttctcaatgtttctgttgaaaccccagagaacctggctgtggactgggttaataataaaatctatctagtggaaaccaaggtcaaccgcatagatatggtaaatttggatggaagctatcgggttacccttataactgaaaacttggggcatcctagaggaattgccgtggacccaactgttggttatttatttttctcagattgggagagcctttctggggaacctaagctggaaagggcattcatggatggcagcaaccgtaaagacttggtgaaaacaaagctgggatggcctgctggggtaactctggatatgatatcgaagcgtgtttactgggttgactctcggtttgattacattgaaactgtaacttatgatggaattcaaaggaagactgtagttcatggaggctccctcattcctcatccctttggagtaagcttatttgaaggtcaggtgttctttacagattggacaaagatggccgtgctgaaggcaaacaagttcacagagaccaacccacaagtgtactaccaggcttccctgaggccctatggagtgactgtttaccattccctcagacagccctatgctaccaatccgtgtaaagataacaatgggggctgtgagcaggtctgtgttctcagccacagaacagataatgatggtttgggtttccgttgcaagtgcacattcggcttccaactggatacagatgagcgccactgcattgctgttcagaatttcctcattttttcatcccaagttgctattcgtgggatcccgttcaccttgtctacccaggaagatgtcatggttccagtttcggggaatccttctttctttgtcgggattgattttgacgcccaggacagcactatctttttttcagatatgtcaaaacacatgatttttaagcaaaagattgatggcacaggaagagaaattctcgcagctaacagggtggaaaatgttgaaagtttggcttttgattggatttcaaagaatctctattggacagactctcattacaagagtatcagtgtcatgaggctagctgataaaacgagacgcacagtagttcagtatttaaataacccacggtcggtggtagttcatccttttgccgggtatctattcttcactgattggttccgtcctgctaaaattatgagagcatggagtgacggatctcacctcttgcctgtaataaacactactcttggatggcccaatggcttggccatcgattgggctgcttcacgattgtactgggtagatgcctattttgataaaattgagcacagcacctttgatggtttagacagaagaagactgggccatatagagcagatgacacatccgtttggacttgccatctttggagagcatttattttttactgactggagactgggtgccattattcgagtcaggaaagcagatggtggagaaatgacagttatccgaagtggcattgcttacatactgcatttgaaatcgtatgatgtcaacatccagactggttctaacgcctgtaatcaacccacgcatcctaacggtgactgcagccacttctgcttcccggtgccaaatttccagcgagtgtgtgggtgcccttatggaatgaggctggcttccaatcacttgacatgcgagggggacccaaccaatgaaccacccacggagcagtgtggcttattttccttcccctgtaaaaatggcagatgtgtgcccaattactatctctgtgatggagtcgatgattgtcatgataacagtgatgagcaactatgtggcacacttaataatacctgttcatcttcggcgttcacctgtggccatggggagtgcattcctgcacactggcgctgtgacaaacgcaacgactgtgtggatggcagtgatgagcacaactgccccacccacgcacctgcttcctgccttgacacccaatacacctgtgataatcaccagtgtatctcaaagaactgggtctgtgacacagacaatgattgtggggatggatctgatgaaaagaactgcaattcgacagagacatgccaacctagtcagtttaattgccccaatcatcgatgtattgacctatcgtttgtctgtgatggtgacaaggattgtgttgatggatctgatgaggttggttgtgtattaaactgtactgcttctcaattcaagtgtgccagtggggataaatgtattggcgtcacaaatcgttgtgatggtgtttttgattgcagtgacaactcggatgaagcgggctgtccaaccaggcctcctggtatgtgccactcagatgaatttcagtgccaagaagatggtatctgcatcccgaacttctgggaatgtgatgggcatccagactgcctctatggatctgatgagcacaatgcctgtgtccccaagacttgcccttcatcatatttccactgtgacaacggaaactgcatccacagggcatggctctgtgatcgggacaatgactgcggggatatgagtgatgagaaggactgccctactcagccctttcgctgtcctagttggcaatggcagtgtcttggccataacatctgtgtgaatctgagtgtagtgtgtgatggcatctttgactgccccaatgggacagatgagtccccactttgcaatgggaacagctgctcagatttcaatggtggttgtactcacgagtgtgttcaagagccctttggggctaaatgcctatgtccattgggattcttacttgccaatgattctaagacctgtgaagacatagatgaatgtgatattctaggctcttgtagccagcactgttacaatatgagaggttctttccggtgctcgtgtgatacaggctacatgttagaaagtgatgggaggacttgcaaagttacagcatctgagagtctgctgttacttgtggcaagtcagaacaaaattattgccgacagtgtcacctcccaggtccacaatatctattcattggtcgagaatggttcttacattgtagctgttgattttgattcaattagtggtcgtatcttttggtctgatgcaactcagggtaaaacctggagtgcgtttcaaaatggaacggacagaagagtggtatttgacagtagcatcatcttgactgaaactattgcaatagattgggtaggtcgtaatctttactggacagactatgctctggaaacaattgaagtctccaaaattgatgggagccacaggactgtgctgattagtaaaaacctaacaaatccaagaggactagcattagatcccagaatgaatgagcatctactgttctggtctgactggggccaccaccctcgcatcgagcgagccagcatggacggcagcatgcgcactgtcattgtccaggacaagatcttctggccctgcggcttaactattgactaccccaacagactgctctacttcatggactcctatcttgattacatggacttttgcgattataatggacaccatcggagacaggtgatagccagtgatttgattatacggcacccctatgccctaactctctttgaagactctgtgtactggactgaccgtgctactcgtcgggttatgcgagccaacaagtggcatggagggaaccagtcagttgtaatgtataatattcaatggccccttgggattgttgcggttcatccttcgaaacaaccaaattccgtgaatccatgtgccttttcccgctgcagccatctctgcctgctttcctcacaggggcctcatttttactcctgtgtttgtccttcaggatggagtctgtctcctgatctcctgaattgcttgagagatgatcaacctttcttaataactgtaaggcaacatataatttttggaatctcccttaatcctgaggtgaagagcaatgatgctatggtccccatagcagggatacagaatggtttagatgttgaatttgatgatgctgagcaatacatctattgggttgaaaatccaggtgaaattcacagagtgaagacagatggcaccaacaggacagtatttgcttctatatctatggtggggccttctatgaacctggccttagattggatttcaagaaacctttattctaccaatcctagaactcagtcaatcgaggttttgacactccacggagatatcagatacagaaaaacattgattgccaatgatgggacagctcttggagttggctttccaattggcataactgttgatcctgctcgtgggaagctgtactggtcagaccaaggaactgacagtggggttcctgccaagatcgccagtgctaacatggatggcacatctgtgaaaactctctttactgggaacctcgaacacctggagtgtgtcactcttgacatcgaagagcagaaactctactgggcagtcactggaagaggagtgattgaaagaggaaacgtggatggaacagatcggatgatcctggtacaccagctttcccacccctggggaattgcagtccatgattctttcctttattatactgatgaacagtatgaggtcattgaaagagttgataaggccactggggccaacaaaatagtcttgagagataatgttccaaatctgaggggtcttcaagtttatcacagacgcaatgccgccgaatcctcaaatggctgtagcaacaacatgaatgcctgtcagcagatttgcctgcctgtaccaggaggattgttttcctgcgcctgtgccactggatttaaactcaatcctgataatcggtcctgctctccatataactctttcattgttgtttcaatgctgtctgcaatcagaggctttagcttggaattgtcagatcattcagaaaccatggtgccggtggcaggccaaggacgaaacgcactgcatgtggatgtggatgtgtcctctggctttatttattggtgtgattttagcagctcagtggcatctgataatgcgatccgtagaattaaaccagatggatcttctctgatgaacattgtgacacatggaataggagaaaatggagtccggggtattgcagtggattgggtagcaggaaatctttatttcaccaatgcctttgtttctgaaacactgatagaagttctgcggatcaatactacttaccgccgtgttcttcttaaagtcacagtggacatgcctaggcatattgttgtagatcccaagaacagatacctcttctgggctgactatgggcagagaccaaagattgagcgttctttccttgactgtaccaatcgaacagtgcttgtgtcagagggcattgtcacaccacggggcttggcagtggaccgaagtgatggctacgtttattgggttgatgattctttagatataattgcaaggattcgtatcaatggagagaactctgaagtgattcgttatggcagtcgttacccaactccttatggcatcactgtttttgaaaattctatcatatgggtagataggaatttgaaaaagatcttccaagccagcaaggaaccagagaacacagagccacccacagtgataagagacaatatcaactggctaagagatgtgaccatctttgacaagcaagtccagccccggtcaccagcagaggtcaacaacaacccttgcttggaaaacaatggtgggtgctctcatctctgctttgctctgcctggattgcacaccccaaaatgtgactgtgcctttgggaccctgcaaagtgatggcaagaattgtgccatttcaacagaaaatttcctcatctttgccttgtctaattccttgagaagcttacacttggaccctgaaaaccatagcccacctttccaaacaataaatgtggaaagaactgtcatgtctctagactatgacagtgtaagtgatagaatctacttcacacaaaatttagcctctggagttggacagatttcctatgccaccctgtcttcagggatccatactccaactgtcattgcttcaggtatagggactgctgatggcattgcctttgactggattactagaagaatttattacagtgactacctcaaccagatgattaattccatggctgaagatgggtctaaccgcactgtgatagcccgcgttccaaaaccaagagcaattgtgttagatccctgccaagggtacctgtactgggctgactgggatacacatgccaaaatcgagagagccacattgggaggaaacttccgggtacccattgtgaacagcagtctggtcatgcccagtgggctgactctggactatgaagaggaccttctctactgggtggatgctagtctgcagaggattgaacgcagcactctgacgggcgtggatcgtgaagtcattgtcaatgcagccgttcatgcttttggcttgactctctatggccagtatatttactggactgacttgtacacacaaagaatttaccgagctaacaaatatgacgggtcaggtcagattgcaatgaccacaaatttgctctcccagcccaggggaatcaacactgttgtgaagaaccagaaacaacagtgtaacaatccttgtgaacagtttaatgggggctgcagccatatctgtgcaccaggtccaaatggtgccgagtgccagtgtccacatgagggcaactggtatttggccaacaacaggaagcactgcattgtggacaatggtgaacgatgtggtgcatcttccttcacctgctccaatgggcgctgcatctcggaagagtggaagtgtgataatgacaacgactgtggggatggcagtgatgagatggaaagtgtctgtgcacttcacacctgctcaccgacagccttcacctgtgccaatgggcgatgtgtccaatactcttaccgctgtgattactacaatgactgtggtgatggcagtgatgaggcagggtgcctgttcagggactgcaatgccaccacggagtttatgtgcaataacagaaggtgcatacctcgtgagtttatctgcaatggtgtagacaactgccatgataataacacttcagatgagaaaaattgccctgatcgcacttgccagtctggatacacaaaatgtcataattcaaatatttgtattcctcgcgtttatttgtgtgacggagacaatgactgtggagataacagtgatgaaaaccctacttattgcaccactcacacatgcagcagcagtgagttccaatgcgcatctgggcgctgtattcctcaacattggtattgtgatcaagaaacagattgttttgatgcctctgatgaacctgcctcttgtggtcactctgagcgaacatgcctagctgatgagttcaagtgtgatggtgggaggtgcatcccaagcgaatggatctgtgacggtgataatgactgtggggatatgagtgacgaggataaaaggcaccagtgtcagaatcaaaactgctcggattccgagtttctctgtgtaaatgacagacctccggacaggaggtgcattccccagtcttgggtctgtgatggcgatgtggattgtactgacggctacgatgagaatcagaattgcaccaggagaacttgctctgaaaatgaattcacctgtggttacggactgtgtatcccaaagatattcaggtgtgaccggcacaatgactgtggtgactatagcgacgagaggggctgcttataccagacttgccaacagaatcagtttacctgtcagaacgggcgctgcattagtaaaaccttcgtctgtgatgaggataatgactgtggagacggatctgatgagctgatgcacctgtgccacaccccagaacccacgtgtccacctcacgagttcaagtgtgacaatgggcgctgcatcgagatgatgaaactctgcaaccacctagatgactgtttggacaacagcgatgagaaaggctgtggcattaatgaatgccatgacccttcaatcagtggctgcgatcacaactgcacagacaccttaaccagtttctattgttcctgtcgtcctggttacaagctcatgtctgacaagcggacttgtgttgatattgatgaatgcacagagatgccttttgtctgtagccagaagtgtgagaatgtaataggctcctacatctgtaagtgtgccccaggctacctccgagaaccagatggaaagacctgccggcaaaacagtaacatcgaaccctatctcatttttagcaaccgttactatttgagaaatttaactatagatggctatttttactccctcatcttggaaggactggacaatgttgtggcattagattttgaccgagtagagaagagattgtattggattgatacacagaggcaagtcattgagagaatgtttctgaataagacaaacaaggagacaatcataaaccacagactaccagctgcagaaagtctggctgtagactgggtttccagaaagctctactggttggatgcccgcctggatggcctctttgtctctgacctcaatggtggacaccgccgcatgctggcccagcactgtgtggatgccaacaacaccttctgctttgataatcccagaggacttgcccttcaccctcaatatgggtacctctactgggcagactggggtcaccgcgcatacattgggagagtaggcatggatggaaccaacaagtctgtgataatctccaccaagttagagtggcctaatggcatcaccattgattacaccaatgatctactctactgggcagatgcccacctgggttacatagagtactctgatttggagggccaccatcgacacacggtgtatgatggggcactgcctcaccctttcgctattaccatttttgaagacactatttattggacagattggaatacaaggacagtggaaaagggaaacaaatatgatggatcaaatagacagacactggtgaacacaacacacagaccatttgacatccatgtgtaccatccatataggcagcccattgtgagcaatccctgtggtaccaacaatggtggctgttctcatctctgcctcatcaagccaggaggaaaagggttcacttgcgagtgtccagatgacttccgcacccttcaactgagtggcagcacctactgcatgcccatgtgctccagcacccagttcctgtgcgctaacaatgaaaagtgcattcctatctggtggaaatgtgatggacagaaagactgctcagatggctctgatgaactggccctttgcccgcagcgcttctgccgactgggacagttccagtgcagtgacggcaactgcaccagcccgcagactttatgcaatgctcaccaaaattgccctgatgggtctgatgaagaccgtcttctttgtgagaatcaccactgtgactccaatgaatggcagtgcgccaacaaacgttgcatcccagaatcctggcagtgtgacacatttaacgactgtgaggataactcagatgaagacagttcccactgtgccagcaggacctgccggccgggccagtttcggtgtgctaatggccgctgcatcccgcaggcctggaagtgtgatgtggataatgattgtggagaccactcggatgagcccattgaagaatgcatgagctctgcccatctctgtgacaacttcacagaattcagctgcaaaacaaattaccgctgcatcccaaagtgggccgtgtgcaatggtgtagatgactgcagggacaacagtgatgagcaaggctgtgaggagaggacatgccatcctgtgggggatttccgctgtaaaaatcaccactgcatccctcttcgttggcagtgtgatgggcaaaatgactgtggagataactcagatgaggaaaactgtgctccccgggagtgcacagagagcgagtttcgatgtgtcaatcagcagtgcattccctcgcgatggatctgtgaccattacaacgactgtggggacaactcagatgaacgggactgtgagatgaggacctgccatcctgaatattttcagtgtacaagtggacattgtgtacacagtgaactgaaatgcgatggatccgctgactgtttggatgcgtctgatgaagctgattgtcccacacgctttcctgatggtgcatactgccaggctactatgttcgaatgcaaaaaccatgtttgtatcccgccatattggaaatgtgatggcgatgatgactgtggcgatggttcagatgaagaacttcacctgtgcttggatgttccctgtaattcaccaaaccgtttccggtgtgacaacaatcgctgcatttatagtcatgaggtgtgcaatggtgtggatgactgtggagatggaactgatgagacagaggagcactgtagaaaaccgacccctaaaccttgtacagaatatgaatataagtgtggcaatgggcattgcattccacatgacaatgtgtgtgatgatgccgatgactgtggtgactggtccgatgaactgggttgcaataaaggaaaagaaagaacatgtgctgaaaatatatgcgagcaaaattgtacccaattaaatgaaggaggatttatctgctcctgtacagctgggttcgaaaccaatgtttttgacagaacctcctgtctagatatcaatgaatgtgaacaatttgggacttgtccccagcactgcagaaataccaaaggaagttatgagtgtgtctgtgctgatggcttcacgtctatgagtgaccgccctggaaaacgatgtgcagctgagggtagctctcctttgttgctactgcctgacaatgtccgaattcgaaaatataatctctcatctgagaggttctcagagtatcttcaagatgaggaatatatccaagctgttgattatgattgggatcccaaggacataggcctcagtgttgtgtattacactgtgcgaggggagggctctaggtttggtgctatcaaacgtgcctacatccccaactttgaatccggccgcaataatcttgtgcaggaagttgacctgaaactgaaatacgtaatgcagccagatggaatagcagtggactgggttggaaggcatatttactggtcagatgtcaagaataaacgcattgaggtggctaaacttgatggaaggtacagaaagtggctgatttccactgacctggaccaaccagctgctattgctgtgaatcccaaactagggcttatgttctggactgactggggaaaggaacctaaaatcgagtctgcctggatgaatggagaggaccgcaacatcctggttttcgaggaccttggttggccaactggcctttctatcgattatttgaacaatgaccgaatctactggagtgacttcaaggaggacgttattgaaaccataaaatatgatgggactgataggagagtcattgcaaaggaagcaatgaacccttacagcctggacatctttgaagaccagttatactggatatctaaggaaaagggagaagtatggaaacaaaataaatttgggcaaggaaagaaagagaaaacgctggtagtgaacccttggctcactcaagttcgaatctttcatcaactcagatacaataagtcagtgcccaacctttgcaaacagatctgcagccacctctgccttctgagacctggaggatacagctgtgcctgtccccaaggctccagctttatagaggggagcaccactgagtgtgatgcagccatcgaactgcctatcaacctgccccccccatgcaggtgcatgcacggaggaaattgctattttgatgagactgacctccccaaatgcaagtgtcctagcggctacaccggaaaatattgtgaaatggcgttttcaaaaggcatctctccaggaacaaccgcagtagctgtgctgttgacaatcctcttgatcgtcgtaattggagctctggcaattgcaggattcttccactatagaaggaccggctcccttttgcctgctctgcccaagctgccaagcttaagcagtctcgtcaagccctctgaaaatgggaatggggtgaccttcagatcaggggcagatcttaacatggatattggagtgtctggttttggacctgagactgctattgacaggtcaatggcaatgagtgaagactttgtcatggaaatggggaagcagcccataatatttgaaaacccaatgtactcagccagagacagtgctgtcaaagtggttcagccaatccaggtgactgtatctgaaaatgtggataataagaattatggaagtcccataaacccttctgagatagttccagagacaaacccaacttcaccagctgctgatggaactcaggtgacaaaatggaatctcttcaaacgaaaatctaaacaaactaccaactttgaaaatccaatctatgcacagatggagaacgagcaaaaggaaagtgttgctgcgacaccacctccatcaccttcgctccctgctaagcctaagcctccttcgagaagagacccaactccaacctattctgcaacagaagacacttttaaagacaccgcaaatcttgttaaagaagactctgaagtatagctataccagctatttagggaataattagaaacacacttttgcacatatattttttacaaacagatgaaaaaagttaacattcagtactttatgaaaaaaatatatttttccctgtttgcctataggtggaggtatcctgtgtgtctttttttacttatgccgtctcatatttttacaaataattatcacaatgtactatatgtatatctttgcactgaagttgtctgaaggtaatactataaatatattgtatatttgtaaattttggaaagattatcctgttactgaatttgctaataaagatgtctgctgaaaaaaaa

SEQ ID NO: 55288 - DNA, 1056 bp, Homo sapiens
gtctgcgcggagtctgagcggcgctcgtcccgtcccaaggccgacgccagcacgccgtcatggcccccgcagcggcgacggggggcagcaccctgcccagtggcttctcggtcttcaccaccttgcccgacttgctcttcatctttgagtttatcttcgggggcctggtgtggatcctggtggcctcctccctggtgccctggcccctggtccagggctgggtgatgttcgtgtctgtgttctgcttcgtggccaccaccaccttgatcatcctgtacataattggagcccacggtggagagacttcctgggtcaccttggacgcagcctaccactgcaccgctgccctcttttacctcagcgcctcagtcctggaggccctggccaccatcacgatgcaagacggcttcacctacaggcactaccatgaaaacattgctgccgtggtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggcgaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatggggactaaaactcacccaacagatctttccagaggtccatggtggaagacgataaccctgtgaaatactttataaaatgtcttaatgttc

SEQ ID NO: 55289 - DNA, 930 bp, Homo sapiens
gtctgcgcggagtctgagcggcgctcgtcccgtcccaaggccgacgccagcacgccgtcatggcccccgcagcggcgacggggggcagcaccctgcccagtggcttctcggtcttcaccaccttgcccgacttgctcttcatctttgagtttatcttcgggggcctggtgtggatcctggtggcctcctccctggtgccctggcccctggtccagggctgggtgatgttcgtgtctgtgttctgcttcgtggccaccaccaccttgatcatcctgtacataattggagcccacggtggagagacttcctgggtcaccttggtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggccaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatgcggactaaaactcacccaacagatctttccagaggtccatggtggaagacgataaccctgtgaaatactttataaaatgtcttaatgttc

SEQ ID NO: 55290 - DNA, 888 bp, Homo sapiens
gtctgcgcggagtctgagcggcgctcgtcccgtcccaaggccgacgccagcacgccgtcatggcccccgcagcggcgacggggggcagcaccctgcccagtggcttctcggtcttcaccaccttgcccgacttgctcttcatctttgagtttgacgcagcctaccactgcaccgctgccctcttttacctcagcgcctcagtcctggaggccctggccaccatcacgatgcaagacggcttcacctacaggcactaccatgaaaacattgctgccgtggtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggccaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatgcggactaaaactcacccaacagatctttccagaggtccatggtggaagacgataaccctgtgaaatactttataaaatgtcttaatgttc

SEQ ID NO: 55291 - DNA, 762 bp, Homo sapiens
gtctgcgcggagtctgagcggcgctcgtcccgtcccaaggccgacgccagcacgccgtcatggcccccgcagcggcgacggggggcagcaccctgcccagtggcttctcggtcttcaccaccttgcccgacttgctcttcatctttgagtttgtgttctcctacatagccactctgctctacgtggtccatgcggtgttctctttaatcagatggaagtcttcataaagccgcagtagaacttgagctgaaaacccagatggtgttaactggccgccccactttccggcataactttttagaaaacagaaatgcccttgatggtggaaaaaagaaaacaaccacccccccactgcccaaaaaaaaaagccctgccctgttgctcgtgggtgctgtgtttactctcccgtgtgccttcgcgtccgggttgggagcttgctgtgtctaacctccaactgctgtgctgtctgctagggtcacctcctgtttgtgaaaggggaccttcttgttcgggggtgggaagtggccaccgtgacctgagaaggaaagaaagatcctctgctgacccctggagcagctctcgagaactacctgttggtattgtccacaagctctcccgagcgccccatcttgtgccatgttttaagtcttcatggatgttctgcatgtcatgcggactaaaactcacccaacagatctttccagaggtccatggtggaagacgataaccctgtgaaatactttataaaatgtcttaatgttc

SEQ ID NO: 55292 - DNA, 2501 bp, Homo sapiens
cgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataatgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatataaaaaaaaaaaaaaaaaaaaaaaaaaaaaaaaaaaaaaaaaaaaaaaaaaaaaaaaaaaaaaa

SEQ ID NO: 55293 - DNA, 1147 bp, Homo sapiens
accaaatcaaccataggtccaagaacaattgtctctggacggcagctatgcgactcaccgtgctgtgtgctgtgtgcctgctgcctggcagcctggccctgccgctgcctcaggaggcgggaggcatgagtgagctacagtgggaacaggctcaggactatctcaagagattttatctctatgactcagaaacaaaaaatgccaacagtttagaagccaaactcaaggagatgcaaaaattctttggcctacctataactggaatgttaaactcccgcgtcatagaaataatgcagaagcccagatgtggagtgccagatgttgcagaatactcactatttccaaatagcccaaaatggacttccaaagtggtcacctacaggatcgtatcatatactcgagacttaccgcatattacagtggatcgattagtgtcaaaggctttaaacatgtggggcaaagagatccccctgcatttcaggaaagttgtatggggaactgctgacatcatgattggctttgcgcgaggagctcatggggactcctacccatttgatgggccaggaaacacgctggctcatgcctttgcgcctgggacaggtctcggaggagatgctcacttcgatgaggatgaacgctggacggatggtagcagtctagggattaacttcctgtatgctgcaactcatgaacttggccattctttgggtatgggacattcctctgatcctaatgcagtgatgtatccaacctatggaaatggagatccccaaaattttaaactttcccaggatgatattaaaggcattcagaaactatatggaaagagaagtaattcaagaaagaaatagaaacttcaggcagaacatccattcattcattcattggattgtatatcattgttgcacaatcagaattgataagcactgttcctccactccatttagcaattatgtcacccttttttattgcagttggtttttgaatgtctttcactccttttaaggataaactcctttatggtgtgactgtgtcttattcatctatacttgcagtgggtagatgtcaataaatgttacatacacaaataaataaaatgtttattccatggtaaatttaaaaaaaaaaaaaaaaaaaaaaaaaaaaa

SEQ ID NO: 55294 - DNA, 2305 bp, Homo sapiens
gttactgtcccgcgaacccacatccctacaaagcaggaaagtatgcttgggagaggccaagtgagtggggaatcagcccaaagccaggcgtccagggtctccctcacctgaagctgactttttccccaccttggacagagggcgggagatgccatccccactgaacccagtgctttcaccagccatattagctcccactcaccccccgtcgtggaagcctcggccgtcacacctgcagggccggggcgtgcatggcctcagggatggcctgttcagctgctgggtgactcgggtccaggtgcctcaccacctgctgagctctgtgtgatttctggacacttctgctcgttgcctttgggctcagtgaagagtctggagtttatctggagtgaggtggccggttcttggtgggatctgagcaggacagcgtctggctccttccctcggctcatggccctcagaatctgcgtcacatacaccccagctctcccgataggtctctgcactcgctgttgcctctgcctggaacagtctccctcctggtgtcattgtctccgtggtgtgtccttcctgaccttccacctccaccagtctgtcccccttggggacagggactcgttgctcatgttcacccggcaggctggacacttcgtggagggctccaaagccggcagatcccggggccgcctctgtctctcccaggccctgcgtgttgcggtgagaggagcatttgtgtctctgtggtttgctgctggagctggtgaccgggagagaaacaagggagacaagggtgcccagacaggtgcggggctcagccaggaggcagaagacgtggacgtgtcccgggccaggagggtcacagatgcaccacaaggcactctgtgtggcactgggaacaggaattctgggagtcagtctgcaagggtggtgggcgttgctcacctgggagaagcctttagagtgggcgttgagcaggccattagctcgtgccctgaggaggtgcatgggcggcatgggctctccatggaaattatgtgggcgcgaatggatgtggctctgcgctcacctgggcgaggacttctggccggtgccggggcactctgcatgaccctggcagaatcgagctgccctgactatgaaaggggaagaagagcatgcctgaccctccaccggcaccccacccctcactgctccacctggggcctgcctctgcgggtggctgggtcctggctgactgttgtgactgttgaggccctgggggggtggcgcatgggagttaggaggactggccaggtggggcccactatgcacccacccccagtgtcaggtgcttctcctctcctcctccaccacctcctcctcctcctcctcatcatcatcctcacttgttgaggacgtcctgtgtgccaagtggtttatatgcccagcctcatttaatcctcagaatgactccatgaggtagctactaaaaccccccacttaacagatgaggaaactgaggcctagagaagctcaacaagttgcctaagttccaagtttcctctcccaactctcctaccctctcctcttccttctcctttctcccattcttccctgcctcttccctaactagacaattttttattgagtgtctcccaggtgcaggcatgagccaggtgctgggaaaatcatgataacccagctccttctggtcattttctcagctggttagaggctgggaggacacgcaagttcagctccagccgactggggcattggtggtagcccctggagacattgtgcaatggggctacgaggctgcatctggctccagggaagcgtgttgcaatccatgagtgatgtctgccatgcgtacaggcatggagagtgaggcgcctgtactgtctttctgtagaccctagactggtggggcctctgaaatgcatccagacactgtgctgggtgtgttgcatggccctcccaaccaattcagtatttttctccccattttccagggagaaatctaaggcgtcagaatgtaaggttcttattggaacccaggctccagggtccctggttttctgtgacatcatgctgcaggaccctgtttctctctttgctttggctgctggggagctcagaagggagctttaggcttgctctcagtcaccacattagctcaggggtttgggcatttttgtcgccgtctcctttgggctctgtctcctccctgctgtgcttcctgaggagcaggccggatgtaagttatcaactataaataaaaccaagacttccgttctggctctcaaaaaaaaaaaaaaaaaaa

SEQ ID NO: 55295 - DNA, 1936 bp, Homo sapiens
tctggagccaagtaatggtgatactgatgcttccttttctttgccgcgctcggattctgagtttcacaagaatgtacctgggtgccccttagcgggatatgaatagcttcttcggaaccccagcggccagctggtgcctcctggaaagtgacgtctcatctgcaccggacaaggaggcggggagggagcgcagagcactcagcgtccagcagcgcggcgggccagcctggagcggaagcctggagtggagcaggcagtccgcgggggacagacgtcggctgggattgagccggcagactgcgaaaagtagctggagccggagcagggacagaacctgttgctgcagacgggcttggtggattctggttcctgccgccgacagggctcgccgggagaggttcatcatgaatgagaaatgggacacaaactcttcagaaaactggcatcccatctggaatgtcaatgacacaaagcatcatctgtactcagatattaatattacctatgtgaactactatcttcaccagcctcaagtggcagcaatcttcattatttcctactttctgatcttctttttgtgcatgatgggaaatactgtggtttgctttattgtaatgaggaacaaacatatgcacacagtcactaatctcttcatcttaaacctggccataagtgatttactagttggcatattctgcatgcctataacactgctggacaatattatagcaggatggccatttggaaacacgatgtgcaagatcagtggattggtccagggaatatctgtcgcagcttcagtctttacgttagttgcaattgctgtagataggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaaaaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttataccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaaaaagagctagtgtgataatcctaactctactacgcattatatatttaaatccattgctttttgtggctttgcacttcaaatttttcaaagaatgttctaaataaaacatttactgaaagccctctctggcaaaaaaattaaaaataaacaaaaatggtcataagatcataaacaatcttatgttgtataaaaatacgtagagtgacttagacatgtttgcatgaataaatatatttctagagaacagttaaaaaaaaaaaaaaaaaaaa

SEQ ID NO: 55296 - DNA, 1560 bp, Homo sapiens
tgcctctgcccacctcttctcttctgcttccatattacaggttcatcatgaatgagaaatgggacacaaactcttcagaaaactggcatcccatctggaatgtcaatgacacaaagcatcatctgtactcagatattaatattacctatgtgaactactatcttcaccagcctcaagtggcagcaatcttcattatttcctactttctgatcttctttttgtgcatgatgggaaatactgtggtttgctttattgtaatgaggaacaaacatatgcacacagtcactaatctcttcatcttaaacctggccataagtgatttactagttggcatattctgcatgcctataacactgctggacaatattatagcaggatggccatttggaaacacgatgtgcaagatcagtggattggtccagggaatatctgtcgcagcttcagtctttacgttagttgcaattgctgtagataggttccagtgtgtggtctacccttttaaaccaaagctcactatcaagacagcgtttgtcattattatgatcatctgggtcctagccatcaccattatgtctccatctgcagtaatgttacatgtgcaagaagaaaaatattaccgagtgagactcaactcccagaataaaaccagtccagtctactggtgccgggaagactggccaaatcaggaaatgaggaagatctacaccactgtgctgtttgccaacatctacctggctcccctctccctcattgtcatcatgtatggaaggattggaatttcactcttcagggctgcagttcctcacacaggcaggaagaaccaggagcagtggcacgtggtgtccaggaagaagcagaagatcattaagatgctcctgattgtggccctgctttttattctctcatggctgcccctgtggactctaatgatgctctcagactacgctgacctttctccaaatgaactgcagatcatcaacatctacatctacccttttgcacactggctggcattcggcaacagcagtgtcaatcccatcatttatggtttcttcaacgagaatttccgccgtggtttccaagaagctttccagctccagctctgccaaaaaagagcaaagcctatggaagcttatgccctaaaagctaaaagccatgtgctcataaacacatctaatcagcttgtccaggaatctacatttcaaaaccctcatggggaaaccttgctttataggaaaagtgctgaaaaaccccaacaggaattagtgatggaagaattaaaagaaactactaacagcagtgagatttaaaaagagctagtgtgataatcctaactctactacgcattatatatttaaatccattgctttttgtggctttgcacttcaaatttttcaaagaatgttctaaataaaacatttactgaaagccctctctggcaaaaaaattaaaaataaacaaaaatggtcataagatcataaacaatcttatgttgtataaaaatacgtagagtgacttagacatgtttgcatgaataaatatatttctagagaacagtta

SEQ ID NO: 55297 - DNA, 1853 bp, Homo sapiens
cacagggactgcgctcccttgcccctagcgctcccgcgctgctgctccagccgcccggcagctctgaggatggagaggagggcgcggagctcctccagggagtcccgcgggcgaggcggcaggactccgcacaaggagaacaagagggcaaaggccgagaggagcggcgggggccgcgggcgccaggaggctgggcccgagccgtcgggctccggacgggcggggaccccgggggagccccgagcgcccgccgccacggtggtggacgtggatgaggtccgaggctccggcgaggagggcaccgaggtggtggcgctgttggagagcgagcggcccgaggaaggtaccaaatcctccggcttaggggcctgtgagtggcttcttgtcctcatttccctgctcttcatcatcatgaccttccctttttccatctggttctgcgtaaaggttgtacaagagtatgaaagagtaattatattccgactgggacatctgcttcctggaagagccaaaggccctggtcttttcttttttttgccctgcctggatacctaccacaaggttgaccttcgtctccaaactctggagataccttttcatgagatcgtgaccaaagacatgtttataatggagatagatgccatttgctactaccgaatggaaaatgcctctcttctcctaagcagtcttgctcatgtatctaaagctgtgcaattccttgtgcaaaccactatgaagcgtctcctagcacatcgatccctcactgaaattcttctagagaggaagagcatcgcccaagatgcaaaggttgccttggattcagtgacctgtatttggggaatcaaagtggagagaatagaaattaaagatgtgaggttgccagctgggcttcagcactcactggctgtggaggctgaagcgcaaagacaagccaaagtgcggatgattgctgcagaagcggaaaaggctgcttctgagtccctgaggatggcagctgagattctgtcaggcacccctgctgctgttcagcttcgatacctccacacccttcagtctctgtccacagagaagccttccactgtggttttacctttgccatttgacctactgaattgcctgtcttctcccagcaacagaactcagggaagcctccccttcccaagtccttccaaacctgttgagccactaaatcctaaaaagaaagactctcccatgttataggaaggatggggcataatgtgactgtaaaggggcctgccatagaaaagtcacatccctgagggagacactctgtcctcattccctgcccttcctttggttgccatatggaatggccatggaatgcacgaagtcacaatgcaccatccatgagaagacagtgaaatgatgtaatgacagagaaggcagacaacatgtttccgtgactcatctagtcagagcaattatgggaaacagctttggtcaacattctactttggaaagaattttgagtctagatgtggttaaattttgacttctgggaacttggttcagatgtccctttcactgtatgtcctctgacccctttggcaaggttgccacagctcccacagcccttcctacaagcacctatcattgggcttgtcacactctattgctcttctgtcccgaagatgcagtcttctctccaatgatactaccaagtcttagttttcctcaaccacactcaatctttttgctccaccctgaattcctcacacctaaccctgatagttacctaaagtgacacttaaatgtttcagagtgaatgcaaaaaagagagatgtacttggagtcggatatacaatttatccctaattaaagcatttaaaagg

SEQ ID NO: 55298 - DNA, 3015 bp, Homo sapiens
tgcagccggagcagcaccagcaacagcaacagcgagcgggacggagttaggaccgctcggagcgcacaggtctcgagggtgttggtgccagaagaaaagaatgattgatgggaaacagacaccgggctatagacactcatccttttgcttcagatactgatatctcagcctgcttgagcatcccttgtgagctgtgaacattgaggatcactcagggttatcggatgtacaacgggagagccatcgctttgctaaattattatctgcaattggacatcttttacaaaaaccaaactagacctgagtctaatagatatgttctaagacaaagaaaaagctgcaagttgttaacgcctaacacacaagtatgttaggcttccaccaaagtcctcaatatacctgaatacgcacaatatcttaactcttcatatttggttttgggatctgctttgaggtcccatcttcatttaaaaaaaaatacagagacctacctacccgtacgcatacatacatatgtgtatatatatgtaaactagacaaagatcgcagatcataaagcaagctctgctttagtttccaagaagattacaaagaatttagagatgtatttgtcaagattcctgtcgattcatgccctttgggttacggtgtcctcagtgatgcagccctaccctttggtttggggacattatgatttgtgtaagactcagatttacacggaagaagggaaagtttgggattacatggcctgccagccggaatccacggacatgacaaaatatctgaaagtgaaactcgatcctccggatattacctgtggagaccctcctgagacgttctgtgcaatgggcaatccctacatgtgcaataatgagtgtgatgcgagtacccctgagctggcacacccccctgagctgatgtttgattttgaaggaagacatccctccacattttggcagtctgccacttggaaggagtatcccaagcctctccaggttaacatcactctgtcttggagcaaaaccattgagctaacagacaacatagttattacctttgaatctgggcgtccagaccaaatgatcctggagaagtctctcgattatggacgaacatggcagccctatcagtattatgccacagactgcttagatgcttttcacatggatcctaaatccgtgaaggatttatcacagcatacggtcttagaaatcatttgcacagaagagtactcaacagggtatacaacaaatagcaaaataatccactttgaaatcaaagacaggttcgcgttttttgctggacctcgcctacgcaatatggcttccctctacggacagctggatacaaccaagaaactcagagatttctttacagtcacagacctgaggataaggctgttaagaccagccgttggggaaatatttgtagatgagctacacttggcacgctacttttacgcgatctcagacataaaggtgcgaggaaggtgcaagtgtaatctccatgccactgtatgtgtgtatgacaacagcaaattgacatgcgaatgtgagcacaacactacaggtccagactgtgggaaatgcaagaagaattatcagggccgaccttggagtccaggctcctatctccccatccccaaaggcactgcaaatacctgtatccccagtatttccagtattggtacgaatgtctgcgacaacgagctcctgcactgccagaacggagggacgtgccacaacaacgtgcgctgcctgtgcccggccgcatacacgggcatcctctgcgagaagctgcggtgcgaggaggctggcagctgcggctccgactctggccagggcgcgcccccgcacggctccccagcgctgctgctgctgaccacgctgctgggaaccgccagccccctggtgttctaggtgtcacctccagccacaccggacgggcctgtgccgtggggaagcagacacaacccaaacatttgctactaacataggaaacacacacatacagacacccccactcagacagtgtacaaactaagaaggcctaactgaactaagccatatttatcacccgtggacagcacatccgagtcaagactgttaatttctgactccagaggagttggcagctgttgatattatcactgcaaatcacattgccagctgcagagcatattgtggattggaaaggctgcgacagccccccaaacaggaaagacaaaaaacaaacaaatcaaccgacctaaaaacattggctactctagcgtggtgcgccctagtacgactccgcccagtgtgtggaccaaccaaatagcattctttgctgtcaggtgcattgtgggcataaggaaatctgttacaagctgccatattggcctgcttccgtccctgaatcccttccaacctgtgctttagtgaacgttgctctgtaacccttgttggttgaaagatttctttgtctgatgttagtgatgcacatgtgtaacagccccctctaaaagcgcaagccagtcatacccctgtatatcttagcagcactgagtccagtgcgagcacacacccactatacaagagtggctataggaaaaaagaaagtgtatctatccttttgtattcaaatgaagttatttttcttgaactactgtaatatgtagattttttgtattattgccaatttgtgttaccagacaatctgttaatgtatctaattcgaatcagcaaagactgacattttattttgtcctctttcgttctgttttgtttcactgtgcagagatttctctgtaagggcaacgaacgtgctggcatcaaagaatatcagtttacatatataacaagtgtaataagattccaccaaaggacattctaaatgttttcttgttgctttaacactggaagatttaaagaataaaaactcctgcataaacaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 55299 - DNA, 2716 bp, Homo sapiens
agtgtgcgaggcagcgtgaagctggggcctgctccccgcagcctctggagcgcatcacagaccttctgagacctatgttgctggccccccagaacccgcaacatggcagatggggcaaaggccaaccccaaagggttcaaaaagtaggtgctggatagatgcttctctgggtggaggggcccacgcttcggggcctcctgtccttcaagaacctccaggtctagcctgggtatgaagaagttcttcaccgtggccatccttgctggcagcgttctgtccacagctcacggcagcctgctcaacctgaaggccatggtggaggccgtcacagggaggagcgccatcctgtccttcgtgggctacggttgctactgtgggctggggggccgtggccagcccaaggatgaggtggactggtgctgccacgcccacgactgctgctaccaggaactctttgaccaaggctgtcacccctatgtggaccactatgatcacaccatcgagaacaacactgagatagtctgcagtgacctcaacaagacagagtgtgacaagcagacatgcatgtgtgacaagaacatggttctgtgcctcatgaaccagacgtaccgagaggagtaccgtggcttcctcaatgtctactgccagggccccacgcccaactgcagcatctatggaccgccccctgaggaggtcacctgcagtcaccaatccccagcgccccccgcccctccctagagcctctgaggtttgagagagagagcgggaggagggtctggcttggggaccagacgaggtgcagggagggtaggagccaggccaggagcctgagggttgctggttgcctcctccctggagctctccagtgagggctcagctctcagaggactcaggaaggcctgggtcctgactcccccagcccagccccaggcatgggtgcctcctgctgctggttctggactgggtgggaggcacggagcttataggggtctctcctgagggtggccggggagacctgagagagaggaggaggggcctctgagtggggcctctgttgctggcgccagtttaactccccggagccttagaaagtctgagccttagaaagtctgggcctgagcatccaggcccagagctggatgcatcctcggcccaagatcacaggaaggcagattgctggtcacaaagcatgggttccgggagcccctcagctgatcccacaggatggcctggggtggtggctactttgggcttgaagctctctagagccccattcacagagcaggtgccccaccccagccctcactgaggtggccatgagtccaggttcagaccctaggggatgtgcagtgctgagtgtcccagccctgaagtctagcctcagagcaggctcctgggcactgacagagccacacacccaggtacaccccccaggctaatatggggacacacaaaaatatggccttcaacacctacaagtcttctctgtgtcccccatcgacccatgcacatcaccccaaccctgctctgccacaccacgtgggtctgaggagcactcctaccccccggctccgggtccctgacagacactgccctcctggcctgcacctggaatggcagccagaacactggagggggacccacaccctctctccctgggctgtggatgggtgttgcaagtcccatccctcctggcctgcacctggaacagcagccagaacaccggagggggacccacaccctctctccctgggctgtgggcaggcgtcacaagtcccattggtggggaagaggctgagggctgagacccacctcagtgaagagggaaacgtaagcagggagagcatcaaggcgggaggcagcctggaaacttctagaagagggtcaaggtaggaggctacatggaagcttctagaaggcagtaaggaacagggtggtgaaggagaggggagaagatgggagcatggagagacgaggtgagtgacagccaccagcagggacgggcctccaggcaacacagaggagctgggggccagggccttacggggctgggttcctgtgtggggcgtggagctggggctgaagtggaggggacggccctgcggcccccagcactgttgtttctccaggtgcaccttaccttcctccttacctgcccgagcctcaactcagggtcagcagcctccacggagccagccccacctgcccgaaaaccactgaagccaccctccgcctggactcaacagccgccagcaagctcgcctggcagtgcccctggagcaccattgtcgctggggagggagagccgggaagggtggagaaggaggcagaagggacatgtatgaaaaaaggacaggaaacctgaccagaggcggtttccagagccccagccttggagacaaggacactgccacccagcgccacagtcagtctgggaggggcccacgccccccaccccccatgccacactgccgcctcttgctggccatggttctccggcttgggggaacgcaggttcccagctgcgcccctcccccgcgcacacacaccctcccctgtccctcggaaagactaggccagggtctggggatgggattctgctgccaggggtcctgcctgcccccactcaccccagacgcttcggatgctgcagctcctggataatctccacaggactcggcttcctctcctcaaatgaataaaggcctcctacctc

SEQ ID NO: 55300 - DNA, 5546 bp, Homo sapiens
aggaaaagacaatttctctctgattcagaatcctgaaaatgtgatctcccttaaaaagaggacagtgctgctgtgagtttgacgaagtggacatcacctgcagtcagtccagagctgcccagtcttgaatataatcatggccaaaccttatgaatttaactggcagaaggaagttccctcctttttgcaagaaggaacagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcagcttttgaaatcctgtcatgcagtgtcccaaacgcaaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttcaaaaaaaaaaaaaaaaaaaaa

SEQ ID NO: 55301 - DNA, 5509 bp, Homo sapiens
aggaaaagacaatttctctctgattcagaatcctgaaaatgtgatctcccttaaaaagaggacagtgctgctgtgagtttgacgaagtggacatcacctgcagtcagtccagagctgcccagtcttgaatataatcatggccaaaccttatgaatttaactggcagaaggaagttccctcctttttgcaagaaggaacagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttcaaaaaaaaaaaaaaaaaaaaa

SEQ ID NO: 55302 - DNA, 1461 bp, Homo sapiens
agaacctcagtggatctcagagagagccccagactgagggaagcatggatggatggagaaggatgcctcgctggggactgctgctgctgctctggggctcctgtacctttggtctcccgacagacaccaccacctttaaacggatcttcctcaagagaatgccctcaatccgagaaagcctgaaggaacgaggtgtggacatggccaggcttggtcccgagtggagccaacccatgaagaggctgacacttggcaacaccacctcctccgtgatcctcaccaactacatggacacccagtactatggcgagattgggatcgggaccccaccccaaaccttcaaagtcgtctttgacactggttcgtccaatgtttgggtgccctcctccaagtgcagccgtctctacactgcctgtgtgtatcacaagctcttcgatgcttcggattcctccagctacaagcacaatggaacagaactcaccctccgctattcaacagggacagtcagtggctttctcagccaggacatcatcaccgtgggtggaatcacggtgacacagatgtttggagaggtcacggagatgcccgccttacccttcatgctggccgagtttgatggggttgtgggcatgggcttcattgaacaggccattggcagggtcacccctatcttcgacaacatcatctcccaaggggtgctaaaagaggacgtcttctctttctactacaacagagattccgagaattcccaatcgctgggaggacagattgtgctgggaggcagcgacccccagcattacgaagggaatttccactatatcaacctcatcaagactggtgtctggcagattcaaatgaagggggtgtctgtggggtcatccaccttgctctgtgaagacggctgcctggcattggtagacaccggtgcatcctacatctcaggttctaccagctccatagagaagctcatggaggccttgggagccaagaagaggctgtttgattatgtcgtgaagtgtaacgagggccctacactccccgacatctctttccacctgggaggcaaagaatacacgctcaccagcgcggactatgtatttcaggaatcctacagtagtaaaaagctgtgcacactggccatccacgccatggatatcccgccacccactggacccacctgggccctgggggccaccttcatccgaaagttctacacagagtttgatcggcgtaacaaccgcattggcttcgccttggcccgctgaggccctctgccacccaggcaggccctgccttcagccctggcccagagctggaacactctctgagatgcccctctgcctgggcttatgccctcagatggagacattggatgtggagctcctgctggatgcgtgccctgacccctgcaccagcccttccctgctttgaggacaaagagaataaagacttcatgttcac

SEQ ID NO: 55303 - DNA, 2451 bp, Homo sapiens
ctcttggctccgctagtgcccggcgcgccgccgccagtgctgcgggctccgggcaatggatgcccccggggccctggcccagaccgccgcccccggtccgggcaggaaggagctgaagatcgtgatcgtgggcgacggcggctgcggcaagacctcgctgctcatggtgtacagccagggctccttccccgagcactacgccccatcggtgttcgagaagtacacggccagcgtgaccgttggcagcaaggaggtgaccctgaacctctacgacacggccgggcaagaagactatgaccggctgcggcccctgtcctaccagaacacccacctcgtgctcatctgctatgacgtcatgaatcccaccagctacgacaacgtcctcatcaagtggttccctgaggtcacgcatttctgccgcgggatccccatggtgctcatcggctgcaagacagacctgaggaaggacaaggagcagctgcggaagctccgggccgcccagctggagcccatcacctacatgcagggcctgagcgcctgcgaacagatccgagctgctctctacctggaatgttccgccaagtttcgggagaatgtggaggacgtcttccgggaggccgccaaggtggctctcagcgctctgaagaaggcgcaacggcagaagaagcgccggctctgcctgctgctctgacccagggcagacagacctcacgacagcactgacagggcccgggggcccaggtgccgattgcaccagggaggctgccccatcccgaccctccagctcatggtgtctggggcctgcggctagactcttggaacattctggaactctctcctttcctggctggggctctgaccacaaactcccctccaggctgcccctgggacatggtggtgatgtgggtgcaggagccagtgtctgttgtcgggactcgcaagtgccctcatcacagccacccccaccacgagtgtctccccagtgcagactcaagttatgcttgaaatgaaaaagtctatctggtagtgggtaaacgtagacctggcactgttccacgcgggcgccccaagcctgccactcctgtgtccctgcctccctgggctcccgagataggcaccactgtatcctccagctccttccttccttcccccaggaacacggaggccaccgagggggctgggcctatcaggaggacacaggctgcagcctggcacccacccctcccatctccaccccacatggaagacttgtcttcaacttggccactgtctttgcagagctgggcacatgtgcccagggggcagaaaaaatggcttctcagttgttaaaagtataccctggaccacccatctgaccatctccttaaggtttcacccaaagcccccagtgtcagagacttgggatgggaagaacagtcggctcccagtgtggtcatgagcaagttttctgtggactgttccccccactgtggtaggacaggactggcccacttagtcctcaagctcccaacctgctgtccctcaagccccgcttctaccagcctgtggagttcaggaggcgagacatcctggcctcctttgagaactgatgggatctaccccctgtccacgcgggacagtttctcagaactggttcatagaccacctgtgtcaccaacagccagatacctaatccctgagcctcctttgggaaggtctggggccgagggtctgggaatttttttttttttttttttttgggacagagtctcattctgtcactcaggctagagtgcagtggcatgatcttggctcactgcaagctccacctcctgggttcaagcgattctcttgcctcagcctcctgagtagctgggactacatgcgcacaccaccacgtccggctaatttttgtatttttagtagagacagggtttcaccatgttggccaggctggtcttgaactcctgacctcgtgatccacccgccttagcctcccaaagtgctgggattacaggcgtgagccaccgtgcccggcccaggacttttaaaacaagcatcccaggggattccggtgcctaccagaagtcgcaagctgcttggctctggagggcgcctaggagtcggtgtcgcctaagatgggataatggcttcaggcaactcctagccttccccatatctcctgcctcagcccccctggcccagtgctggggcgtcagctaaacctgagcttccaagaagtcaggttgccaaaggaaggagccttctgagaccctccccaacccacccaggttcccaaggccctgccgtaccctggggaatcaaccaaggagttcttgttctcgaagaaccccaggcctcatgatggtctacggtagaggtccaacaactacagcctgtgggccacatctggccacagcctgatttgtaaataaagttttattggaacacagcaaaaaaaaaaaaaaaaaa

SEQ ID NO: 55304 - DNA, 3947 bp, Homo sapiens
ccgcagccgcccgggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaatggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaaagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcaaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaaaggtaaactggcatatccagggcaaatgtgggctgccaatggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaaggcataaaccagacctgtcccaggccgatgtggaaatatgttctttctagttgtgggtaccctgatctaggtggtttgtaattgtgcattactgactgcatatgtttgtgtatgtgtaaatgtgggctccctgttaagtggggctcatggatacgaggcctgaggaagtgtggcttgctagtctgttacgttaacatgcttttctaaaattgcttcacgtgttaattcatttactcctgcattcattgactgtttttgttcttttccattcactttgtacttatttttttcattaaattttgcatttattttgaaaaaaatacagatctaag

SEQ ID NO: 55305 - DNA, 3947 bp, Homo sapiens
ccgcagccgcccgggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaaagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcaaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaaaggtaaactggcatatccagggcaaatgtgggctgccaatggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaaggcataaaccagacctgtcccaggccgatgtggaaatatgttctttctagttgtgggtaccctgatctaggtggtttgtaattgtgcattactgactgcatatgtttgtgtatgtgtaaatgtgggctccctgttaagtggggctcatggatacgaggcctgaggaagtgtggcttgctagtctgttacgttaacatgcttttctaaaattgcttcacgtgttaattcatttactcctgcattcattgactgtttttgttcttttccattcactttgtacttatttttttcattaaattttgcatttattttgaaaaaaatacagatctaag

SEQ ID NO: 55306 - DNA, 2146 bp, Homo sapiens
atgggttcagactttatgccctgaaaagatccttccagccctggccatcttggacttctggagctaccctggctcacaggggtcttgttgccctgggtgtccccagttcttgaaaagaatcagcctgggaggggccacaccctgaccatccccctttatcccttctgagatgtttgttaggaagtctgggtccaggggatatcatttcttgttccatccatgcaggggttgcttacctcgggtaggaaaccctcaggcggtggcaggtgcacaggtaggggaggatggagagggcagtggtgcctgaagccctggatgggcggagctgaccccccaacaccaactctctcatgcctgctcctccctgtccccccagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaatgtgtaaaatgacagagatgtaacaagctcatagggtatcaatatctcttattgttctatgttgaaaaaaaaaaaaaaaaaaaaaaaaaaa

SEQ ID NO: 55307 - DNA, 1862 bp, Homo sapiens
gcttgacaagtcaggattgtgcctccagtcagaaggaccatgaagagagagaagagggcagagccgtgcatggggctgctccccaggacctgagcaggaacctggagttttcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaatgtgtaaaatgacagagatgtaacaagctcatagggtatcaatatctcttattgttctatgttgaaaaa

SEQ ID NO: 55308 - DNA, 2545 bp, Homo sapiens
atctgcctgactttcacttttggtgctggagaactcagaaggtggctcagccctctggtccacacttggtgggcagctcggatgccccaggcagcccgggcacagtgagcttagtccccttcaccccctccgcagagctctggggcatccgcacagtcactcctggacacaagataaggaggagtttccccgaggcatcacagggcttcccgggactgagggactgactcaactggttattggacagtgccccacccccaatccggctgaggggcaggaaggcagaaggtcttggtggccctggatcttgtggctgcaatcggttccaaacagcagttaggtcagcagtccgctcagccgaggcagctctgttcatggcgttctcgaagctcttggagcaagccggaggcgtgggcctcttccagaccctgcaggtgctcaccttcatcctcccctgcctcatgataccttcccagatgctcctggagaacttctcagccgccatcccaggccaccgatgctggacacacatgctggacaatggctctgcggtttccacaaacatgacccccaaggcccttctgaccatctccatcccgccaggccccaaccaggggccccaccagtgccgccgcttccgccagccacagtggcagctcttggaccccaatgccacggccaccagctggagcgaagctgacacggagccgtgtgtggacggctgggtctatgaccgcagcgtcttcacctccaccatcgtggccaagtgggacctggtgtgcagctcccagggcttgaagcccctaagccagtccatcttcatgtccgggatcctggtgggctcctttatctggggcctcctctcctaccggtttgggaggaagccgatgctgagctggtgctgcctgcagttggccgtggcgggcaccagcaccatcttcgccccaacattcgtcatctactgcggcctgcggttcgtggccgcttttgggatggccggcatctttctgagttcactgacactgatggtggagtggaccacgaccagcaggagggcggtcaccatgacggtggtgggatgtgccttcagcgcaggccaggcggcgctgggcggcctggcctttgccctgcgggactggaggactctccagctggcagcatcagtgcccttctttgccatctccctgatatcctggtggctgccagaatccgcccggtggctgattattaagggcaaaccagaccaagcacttcaggagctcagaaaggtggccaggataaatggccacaaggaggccaagaacctgaccatagaggtgctgatgtccagcgtgaaggaggaggtggcctctgcaaaggagccgcggtcggtgctggacctgttctgcgtgcccgtgctccgctggaggagctgcgccatgctggtggtgaatttctctctattgatctcctactatgggctggtcttcgacctgcagagcctgggccgtgacatcttcctcctccaggccctcttcggggccgtggacttcctgggccgggccaccactgccctcttgctcagtttccttggccgccgcaccatccaggcgggttcccaggccatggccggcctcgccattctagccaacatgctggtgccgcaagatttgcagaccctgcgtgtggtctttgctgtgctgggaaagggatgttttgggataagcctaacctgcctcaccatctacaaggctgaactctttccaacgccagtgcggatgacagcagatggcattctgcatacagtgggccggctgggggctatgatgggtcccctgatcctgatgagccgccaagccctgcccctgctgcctcctctcctctatggcgttatctccattgcttccagcctggttgtgctgttcttcctcccggagacccagggacttccgctccctgacactatccaggacctggagagccagaaatcaacagcagcccagggcaaccggcaagaggccgtcactgtggaaagtacctcgctctagaaattgtgcctgcatggagcccctttagtcaaagactcctggaaaggagttgcctcttctccaatcagagcgtggaggcgagttgggcgacttcaagggcctggcatggcagaggccaggcagccgtggccgagtggacagcgtggccgtctgctgtggctgaaggcagcttccacagctcactcctcttctccctgccctgatcagattccccaccttacccgggccctacaggagcctgtgcagatggccatgcccaaccaataacgagacggttcccctccctttccctgccaggctcatgtctttacaccttcactcagccacgccaaccagagactgggttccaatctcaccccaccacatacagagccctcatctgtgaaatgagaatgatcacgtgacccaccccccagggcaggtatcagggtgaactgatcttagcaccggccaaataaatggaacctgctgagagagctgccagaaaaaaaaaaaaaaaaaaaaaaaaaaaaaaaaaa

SEQ ID NO: 55309 - DNA, 2207 bp, Homo sapiens
agcttgttagagctgagctgccctactacagcagctgccggcccctaggacagagcagggacctcaactacactgatcaccagccccatcggatccagacccggccaccagctctggctcgtcttgccccagtgccatgaccttctcggagatcctggaccgtgtgggaagcatgggccatttccagttcctgcatgtagccatactgggcctcccgatcctcaacatggccaaccacaacctgctgcagatcttcacagccgccacccctgtccaccactgtcgcccgccccacaatgcctccacagggccttgggtgctccccatgggcccaaatgggaagcctgagaggtgcctccgttttgtacatccgcccaatgccagcctgcccaatgacacccagagggccatggagccatgcctggatggctgggtctacaacagcaccaaggactccattgtgacagagtgggacttggtgtgcaactccaacaaactgaaggagatggcccagtctatcttcatggcaggtatactgattggagggctcgtgcttggagacctgtctgacaggtttggccgcaggcccatcctgacctgcagctacctgctgctggcagccagcggctccggtgcagccttcagccccaccttccccatctacatggtcttccgcttcctgtgtggctttggcatctcaggcattaccctgagcaccgtcatcttgaatgtggaatgggtgcctacccggatgcgggccatcatgtcgacagcactcgggtactgctacacctttggccagttcattctgcccggcctggcctacgccatcccccagtggcgttggctgcagttaactgtgtccattcccttcttcgtcttcttcctatcatcctggtggacaccagagtccatacgctggttggtcttgtctggaaagtcctcgaaggccctgaagatactccggcgggtggctgtcttcaatggcaagaaggaagagggagaaaggctcagcttggaggagctcaaactcaacctgcagaaggagatctccttggccaaggccaagtacaccgcaagtgacctgttccggatacccatgctgcgccgcatgaccttctgtctttccctggcctggtttgctaccggttttgcctactatagtttggctatgggtgtggaagaatttggagtcaacctctacatcctccagatcatctttggtggggtcgatgtcccagccaagttcatcaccatcctctccttaagctacctgggccggcataccactcaggccgctgccctgctcctggcaggaggggccatcttggctctcacctttgtgcccttggacttgcagaccgtgaggacagtattggctgtgtttgggaagggatgcctatccagctccttcagctgcctcttcctctacacaagtgaattataccccacagtcatcaggcaaacaggtatgggcgtaagtaacctgtggacccgcgtgggaagcatggtgtccccgctggtgaaaatcacgggtgaggtacagcccttcatccccaatatcatctacgggatcaccgccctcctcgggggcagtgctgccctcttcctgcctgagaccctgaatcagcccttgccagagactatcgaagacctggaaaactggtccctgcgggcaaagaagccaaagcaggagccagaggtggaaaaggcctcccagaggatccctctacagcctcacggaccaggcctgggctccagctgaggacaacggaaccccctttccctgccctccagagactgatcctagccaggcaccttaggagtatagggaggccccatataggtccatcctcctaggatgaagccttctgagagcttggtgaaggtgtctccatcaccaccaccagagcctcctgcccagccctggccagttcaaaggttcagccatccctgcccttgttctccctgcaacccaggccctgccattcttctgtctagcccttccccactggccaccttcccccactgtcccggtcctcttcccctgaggtcccctgatatcccctggctcagtcctaacaagactgagtcttaacaagatgagaagtcctccccttcttgcctcccacacttttctttgatgggaggtttcaataaacagcgataagaactctaaaaaaaaaaaaaaaaaaaaaaaaaaaaaa

SEQ ID NO: 55310 - DNA, 2677 bp, Homo sapiens
ctgctgagcagaagctgaaacacagaattctaagcgttgctgagacccactgacctgcagacctcatagtgggtgcccaggatgttgtcctacggagagaggctggggtcccctgctgtctccccactcccagtccgtggggggcatgtgatgcgagggacggcctttgcctacgtgcccagccctcaggtcctacacaggatcccggggacctctgcctatgccttccccagcctgggccctgtggcccttgctgagcacacctgcccctgtggggaggtcctggagcgccatgaaccactgcctgccaagctggccctggaggaggagcagaagccagagtccaggctggtccccaagctgcgccaggctggcgccatgctgctcaaggtgccactgatgctcaccttcctctacctcttcgtctgctccctggacatgctcagctcggccttccagctggctggagggaaggtggctggtgacatcttcaaggataacgccatcctgtccaacccggtggccgggctggtggtggggatcctggtgaccgtgctggtgcagagctccagcacctccacatccatcatcgtcagcatggtctcctctggcttgctggaggtgagctctgccatccccatcatcatgggctccaacatcggcacctctgtcaccaacaccatcgtggccctgatgcaggcgggggacaggactgacttccggcgggccttcgcgggggccacggtgcatgactgctttaactggctgtcagtgctggtcctgctgcccctggaggctgccactggctacctgcaccacatcactcgacttgtggtggcctccttcaacatccatggtggccgtgatgctcctgacctgctcaagatcatcacagagcccttcacgaagctcatcatccagctggacgagtctgtgataaccagcattgccactggtgatgagtccctgaggaaccacagtctcatccagatctggtgccacccagactccttacaggctcccacctccatgtccagagcagaggccaactccagccagacccttggaaatgccaccatggagaaatgcaaccacatctttgtggacactggcctaccggacctggctgtggggctcatcctgctggcaggagccctggtgctgctgtgcacctgcctcatcctcctagtcaagatgctcaactccctgctcaagggccaagtggccaaggtcatccagaaggtcatcaatacggacttccctgcccccttcacctgggtcacaggctactttgccatggtggtgggcgccagcatgaccttcgtggtccagagcagttctgtgttcacctcggccatcaccccactcatcggtcttggtgtgatcagcattgagagggcctacccgctcacactgggttccaacatcggcaccaccaccacggccatcctggctgccctggccagccccagggagaagctgtccagcgctttccagattgccctctgtcacttcttcttcaacatctcgggtatccttctgtggtacccggtgccctgcacacgcctgcccatccgcatggccaaggcgctggggaaacgcacggccaagtaccgctggtttgccgtcctctatctccttgtctgcttcctgctgctgccctcactggtgtttggcatctccatggcaggctggcaggtcatggtaggtgtgggcacgcccttcggggccctgctggccttcgtggtgctcatcaatgtcctgcagagtcggagtcccgggcacctgcccaagtggttacagacatgggacttcctgcctcgctggatgcactccctgaagcccctggaccacctcatcacccgcgccaccctatgctgtgccaggcctgagccccgctcacccccgctgccccccagggtcttcctggaggagctaccccctgccacaccctccccccgtcttgcactgcctgctcaccacaatgccacccgcctctaggctgtgggcccagactacagcctggaatggggaaggcctggggtggaaaggcaggggagggagggtgtgtgtaggtatgtgcatgtgcctgtgccaccctgggtgccagtctctccttctgtagctccgcaaagctctgggcttgtgtgagagtgtcggtgtgtgtgcatgtgtgggggtgagtctgcatgtgcacctgtcatgtgtagaagcttgtatttgtgtacaggtgtgccagcccatgcaggtgtacacagacacacctgtgggaggctgtgtgcaggctgcaggatatctgggtatgatttcaggtcctctgcacgtgtacacatgactaggataggcaggagtaagggtgggtctgggtatatgactgtgcagctgtttgtgcatagatgttggtgcctgcgttactgaatttgcacacctccttgccaccttccttcctccaagataccatctcctcatcctaacccaggtcttcggcaccaccacaattaattcccttcccaacacttgcctgatggaaaaaaaacaaaggaattaaaactctcctcaggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 55311 - DNA, 2273 bp, Homo sapiens
gggggcagatcctggggagaatggaggagcacacagaggcaggctcggcaccagagatgggggcccagaaggccctgattgacaatcctgctgacatcctagtcattgctgcatatttcctgctggtcattggcgttggcttgtggtccatgtgcagaaccaacagaggcactgtgggcggctacttcctggcaggacgcagcatggtgtggtggccggttggggcctctctcttcgccagcaacatcggcagtggccactttgtgggcctggcagggactggcgctgcaagtggcttggctgttgctggattcgagtggaatgcgctcttcgtggtgctgctactgggctggctgtttgcacccgtgtacctgacagcgggggtcatcacgatgccacagtacctgcgcaagcgcttcggcggccgccgcatccgcctctacctgtctgtgctctcccttttcctgtacatcttcaccaagatctcagtggacatgttctccggagctgtattcatccagcaggctctgggctggaacatctatgcctccgtcatcgcgcttctgggcatcaccatgatttacacggtgacaggagggctggccgcgctgatgtacacggacacggtacagaccttcgtcattctggggggcgcctgcatcctcatgggttacgccttccacgaggtgggcgggtattcgggtctcttcgacaaatacctgggagcagcgacttcgctgacggtgtccgaggatccagccgtgggaaacatctccagcttctgctatcgaccccggcccgactcctaccacctgctccggcaccccgtgaccggggatctgccgtggcccgcgctgctcctcggactcacaatcgtctcgggctggtactggtgcagcgaccaggtcatcgtgcagcgctgcctggccgggaagagcctgacccacatcaaggcgggctgcatcctgtgtgggtacctgaagctgacgcccatgtttctcatggtcatgccaggcatgatcagccgcattctgtacccagacgaggtggcgtgcgtggtgcctgaggtgtgcaggcgcgtgtgcggcacggaggtgggctgctccaacatcgcctacccgcggctcgtcgtgaagctcatgcccaacggtctgcgcggactcatgctggcggtcatgctggccgcgctcatgtcctcgctggcctccatcttcaacagcagcagcacgctcttcaccatggacatctacacgcgcctgcggccacgcgccggcgaccgcgagctgctgctggtgggacggctctgggtggtgttcatcgtggtagtgtcggtggcctggcttcccgtggtgcaggcggcacagggcgggcagctcttcgattacatccaggcagtctctagctacctggcaccgcccgtgtccgccgtcttcgtgctggcgctcttcgtgccgcgcgttaatgagcagggcgccttctggggactcatcgggggcctgctgatgggcctggcacgcctgattcccgagttctccttcggctcgggcagctgtgtgcagccctcggcgtgcccagctttcctctgcggcgtgcactacctctacttcgccattgtgctgttcttctgctctggcctcctcaccctcacggtctccctgtgcaccgcgcccatccccagaaagcacctccaccgcctggtcttcagtctccggcatagcaaggaggaacgggaggacctggatgctgatgagcagcaaggctcctcactccctgtacagaatgggtgcccagagagtgccatggagatgaatgagccccaggccccggcaccaagcctcttccgccagtgcctgctctggttttgtggaatgagcagaggtggggtgggcagtcctccgccccttacccaggaggaggcagcggcagcagccaggcggctggaggacatcagcgaggacccgagctgggcccgtgtggtcaacctcaatgccctgctcatgatggcagtggccgtgttcctctggggcttctatgcctaagaccaactgcgttggacaccataagccacagcctcacaggaagtgggggtgaggagcctgcggtgctccccagaaaaggggaaggggcagtggggtgagaaggtcctggctccccttctcccggccttcctctgcctggggcccactgcatctgattggcagtcacttcccatgagggcctggcccacccgctgcagttgccctaaggaaaaataaagctgcctttcccctgta

SEQ ID NO: 55312 - DNA, 4627 bp, Homo sapiens
gagagctgcctgctcagacaacagacacgcgaggtcaggaagaagccgcttataaattaccgcttccttcgcgccgccgccaacgccgagccccgaggaccgcaagcccagaggacaagctgcgccaagagggagtgcggagcgttcacccagcgggtcagagagcgagcgggcaggcagcccccggccggcggaacccggcacagccgagcagagcgcgggcggcgccgcagccaccccagatccagaaccagaaccacagcccttctgaggagctcccaaacaaagcaaggagatggccaccaaggagaagctgcagtgtctgaaagatttccacaaggacatcctgaagccctcaccagggaagagcccaggcacgcggcctgaggacgaggctgagggaaaacctccgcagagggagaagtggtctagcaagatcgactttgtgctctctgtggctggcggcttcgtgggcttgggcaacgtctggcgcttcccgtacctctgctacaagaatggtggaggtgcgtttctcataccgtattttattttcctgtttgggagcggcctgcctgtgtttttcttggagatcatcataggccagtacacctctgaagggggcatcacctgctgggaaaagatctgccccttgttctctggtatcggctatgcctccgttgtaattgtgtccctcctgaatgtctactacatcgtcatcctggcctgggccacatactacctgttccagtccttccagaaggagctgccctgggcacactgcaaccacagctggaacacacctcactgcatggaggacaccatgcgcaagaacaagagtgtctggatcaccatcagctccaccaacttcacctcccctgtcatcgagttctgggagcgcaacgtgctgagcttgtcccctggaatcgaccacccaggctctctgaaatgggacctcgctctctgccttcttttagtctggctagtgtgtttcttctgcatctggaagggcgtcaggtccactgggaaggtcgtctacttcacagccacttttccattcgccatgctcctggtgctgctggtccgagggctgacgctgccgggcgcgggcgcaggcatcaagttctatctgtatcctgacatcacccgccttgaggacccacaggtgtggattgacgctgggactcagatattcttctcttatgccatctgcctgggggctatgacctcgctggggagctacaacaagtacaagtataactcgtacagggactgtatgctgctgggatgcctgaacagtggtaccagttttgtgtctggcttcgcaattttttccatcctgggcttcatggcacaagagcaaggggtggacattgctgatgtggctgagtcaggtcctggcctggccttcattgcctacccaaaagctgtgacaatgatgccgctgcccacattttggtccattcttttttttattatgcttctcttgcttggactggatagccagtttgttgaagttgaaggacagatcacatccttggttgatctttacccatccttcctaaggaagggttatcgtcgggaaatcttcatcgccttcgtgtgtagcatcagctacctgctggggctgacgatggtgacggagggtggcatgtatgtgtttcagctctttgactactatgcagctagcggtgtatgccttttgtgggttgcattctttgaatgttttgttattgcctggatatatggaggtgataacctttatgatggtattgaggacatgattggctatcggcccgggccctggatgaagtacagctgggctgtgatcactccagttctctgtgttggatgtttcatcttctcgctcgtcaagtacgtacccctgacctacaacaaaacatacgtgtaccccaactgggccattgggctgggctggagcctggccctttcctccatgctctgcgttcccttggtcatcgtcatccgcctctgccagactgaggggccgttccttgtgagagtcaagtacctgctgaccccaagggaacccaaccgctgggctgtggagcgcgagggagccacaccttacaactctcgcaccgtcatgaacggcgctctcgtgaaaccgacccacatcattgtggagaccatgatgtgagctctctcgggtcgacggggccggcggctttcctgctgtttactaacattagattctcataggaccaggtttacagagctttatatttgcactaggattttttttttttgtaattgtcacagaaaatgtaattgtgggtatgtgtgcgtgcgtgtgtgtgtgtgtgtgtatcgtgtgtgtgtgttttgttttgatttgggggatattttgtacaaaaagaaaacccacgggaagatgtccgtggagaggcagagctttcatactgaattagatgtattttatgggaatttggtaaatttttctttgtatttttttttttacatataagtatatatacacttagagattgtcatatacttttaccacttgaattgatcttcttgccagcaatagatctcattttcaaaagcaattcttcggtgctgtgtagctggcagaaagttctgtccagtaaacgcaggatggaattttcctgggactctacacccatcttaaggtggtataccttccaaatcctggttcagatggaagaaatagcaggagagaggacccattagctggcagacccagggggaagaaaggagggctgtgaggagatacctcattaaacttggcttagtgaagaagagagatgccaaaggaatgaaccaacccttcacataaaggagactggctgaagctgaatgaggaggccctatagcagaagtctgattctaagagcagtagaaacttgtaccagaagcaaaatcccacttttaattttgagatggtgagtggatagtcagtagaccgtcagaaccactggccagagagggagctgctagagatccaagaaggctggcaggaatgaggctcacaactcagcctcgcaagaggtggcagaggcacaggaggccacagtccttcctggggcattccaggcagagaaggagcagaggctctcccggcaggagctggggtctcagggctcagatgagtctgttgcatttgaatggggtcatagcaggttctggtcattccccaagcaacatctcagcatctcttaaagttgcctgcaggaatgaagcatgacatacctgttgagggactaggggagtggtggggaggtgagtggaccaaaggatataggccccaggcatgcagatgggcccggtgtcggggaggggtgctttctttcctcatctccccactccccactctcagcctgggagactcctgccaagccctcattaaagatgccaccctgggctgccctggcacctagcaaggcacaccaagaacagcttttgagtctgtatcctccactgggggaagtgctcccagttcagaacaagggcagcccgtggtgctgacctaggatataacaaagctcttcacttcaaaacccctgcaatagctgggtttacagacatttaccacctggggacccaaaagagaaggcctaggagagttttctagaaggttgggattgtcagggtcctggccccccagaactggcttgatcaagggccttatgtggagcagaggttgtctctgaaccaggagagaaggtactatacctttcaaatccccagggcagacacacccccacccagcccctatttggacctaaactgtgccatttgaacagtcacttccaagctcagtctaaatgaaaccgaaacgtgaccacgcacaaaggcagtcactgcctcgaggggtgcagaccgcagaattttcacagcaggggctcttggaactctggaaacccccttcttaaatttgggaggaggagtatgcctttggtgtccccctcccaaggggcaattctgaaccccatctttggcaggcatacatatttcactgtttccaaagctatctactctgccaaacaacacccagtcctattccaaactctcaacgattctatcttgttcctgtttttctatgtatttatggttgccgtttgtgtctgatttgattttactgttttttccctgattttatggagtagcattgtgacctgttttcctttgtcttatataactttagtaaactaaccactgtcaatgattgagggcaggtggcacgtggggaagaggggacttggcacgcagtggctacctgggcatttgtggtcatttcagtttccatctccccagcgggggctccctgggtgaaaggccacagtattttgggttggtaggcaaattgcaacattctggacatggcctgaggaaggcctcttcttataagattctcagaccaaattctagaccaaagacacaggcagaccaagtccccaggccccgcctggaaggaagtcgttcctcaactctccccaaggcacctgtctccaatcagagccctctcgcccagccagccctggctctgtgtgcagagcatagctctgcgagtacctgtgtaataatgctcaaccttcatgtctccgtataaacgaaactttccatgagaaaaaaaaaaaaaaaa

SEQ ID NO: 55313 - DNA, 1010 bp, Homo sapiens
gagtgctaactactctaggagagattaaagcctgtgaaatagaacttttccagataatggcgagtttttaggcttgctcatgctgaagcttaatataagctaataagtagagaaattaggaggcttggatattgcaaactttattggttggggtgttacccaggctaatagaaaaaaaattatatcctagaaagacagaacaggtgcgacttctgagaagaaaggttagagaagactagaaaggctgggaccaccttgaatttggcacacacacacacacacccacacgcacacacaaaatcaccaaatgatctggaatgtgctatgcgatgagtcagcctccactgctgtacgtccttggctacagactcctggaacagcagctcttctcaaggctagttgtgacagactcctggaacagcagctcttctcaaggctagttgtgacatccaaagtgacaagagcaggcccatattcagccacctcatccaggccttatcaaagaagagtcttatatgagatcaaatggctgcctttccccacaagattatatttttcctggtatgctctactttgacacatgtggctttctcaggaattttcaataaacgtgacttcactaggtggcctaagccccgatgtaaaatgtatatcccactggaccctgattacaatgcagactgccccaatgtgacagcacctgtttgtgcctcaaatggccacactttccagaatgagtgtttcttttgtgttgaacagagggaatttcattatcgtataaaatttgaaaaatatggaaaatgtgattaatgggtaccagagtaactacacttgcttattctttttctacttaattcagaatagtatttcttttagagtgtgagaatgtaaattaaataacatccctatgctgtacttaaatgtcgaacaaaatgagagacaaaaatgaaggaatcaaactgacaagaaccaaatatcacatttgttacaaataaacaacaaaagagctg

SEQ ID NO: 55314 - DNA, 1010 bp, Homo sapiens; identical to SEQ ID NO: 55313

SEQ ID NO: 55315 - DNA, 2033 bp, Homo sapiens
ggagaatccccggaaaggctgagtctccagctcaaggtcaaaacgtccaaggccgaaagccctccagtttcccctggacgccttgctcctgcttctgctacgaccttctggggaaaacgaatttctcattttcttcttaaattgccattttcgctttaggagatgaatgttttcctttggctgttttggcaatgactctgaattaaagcgatgctaacgcctcttttccccctaattgttaaaagctatggactgcaggaagatggcccgcttctcttacagtgtgatttggatcatggccatttctaaagtctttgaactgggattagttgccgggctgggccatcaggaatttgctcgtccatctcggggatacctggccttcagagatgacagcatttggccccaggaggagcctgcaattcggcctcggtcttcccagcgtgtgccgcccatggggatacagcacagtaaggagctaaacagaacctgctgcctgaatgggggaacctgcatgctggggtccttttgtgcctgccctccctccttctacggacggaactgtgagcacgatgtgcgcaaagagaactgtgggtctgtgccccatgacacctggctgcccaagaagtgttccctgtgtaaatgctggcacggtcagctccgctgctttcctcaggcatttctacccggctgtgatggccttgtgatggatgagcacctcgtggcttccaggactccagaactaccaccgtctgcacgtactaccacttttatgctagttggcatctgcctttctatacaaagctactattaatcgacattgacctatttccagaaatacaattttagatatcatgcaaatttcatgaccagtaaaggctgctgctacaatgtcctaactgaaagatgatcatttgtagttgccttaaaataatgaatacaatttccaaaatggtctctaacatttccttacagaactacttcttacttctttgccctgccctctcccaaaaaactacttcttttttcaaaagaaagtcagccatatctccattgtgcctaagtccagtgtttctttttttttttttttttgagacggagtctcactctgtcacccaggctggactgcaatgacgcgatcttggttcactgcaacctccgcatccggggttcaagccattctcctgcctaagcctcccaagtaactgggattacaggcatgtgtcaccatgcccagctaatttttttgtattttagtagagatgggggtttcaccatattggccagtctggtctcgaactctgaccttgtgatccatcgatcagcctctcgagtgctgagattacacacgtgagcaactgtgcaaggcctggtgtttcttgatacatgtaattctaccaaggtcttcttaatatgttcttttaaatgattgaattatatgttcagattattggagactaattctaatgtggaccttagaatacagttttgagtagagttgatcaaaatcaattaaaatagtctctttaaaaggaaagaaaacatctttaaggggaggaaccagagtgctgaaggaatggaagtccatctgcgtgtgtgcagggagactgggtaggaaagaggaagcaaatagaagagagaggttgaaaaacaaaatgggttacttgattggtgattaggtggtggtagagaagcaagtaaaaaggctaaatggaagggcaagtttccatcatctatagaaagctatataagacaagaactcccctttttttcccaaaggcattataaaaagaatgaagcctccttagaaaaaaaattatacctcaatgtccccaacaagattgcttaataaattgtgtttcctccaagctattcaattcttttaactgttgtagaagacaaaatgttcacaatatatttagttgtaaaccaagtgatcaaactacatattgtaaagcccatttttaaaatacattgtatatatgtgtatgcacagtaaaaatggaaactatattgacctaaaaaaaaaaaaa

SEQ ID NO: 55316 - DNA, 2033 bp, Homo sapiens
cagacatctgctcctcacatgaatgcactcacctcctagagaccaggctgccatcatgctctggaagcttgtggagaatgtcaagtacgaagatatctatgaggaccggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcattcggcgcaccacggcctggacgcgggcatgggtgacagcctctcgctgcacggcctcggccatcccggaatggaagacgtccagtcagttgaagatgccaataacagcggcatgaatctattggaccagtctgtcattaaaaaagttccagttcctcccaaatcggtgacttctctaatgatgaataaagacggcttcctgggaggcatgtctgtcaacaccggcgaggtgttttgctccgtcccaggccgtttgtctctgctcagttcaacttcgaagtacaaagtaactgtgggagaagttcagagacggctgtcgccccctgaatgcctcaatgcatctctcctcggcggagtcctcagaagagccaaatcgaaaaatggggggagatctttgcgagaaaggctagaaaaaatcggtttgaatttacccgcgggcaggcgcaaagcagcaaatgtcacgttactcacctccctggtggaaggagaagctgttcacttagctagggattttgggtacatttgcgaaacggagtttcccgccaaagccgtctctgagtatttgaaccggcagcacacagacccgagtgacctgcactcccgaaagaatatgctgttggccaccaagcaactttgtaaagaatttacggatctactggcgcaggaccggacaccgatagggaacagccgacccagccccatcctggagccggggatccagagctgcctcacgcacttcagcctcatcacgcacggcttcggcgccccggccatttgcgccgcgctcacggccctgcagaactatctcaccgaggcgctcaaaggcatggacaagatgttcttgaacaacaccaccactaacaggcacacgtctggggaaggcccaggtagtaaaactggcgacaaggaggagaaacacaggaaatgaaaaatttttaaaaaaagaaggaaaaatgttttaaatacaaaaggaaaaacagacaaaaatttaattttagctttaaaatattggattggctttggaagaattatattaggtagaatacacatacaatcaaaatttaaaaaaaaaaagctaaataacttaaaaaaaaactgaggcgtacaacggagcaacaatatcggttctcagtgtctatttcaagatacatttggagacaaccgtccggattttccacttcggttctttcgagtttagtaatactgataataaaagaaaaccatgatttccccttccctttggaaaataaacataagactaaacatgagaaaaacgctaacttattggaagaaaatcggagaaacgttggtgtcaatgctttgagagctggttgactgagacgcacgaactttttaattttaaatatatttttaggaaactctcgcagtccccgccctccatctcacctcacccgtctcccaaccacccttttccatgttaccctcccttcctcacattgttacgggaatcttctgggatgaaaatgagtgtggttggaaaaaaaaaaaaaaaaaaaaaaaaaaaaaaaaaaaaaaaaaaaaaaaaaaaaaaaaaa

SEQ ID NO: 55317 - DNA, 1794 bp, Homo sapiens
gaagtatactcattcaagtaaaggatcagtttcagggttcaggctgaagtgtcttaatgactagaattcaggttccaaggagaagcccacaaggctaagggtattggatataacggaaagtggaagctatacctgacttccagagaatgtggaccggatataagatcttaatcttctcttatcttactacagaaatctggatggagaagcggtatttatctcaaagagaagtggacctagaggcttatttcactaggaatcacaccgttttgcaaggtactcgattcaaaagagccattttccaagggcaatactgtagaaattttggctgttgtgaagacagagatgatggctgtgtcactgagttctatgcggcgaatgcgttgtgctactgtgataaattctgtgacagagaaaattctgattgctgtcctgactacaagtccttttgccgtgaagagaaagaatggcctcctcacacacagccttggtatccagaaggttgcttcaaagatggtcaacattatgaagagggatcagtaattaaagaaaactgcaactcctgcacatgctcaggacagcaatggaaatgttcccagcatgtatgccttgttcgttcagaattaattgaacaggtcaataaaggagactatggatggacagcacagaattacagccaattttggggaatgactttagaagatggttttaaatttcgccttggcactttgccacctagtctcatgctcctgagcatgaatgaaatgacagcttctttacctgcaacaactgatcttccagagttttttgttgcttcttataaatggcctggatggactcatggcccattggatcaaaaaaattgtgctgcatcctgggcattttccactgcaagtgtggctgctgaccgaatagcaattcagtctaagggtcgatacacggccaatctatcccctcagaatttgatctcttgctgtgccaagaaccgtcatggatgcaatagtggaagcatcgatagggcttggtggtacctgagaaaacgtggactggtatcccacgcatgctacccacttttcaaagaccaaaatgctaccaacaatggatgtgccatggcaagcaggtctgatgggcgaggaaaacggcatgccacgaagccatgtcccaacaacgtagaaaaatctaacaggatctatcaatgttctcctccatacagagtctcttccaacgaaactgagataatgaaagaaatcatgcaaaatggaccagttcaagccataatgcaagtccatgaagatttcttccattataagacagggatatacagacatgttaccagcacaaataaagaatcagaaaaatatcgaaagcttcagacacatgcagtcaaactcactggatggggcacactgagaggagcacaagggcagaaagaaaaattttggattgctgccaattcctggggaaagtcatggggagagaatggctatttcaggattcttcgaggagtaaatgagtccgacattgaaaagttgattatcgcagcttggggccaactgacgagttctgatgaaccataacatatcattaaatttccataaggtcatgcctttaagtaaccccctaaattgaagtttagcaatatgacattcttggtgacagtggaatctttgtctcttcaccgtgttaacataatctatctattttcttattttcccctctggtctatgcttctgcttccttcatattactgagcattaacaacaccaaaaaaaaaaaaaaaaaaaaaaaaaaaaa

SEQ ID NO: 55318 - DNA, 1605 bp, Homo sapiens
ggggcttttgaggtagagtcagagtagggaaaacaactaatctgttttccaaacaggttttcataaataactgacaggagatgggctgtttttatggaagtattaacccaaatgatgggtgttaatcattaaacctttttggtggtggctcgcttgtttctctgatattctaatccgggtcacagaatggctaaggcagatttaagtgcagcgtggattttttttttctcactttgccttgtgttttccaccctgaaagaatgttgtggctgctcttttttctggtgactgccattcatgctgaactctgtcaaccaggtgcagaaaatgcttttaaagtgagacttagtatcagaacagctctgggagataaagcatatgcctgggataccaatgaagaatacctcttcaaagcgatggtagctttctccatgagaaaagttcccaacagagaagcaacagaaatttcccatgtcctactttgcaatgtaacccagagggtatcattctggtttgtggttacagacccttcaaaaaatcacacccttcctgctgttgaggtgcaatcagccataagaatgaacaagaaccggatcaacaatgccttctttctaaatgaccaaactctggaatttttaaaaatcccttccacacttgcaccacccatggacccatctgtgcccatctggattattatatttggtgtgatattttgcatcatcatagttgcaattgcactactgattttatcagggatctggcaacgtagaagaaagaacaaagaaccatctgaagtggatgacgctgaagataagtgtgaaaacatgatcacaattgaaaatggcatcccctctgatcccctggacatgaagggagggcatattaatgatgccttcatgacagaggatgagaggctcacccctctctgaagggctgttgttctgcttcctcaagaaattaaacatttgtttctgtgtgactgctgagcatcctgaaataccaagagcagatcatatattttgtttcaccattcttcttttgtaataaattttgaatgtgcttgaaagtgaaaagcaatcaattatacccaccaacaccactgaaatcataagctattcacgactcaaaatattctaaaatatttttctgacagtatagtgtataaatgtggtcatgtggtatttgtagttattgatttaagcatttttagaaataagatcaggcatatgtatatattttcacacttcaaagacctaaggaaaaataaattttccagtggagaatacatataatatggtgtagaaatcattgaaaatggatcctttttgacgatcacttatatcactctgtatatgactaagtaaacaaaagtgagaagtaattattgtaaatggatggataaaaatggaattactcatatacagggtggaattttatcctgttatcacaccaacagttgattatatattttctgaatatcagcccctaataggacaattctatttgttgaccatttctacaatttgtaaaagtccaatctgtgctaacttaataaagtaataatcatctcttaagtaaaaaaaaaaaaaaaaaaaaaaaaaaaaa

SEQ ID NO: 55319 - DNA, 2889 bp, Homo sapiens
aggcccgggggtcgccggggccacgacttctcggagaccgtcctgcgctctctggagacgcgctgtccgcgcccagggtggtgccatgtggggcgctcgccgctcgtccgtctcctcatcctggaacgccgcttcgctcctgcagctgctgctggctgcgctgctggcggcgggggcgagggccagcggcgagtactgccacggctggctggacgcgcagggcgtctggcgcatcggcttccagtgtcccgagcgcttcgacggcggcgacgccaccatctgctgcggcagctgcgcgttgcgctactgctgctccagcgccgaggcgcgcctggaccagggcggctgcgacaatgaccgccagcagggcgctggcgagcctggccgggcggacaaagacggccccgacggctcggcagtgcccatctacgtgccgttcctcattgttggctccgtgtttgtcgcctttatcatcttggggtccctggtggcagcctgttgctgcagatgtctccggcctaagcaggatccccagcagagccgagccccagggggtaaccgcttgatggagaccatccccatgatccccagtgccagcacctcccgggggtcgtcctcacgccagtccagcacagctgccagttccagctccagcgccaactcaggggcccgggcgcccccaacaaggtcacagaccaactgttgcttgccggaagggaccatgaacaacgtgtatgtcaacatgcccacgaatttctctgtgctgaactgtcagcaggccacccagattgtgccacatcaagggcagtatctgcatcccccatacgtggggtacacggtgcagcacgactctgtgcccatgacagctgtgccacctttcatggacggcctgcagcctggctacaggcagattcagtcccccttccctcacaccaacagtgaacagaagatgtacccagcggtgactgtataaccgagagtcactggtgggttcctttactgaagggagacgaaggcaggggtggattctcgaggtggaagtccgcacatgtcggtggtatttatggcacgattcctttggatggcttcatttgcccccagactgtatgaaaacatctccgaattagcatttctggatatgtttcatccagggtatcattgatttatgatggaaaaccggcctcagctggagatgactgtgatgttgctgatgggtgtataacaaatgcttgagtccgaagtgcccttgagatatggttgacgaaagaattttataaactgataaattaaggatttttattatgttgttattattatttcttttttgttgttgactgcacaggatcaaaatgcctgttatctcccttttacctgggactttttttttttttttttttttttttaatcagacagggtcttgctctgttgcccaggctggagtgcagtggtgcgatctcggctcactgcaacttcagcctcctggattcaggcaacactcctgcctcagcctcccacgtggctgggattacaggtgcctgcccccatggctaattttttgtattttttgtagagatggggtttcaccatgttggctgggctggtctcactctcctgacctcaagcaatctgcctgtctcagcctcccaaagtgctgggattacaggcgtgagccaccgcccccagcctgagcctttttttttttctaatgcatccaaggttaaggggaagacgcaaataacaggactattctaaaaggaaacctgtttgaactctgtgagatcagtcatcagtctcagtattccacaggcacaccttaatttcattgtaaaaagatatatatattttgtctatttttgtgcttttgggggcctattttgtgcttttttaccttatgtagagatcttattacaaagtgattttctacattaaaaagagactgaaataaattgtatagttacttaactaatgaagacatttcagaactctgggatgattttaatcttgaagtagtaggtggtatagtcataaaaccattcatccccttcttgattgtatcttaattttctggctttaaggtgacatctgagaggtaatgcattcttttttatattgaaatcataaactatcacccgctgcttctctgagttacttttaattttgccttgtggttatggtttggcgtttccttctgtttggttttcagagccccatgtctatatagtcctgagtgcaagtaattactatacttgtaaatgaagatcagtatttctgcctagatctgataaaaaaattttcttgtcttagttataaaaattcaaagaaatgtgttacaaagatacttagtatagctcctcagccataacctgagacttgggatgaaatttaaaccagatacgatttactttgcagatcataaggctttttatactcttgttatcaaaatggcttatttttcaggcactaaggattgttaagagaaaagcttttcaacgaaggattgcctttcttctcccacactgttcttgatttcctctctctttcaggcctcaacaggcactgtattcattgccaatgttccaaattatcaaattcaagtgaatttatttgtgtgttctttacttatataaaaaaagataactttaaggatgtgcaagtacatttccaactgctagcacaaccagtattttgtaattaaacaaatcgctgtatggtatggtcttctacacatttatgtctatagatatctatcgatcatctttctattctgtttcatgactgaataatgtaaaaccagtgttggcaattggtatcatcaatgatactcattttttaataaccaaaggcaggggaaaatcattttacttattaataaatattttatgatgtgaa

SEQ ID NO: 55320 - DNA, 3685 bp, Homo sapiens
agtggactcacgcaggcgcaggagactacacttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttccctcaaaaaaaaaaaaaaaaaaaaaaa

SEQ ID NO: 55321 - DNA, 2486 bp, Homo sapiens
cacacacaccacctcacaaccacacactgcatgcacacacatacaccacagccacacactgtgcatacacgcacaccccacaacccacatactgcatgcacacacacacacctacaagctgcatgctgcatacacaagtcatacaggagataaactcagagtcccagccccaaatagaccccatctcttgctcagttgctgtcatcctagacctgtttctttcgccacatttctataatctgccagtgtctgcaaggagaagacatggggggttttctacctaaggcagaagggcccgggagccaactccagaaacttctgccctcctttctggtcagagaacaagactgggaccagcacctggacaagcttcatatgctgcagcagaagaggattctagagtctccactgcttcgagcatccaaggaaaatgacctgtctgttcttaggcaacttctactggactgcacctgtgacgttcgacaaagaggagccctgggggagacggcgctgcacatagcagccctctatgacaacttggaggcggccttggtgctgatggaggctgccccagagctggtctttgagcccaccacatgtgaggcttttgcaggtcagactgcactgcacatcgctgttgtgaaccagaatgtgaacctggtgcgtgccctgctcacccgcagggccagtgtctctgccagagccacaggcactgccttccgccgtagtccccgcaacctcatctactttggggagcaccctttgtcctttgctgcctgtgtgaacagcgaggagatcgtgcggctgctcattgagcatggagctgacatcagggcccaggactccctgggaaacacagtattacacatcctcatcctccagcccaacaaaacctttgcctgccagatgtacaacctgctgctgtcctacgatggacatggggaccacctgcagcccctggaccttgtgcccaatcaccagggtctcacccccttcaagctggctggagtggagggtaacactgtgatgttccagcacctgatgcagaagcggaggcacatccagtggacgtatggacccctgacctccattctctacgacctcacagagatcgactcctggggagaggagctgtccttcctggagcttgtggtctcctctgataaacgagaggctcgccaaattctggaacagaccccagtgaaggagctggtgagcttcaagtggaacaagtatggccggccgtacttctgcatcctggctgccttgtacctgctctacatgatctgctttaccacgtgctgcgtctaccgcccccttaagtttcgtggtggcaaccgcactcattctcgagacatcaccatcctccagcaaaaactactacaggaggcctatgagacacgtgaagatatcatcaggctggtgggggagctggtgagcatcgttggggctgtgatcatcctgctcctagagattccagacatcttcagggttggtgcctctcgctattttggaaagacgattcttggggggccattccatgtcatcatcatcacctatgcctccctggtgctggtgaccatggtgatgcggctcaccaacaccaatggggaggtggtgcccatgtcctttgccctggtgctgggctggtgcagtgtcatgtatttcactcgaggattccagatgctgggtcccttcaccatcatgatccagaagatgatttttggagacctaatgcgtttctgctggctgatggctgtggtcatcttgggatttgcctccgcgttctatatcattttccagacagaggacccaaccagtctggggcaattctatgactaccccatggcactgttcaccacctttgagctttttctcactgttattgatgcacctgccaactacgacgtggacttgcccttcatgttcagcattgtcaacttcgccttcgccatcattgccacactgctcatgctcaacttgttcatcgccatgatgggcgacacccactggagggtggcccaggagagggatgagctctggagggcccaggtcgtggccaccacagtgatgctggagcggaagctgcctcgctgcctgtggcctcgctccgggatctgtgggtgcgaattcgggctgggggaccgctggttcctgcgggttgagaaccacaatgatcagaatcctctgcgagtgcttcgctatgtggaagtgttcaagaactcagacaaggaggatgaccaggagcatccatctgagaaacagccctctggggctgagagtgggactctagccagagcctctttggctcttccaacttcctccctgtcccggaccgcgtcccagagcagcagtcaccgaggctgggagatccttcgtcaaaacaccctggggcacttgaatcttggactgaaccttagtgagggggatggagaggaggtctaccatttttgattaacatcgctatcactcttgaccttactccc

SEQ ID NO: 55322 - DNA, 3096 bp, Homo sapiens
gccagcagcctctaagagctcctagacggcctttggctttggctggcacaggggtgaaggagagccagcggcattgagtaaccaggcgaatgtgcccccaggagagttcattccaaccctcccagttcctactgctggtgggggtcccagtggcaagtgtcctccttctggcccaatgccttcgatggcactgccctagaaggctgctgggggcctgctggacactgaatggtcaagaggaaccagtgtcccagcctaccccccaactagaaaatgaggtctcaaggcagcacctgccagccacactgccagagatggttgccttctaccaggagctacacacacccactcaaggccagaccatggtccgccagttgatgcacaaactgttggtgttttcggctcgagaggtggatcaccgcggcggttgcctgatgctccaggatacaggcatctccttgctcatcccaccaggtgctgtggctgtgggccgccaggagcgggtgtctttgatcctggtgtgggacctgtcggacgccccatcgctgtcccaagcccaggggctggtaagccctgtggtggcatgtggcccccatggggcctccttcctgaagccttgcactctcacgttcaaacactgtgccgagcagcccagccatgctcgcacctacagcagcaacactaccctgctggatgccaaggtatggaggcccctggggcggccgggggcccacgcctcccgggatgagtgtcgcatccacctctcccacttcagcctctacacctgtgtgctggaggcacctgtggggcgcgaagcccgcaaatggctgcagctggccgtattctgctcaccgctggtgccaggacagtcccatctgcaactgcgtatctacttcctcaacaacacgccctgcgccctgcagtgggcactgaccaacgagcagccccatggtgggcgcctgcgtgggccctgccagctcttcgacttcaatggggctaggggcgaccagtgcctgaagctcacgtacatctcagagggttgggagaatgtggatgacagcagttgccagctggttccccatctccacatctggcatggaaagtgccccttccgctccttctgcttccggagaaaagcagccgatgagaatgaggactgttcagcactaaccaatgagatcattgtcaccatgcacaccttccaggatggcttggagaccaagtatatggaaatcctcagattccaggcatcagaggaggaatcctgggcagcgccaccacctgtttcccagccgcccccatgcaataggctgcccccagagctctttgagcagctgcggatgttattggagccaaacagcatcaccggcaatgactggcgcggactggcctcccacctggggctttgcggcatgaagatccggttcctgtcctgccagcgcagccccgcagcggccatcctggagttgtttgaggagcagaacggcagcctgcaggagctgcactacctcatgaccgtcatggagcggctagactgcgcctccgccatccagaactacctgagtgggacacacggcggcagcccaggccccgagcgcgggggcgcccgggataaccagggcctggagctggacgagaagctctgagcgcccagcgggcagggccggaggaggtgtaggggcgagaggggttgttctcctacgcctaagaggaacacagcagctgttcctggctgtgcccaccacccttcccagaaccctcggacggtgccagggccgcccgcgtcctcgccagcctcccagcagcaggcgcgcccttccggccgcgagctgtcccgcgtgcgggtcccctcctggccggcagagggcgcaggagcccaggagatggcctcagcgtggccagcctgccaaactgaccaggggacggccacggtccccgcgtgcactttagggccggtcaggccctaaagtattcactgagcacttaggaagaccgggcattgggctggtgtcatgaagaatactggaatataggaggtagggtctggagccctgacaagcacacagttcttttgcaggagtcaagatgtgctcataggagccaagggcaaactcgaaaacagccctgccctgtggttaggggaggtgggtgtggctttaggagttgagaggggaagagctgagtgcgggctggagcagcgagaatgcttcacggaggatgttggggagagaggatttgatttgccgagtggtttggagatctttaggggcgggtaggggaagagggtggctggacttaaggtaggagccgaaagtgggcatgggagcccatccccgtgggtgtgaggccggggtaggaccaggcttcccggctaggcacgcctggctggctgcctctgcctctactaacttcctttgtctctttatcctcctgcttaggccgtgtcttcctctctctctgccattttctctatcagaaaacattaaagctgagtagaaacttcaagatgatcattctggcccagcccttttatctctttatctccaatggtgtgcgttttaagtttctctgacttggtttttctgtccctgtctcccacagttgttcccgctctgcacctgtgtttcagttactctctctctctgtcttagatctttttgtttctgcctagtctctgtgccctgtctttgtgtgtttctttctctgcctgaaaccctccctcttttcccttcaggcatatgtctctaaaccaatgttatgtatcaaagactgttgaaagagacagggctactctaggaatggatgggtggggatattttccccatggatcaagatccagtttagggttgggaaataaaggatagggataaaagaggcaccccattcagtcagcagatacttattcagcacctactatgtgtttgatactgtatacaaaagacatgaatgggctgggtcctgaacagagaataaagggtttgactccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 55323 - DNA, 1232 bp, Homo sapiens
ctagaggggcggaaagtaacaaggaggtgggggtacaaatcctcagctcctgcttccgcaagcactaacctgctctgaagtgagccaggcagctctggccatcttttcccagccacagaatcaggtgatggtccagaattaagagctgtcacctgtgtcattcactcacaatggaagaaatgaagaagactgccatccggctgcccaaaggcaaacagaagcctataaagacggaatggaattcccggtgtgtccttttcacctacttccaaggggacatcagcagcgtagtggatgaacacttctccagagctctgagcaatatcaagagcccccaggaattgaccccctcgagtcagagtgaaggtgtgatgctgaaaaacgatgatagcatgtctccaaatcagtggcgttactcgtctccatggacaaagccacaaccagaagtacctgtcacaaaccgtgccgccaactgcaacttgcatgtgcctggtcccatggctgtgaatcagttctcaccgtccctggctaggagggcctctgttcggcctggggagctgtggcatttctcctccctggcgggcaccagctccttagagcctggctactctcatcccttccccgctcggcacctggttccagagccccagcctgatgggaaacgtgagcctctcctaagtctcctccagcaagacagatgcctagcccgtcctcaggaatctgccgccagggagaatggcaaccctggccagatagctggaagcacagggttgctcttcaacctgcctcccggctcagttcactataagaaactatatgtatctcgtggatctgccagtaccagccttccaaatgaaactctttcagagttagagacacctgggaaatactcacttacaccaccaaaccactggggccacccacatcgatacctgcagcatctttagtcaagttggaggagaaagacaacacttggtctaagacacggcagcaagacatccctgcatattgttccagataaaaatgaaagctgctcacacccacttgcctccccaatctgttaaacagcttcgtgtctagtatgagctcagtacttgccctgtgaaaatcccagaagcccccgctgtcaatgttccccatccacaccctgcttgctcctgtgtaacagctcagatgatgaataataataaaactgtacttttttggatggtgaaaaaaaaaaaaaaaaaaaa

SEQ ID NO: 55324 - DNA, 2015 bp, Homo sapiens
gcttctcctgcgcctccttttcgcccagcactagcgccttaggccagctcgggggatgtgagagccgaagcccttagactgccaggcacagagtcgggtcgggatttgtcagccaagcctcggctccagctccgcaatctcgggactcacccgagcgacccaggcccgacggcaagttcgggcgggacggcggccgccgcgcgctcaggctcagcttcgctgcccgcccagaagatgaatccggcctcggcgccccctccgctcccgccgcctgggcagcaagtgatccacgtcacgcaggacctagacacagacctcgaagccctcttcaactctgtcatgaatccgaagcctagctcgtggcggaagaagatcctgccggagtctttctttaaggagcctgattcgggctcgcactcgcgccagtccagcaccgactcgtcgggcggccacccggggcctcgactggctgggggtgcccagcatgtccgctcgcactcgtcgcccgcgtccctgcagctgggcaccggcgcgggtgctgcgggtagccccgcgcagcagcacgcgcacctccgccagcagtcctacgacgtgaccgacgagctgccactgcccccgggctgggagatgaccttcacggccactggccagaggtacttcctcaatcacatagaaaaaatcaccacatggcaagaccctaggaaggcgatgaatcagcctctgaatcatatgaacctccaccctgccgtcagttccacaccagtgcctcagaggtccatggcagtatcccagccaaatctcgtgatgaatcaccaacaccagcagcagatggcccccagtaccctgagccagcagaaccaccccactcagaacccacccgcagggctcatgagtatgcccaatgcgctgaccactcagcagcagcagcagcagaaactgcggcttcagagaatccagatggagagagaaaggattcgaatgcgccaagaggagctcatgaggcaggaagctgccctctgtcgacagctccccatggaagctgagactcttgccccagttcaggctgctgtcaacccacccacgatgaccccagacatgagatccatcactaataatagctcagatcctttcctcaatggagggccatatcattcgagggagcagagcactgacagtggcctggggttagggtgctacagtgtccccacaactccggaggacttcctcagcaatgtggatgagatggatacaggagaaaacgcaggacaaacacccatgaacatcaatccccaacagacccgtttccctgatttccttgactgtcttccaggaacaaacgttgacttaggaactttggaatctgaagacctgatccccctcttcaatgatgtagagtctgctctgaacaaaagtgagccctttctaacctggctgtaatcactaccattgtaacttggatgtagccatgaccttacatttcctgggcctcttggaaaaagtgatggagcagagcaagtctgcaggtgcaccacttcccgcctccatgactcgtgctccctcctttttatgttgccagtttaatcattgcctggttttgattgagagtaacttaagttaaacataaataaatattctattttcattttctgcaagcctgcgttcttgtgacagattatacagaattgtgtctgcaggattgattatgcagaatacttttctctttcttctctgctgccccatggctaagctttatgggtgttaattgaaatttatacaccaattgattttaaaccataaaaagctgaccacaggcagttacttctgagggcatcttggtccaggaaatgtgcacaaaattcgacctgatttacagtttcaaaaactgtattgatgacagtagtaccaaatgctttaaaaactatttaacttgagctttaaaaatcattgtatggatagtaaaattctactgtatggaatacaatgtaattttgaatccaaaaaaaaaaaaaaaaaaa

SEQ ID NO: 55325 - protein, 1205 aa, Homo sapiens
MVLLSLWLIAAALVEVRTSADGQAGNEEMVQIDLPIKRYREYELVTPVSTNLEGRYLSHTLSASHKKRSARDVSSNPEQLFFNITAFGKDFHLRLKPNTQLVAPGAVVEWHETSLVPGNITDPINNHQPGSATYRIRKTEPLQTNCAYVGDIVDIPGTSVAISNCDGLAGMIKSDNEEYFIEPLERGKQMEEEKGRIHVVYKRSAVEQAPIDMSKDFHYRESDLEGLDDLGTVYGNIHQQLNETMRRRRHAGENDYNIEVLLGVDDSVVRFHGKEHVQNYLLTLMNIVNEIYHDESLGVHINVVLVRMIMLGYAKSISLIERGNPSRSLENVCRWASQQQRSDLNHSEHHDHAIFLTRQDFGPAGMQGYAPVTGMCHPVRSCTLNHEDGFSSAFVVAHETGHVLGMEHDGQGNRCGDETAMGSVMAPLVQAAFHRYHWSRCSGQELKRYIHSYDCLLDDPFDHDWPKLPELPGINYSMDEQCRFDFGVGYKMCTAFRTFDPCKQLWCSHPDNPYFCKTKKGPPLDGTECAAGKWCYKGHCMWKNANQQKQDGNWGSWTKFGSCSRTCGTGVRFRTRQCNNPMPINGGQDCPGVNFEYQLCNTEECQKHFEDFRAQQCQQRNSHFEYQNTKHHWLPYEHPDPKKRCHLYCQSKETGDVAYMKQLVHDGTHCSYKDPYSICVRGECVKVGCDKEIGSNKVEDKCGVCGGDNSHCRTVKGTFTRTPRKLGYLKMFDIPPGARHVLIQEDEASPHILAIKNQATGHYILNGKGEEAKSRTFIDLGVEWDYNIEDDIESLHTDGPLHDPVIVLIIPQENDTRSSLTYKYIIHEDSVPTINSNNVIQEELDTFEWALKSWSQCSKPCGGGFQYTKYGCRRKSDNKMVHRSFCEANKKPKPIRRMCNIQECTHPLWVAEEWEHCTKTCGSSGYQLRTVRCLQPLLDGTNRSVHSKYCMGDRPESRRPCNRVPCPAQWKTGPWSECSVTCGEGTEVRQVLCRAGDHCDGEKPESVRACQLPPCNDEPCLGDKSIFCQMEVLARYCSIPGYNKLCCESCSKRSSTLPPPYLLEAAETHDDVISNPSDLPRSLVMPTSLVPYHSETPAKKMSLSSISSVGGPNAYAAFRPNSKPDGANLRQRSAQQAGSKTVRLVTVPSSPPTKRVHLSSASQMAAASFFAASDSIGASSQARTSKKDGKIIDNRRPTRSSTLER

SEQ ID NO: 55326 - protein, 282 aa, Homo sapiens
MDAVEPGGRGWASMLACRLWKAISRALFAEFLATGLYVFFGVGSVMRWPTALPSVLQIAITFNLVTAMAVQVTWKASGAHANPAVTLAFLVGSHISLPRAVAYVAAQLVGATVGAALLYGVMPGDIRETLGINVVRNSVSTGQAVAVELLLTLQLVLCVFASTDSRQTSGSPATMIGISVALGHLIGIHFTGCSMNPARSFGPAIIIGKFTVHWVFWVGPLMGALLASLIYNFVLFPDTKTLAQRLAILTGTVEVGTGAGAGAEPLKKESQPGSGAVEMESV

SEQ ID NO: 55327 - protein, 840 aa, Homo sapiens
MVSVFRSEEMCLSQLFLQVEAAYCCVAELGELGLVQFKDLNMNVNSFQRKFVNEVRRCESLERILRFLEDEMQNEIVVQLLEKSPLTPLPREMITLETVLEKLEGELQEANQNQQALKQSFLELTELKYLLKKTQDFFETETNLADDFFTEDTSGLLELKAVPAYMTGKLGFIAGVINRERMASFERLLWRICRGNVYLKFSEMDAPLEDPVTKEEIQKNIFIIFYQGEQLRQKIKKICDGFRATVYPCPEPAVERREMLESVNVRLEDLITVITQTESHRQRLLQEAAANWHSWLIKVQKMKAVYHILNMCNIDVTQQCVIAEIWFPVADATRIKRALEQGMELSGSSMAPIMTTVQSKTAPPTFNRTNKFTAGFQNIVDAYGVGSYREINPAPYTIITFPFLFAVMFGDCGHGTVMLLAALWMILNERRLLSQKTDNEIWNTFFHGRYLILLMGIFSIYTGLIYNDCFSKSLNIFGSSWSVQPMFRNGTWNTHVMEESLYLQLDPAIPGVYFGNPYPFGIDPIWNLASNKLTFLNSYKMKMSVILGIVQMVFGVILSLFNHIYFRRTLNIILQFIPEMIFILCLFGYLVFMIIFKWCCFDVHVSQHAPSILIHFINMFLFNYSDSSNAPLYKHQQEVQSFFVVMALISVPWMLLIKPFILRASHRKSQLQASRIQEDATENIEGDSSSPSSRSGQRTSADTHGALDDHGEEFNFGDVFVHQAIHTIEYCLGCISNTASYLRLWALSLAHAQLSEVLWTMVMNSGLQTRGWGGIVGVFIIFAVFAVLTVAILLIMEGLSAFLHALRLHWVEFQNKFYVGDGYKFSPFSFKHILDGTAEE

SEQ ID NO: 55328 - protein, 840 aa, Homo sapiens; identical to SEQ ID NO: 55327

SEQ ID NO: 55329 - protein, 840 aa, Homo sapiens; identical to SEQ ID NO: 55327

SEQ ID NO: 55330 - protein, 350 aa, Homo sapiens
MLEGAELYFNVDHGYLEGLVRGCKASLLTQQDYINLVQCETLEDLKIHLQTTDYGNFLANHTNPLTVSKIDTEMRKRLCGEFEYFRNHSLEPLSTFLTYMTCSYMIDNVILLMNGALQKKSVKEILGKCHPLGRFTEMEAVNIAETPSDLFNAILIETPLAPFFQDCMSENALDELNIELLRNKLYKSYLEAFYKFCKNHGDVTAEVMCPILEFEADRRAFIITLNSFGTELSKEDRETLYPTFGKLYPEGLRLLAQAEDFDQMKNVADHYGVYKPLFEAVGGSGGKTLEDVFYEREVQMNVLAFNRQFHYGVFYAYVKLKEQEIRNIVWIAECISQRHRTKINSYIPIL

SEQ ID NO: 55331 - protein, 118 aa, Homo sapiens
MTSQSQGIHQLLQAEKRAKDKLEEAKKRKGKRLKQAKEEAMVEIDQYRMQRDKEFRLKQSKIMGSQNNLSDEIEEQTLGKIQELNGHYNKYMESVMNQLLSMVCDMKPEIHVNYRATN

SEQ ID NO: 55332 - protein, 59 aa, Homo sapiens
MTSQSQGIHQLLQAEKRAKDKLEEAKKILHLLFLKRRDWDCFWKRKAIEASQGGSNGRN

SEQ ID NO: 55333 - protein, 1010 aa, Homo sapiens
MGYSRRADDLADSGMDAFMDNDSLKWASTDIHFSKVWCLLGAAEYTEYKSLSSRIALGISRNMYSAICCLDKNVLLLLKGKAEVGKTFFKRGLMKFDVCEPFPCARYVASTEEKKIMEETNTQIAWPSKLKIGAKSKKDPHIKVSGKKEDVKEAKEMIMSVLDTKSNRVTLKMDVSHTEHSHVIGKGGNNIKKVMEETGCHIHFPDSNRNNQAEKSNQVSIAGQPAGVESARVRIRELLPLVLMFELPIAGILQPVPDPNSPSIQHISQTYNISVSFKQRSRMYGATVIVRGSQNNTSAVKEGTAMLLEHLAGSLASAIPVSTQLDIAAQHHLFMMGRNGSNIKHIMQRTGAQIHFPDPSNPQKKSTVYLQGTIESVCLARQYLMGCLPLVLMFDMKEEIEVDPQFIAQLMEQLDVFISIKPKPKQPSKSVIVKSVERNALNMYEARKCLLGLESSGVTIATSPSPASCPAGLACPSLDILASAGLGLTGLGLLGPTTLSLNTSTTPNSLLNALNSSVSPLQSPSSGTPSPTLWAPPLANTSSATGFSAIPHLMIPSTAQATLTNILLSGVPTYGHTAPSPPPGLTPVDVHINSMQTEGKKISAALNGHAQSPDIKYGAISTSSLGEKVLSANHGDPSIQTSGSEQTSPKSSPTEGCNDAFVEVGMPRSPSHSGNAGDLKQMMCPSKVSCAKRQTVELLQGTKNSHLHSTDRLLSDPELSATESPLADKKAPGSERAAERAAAAQQNSERAHLAPRSSYVNMQAFDYEQKKLLATKAMLKKPVVTEVRTPTNTWSGLGFSKSMPAETIKELRRANHVSYKPTMTTTYEGSSMSLSRSNSREHLGGGSESDNWRDRNGIGPGSHSEFAASIGSPKRKQNKSTEHYLSSSNYMDCISSLTGSNGCNLNSSFKGSDLPELFSKLGLGKYTDVFQQQEIDLQTFLTLTDQDLKELGITTFGARRKMLLAISELNKNRRKLFESPNARTSFLEGGASGRLPRQYHSDIASVSGRW

SEQ ID NO: 55334 - protein, 1010 aa, Homo sapiens; identical to SEQ ID NO: 55333

SEQ ID NO: 55335 - protein, 327 aa, Homo sapiens [sequence omitted]

SEQ ID NO: 55336 - protein, 163 aa, Homo sapiens
MSWRPQPCCISSCCLTTDWVHLWYIWLLVVIGALLLLCGLTSLCFRCCCLSRQQNGEDGGPPPCEVTVIAFDHDSTLQSTITSLQSVFGPAARRILAVAHSHSSLGQLPSSLDTLPGYEEALHMSRFTVAMCGQKAPDLPPVPEEKQLPPTEKESTRIVDSWN

SEQ ID NO: 55337 - protein, 328 aa, Homo sapiens
MEKSIWLLACLAWVLPTGSFVRTKIDTTENLLNTEVHSSPAQRWSMQVPPEVSAEAGDAAVLPCTFTHPHRHYDGPLTAIWRAGEPYAGPQVFRCAAARGSELCQTALSLHGRFRLLGNPRRNDLSLRVERLALADDRRYFCRVEFAGDVHDRYESRHGVRLHVTAAPRIVNISVLPSPAHAFRALCTAEGEPPPALAWSGPALGNSLAAVRSPREGHGHLVTAELPALTHDGRYTCTAANSLGRSEASVYLFRFHGASGASTVALLLGALGFKALLLLGVLAARAARRRPEHLDTPDTPPRSQAQESNYENLSQMNPRSPPATMCSP

SEQ ID NO: 55338 - protein, 499 aa, Homo sapiens
MAQFAFESDLHSLLQLDAPIPNAPPARWQRKAKEAAGPAPSPMRAANRSHSAGRTPGRTPGKSSSKVQTTPSKPGGDRYIPHRSAAQMEVASFLLSKENQSENSQTPTKKEHQKAWALNLNGFDVEEAKILRLSGKPQNAPEGYQNRLKVLYSQKATPGSSRKTCRYIPSLPDRILDAPEIRNDYYLNLVDWSSGNVLAVALDNSVYLWSASSGDILQLLQMEQPGEYISSVAWIKEGNYLAVGTSSAEVQLWDVQQQKRLRNMTSHSARVGSLSWNSYILSSGSRSGHIHHHDVRVAEHHVATLSGHSQEVCGLRWAPDGRHLASGGNDNLVNVWPSAPGEGGWVPLQTFTQHQGAVKAVAWCPWQSNVLATGGGTSDRHIRIWNVCSGACLSAVDAHSQVCSILWSPHYKELISGHGFAQNQLVIWKYPTMAKVAELKGHTSRVLSLTMSPDGATVASAAADETLRLWRCFELDPARRREREKASAAKSSLIHQGIR

SEQ ID NO: 55339 - protein, 687 aa, Homo sapiens
MEEFVGLREGSSGNPVTLQELWGPCPLIRRGIRGGLEWLKQKLFRLGEDWYFLMTLGVLMALVSCAMDLAVESVVRAHQWLYREIGDSHLLRYLSWTVYPVALVSFSSGFSQSITPSSGGSGIPEVKTMLAGVVLEDYLDIKNFGAKVVGLSCTLACGSTLFLGKVGPFVHLSVMMAAYLGRVRTTTIGEPENKSKQNEMLVAAAAVGVATVFGAPFSGVLFSIEVMSSHFSVWDYWRGFFAATCGAFMFRLLAVFNSEQETITSLYKTSFRVDVPFDLPEIFFFVVLGGLCGILGSAYLFCQRIFFGFIRNNRFSSKLLATSKPVYSALATLVLASITYPPSAGRFLASRLSMKQHLDSLFDNHSWALMTQNSSPPWPEELDPQHLWWEWYHPRFTIFGTLAFFLVMKFWMLILATTIPMPAGYFMPIFVYGAAIGRLFGETLSFIFPEGIVAGGITNPIMPGGYALAGAAAFSGAVTHTISTALLAFEVTGQIVHALPVLMAVLAANAIAQSCQPSFYDGTVIVKKLPYLPRILGRNIGSHRVRVEHFMNHSITTLAKDTPLEEVVKVVTSTDVAEYPLVESTESQILVGIVRRAQLVQALKAEPPSWAPGHQQCLQDILAAGCPTEPVTLKLSPETSLHEAHNLFELLNLHSLFVTSRGRAVGCVSWVEMKKAISNLTNPPAPK

SEQ ID NO: 55340 - protein, 220 aa, Homo sapiens
MASAGMQILGVVLTLLGWVNGLVSCALPMWKVTAFIGNSIVVAQVVWEGLWMSCVVQSTGQMQCKVYDSLLALPQDLQAARALCVIALLVALFGLLVYLAGAKCTTCVEEKDSKARLVLTSGIVFVISGVLTLIPVCWTAHAVIRDFYNPLVAEAQKRELGASLYLGWAASGLLLLGGGLLCCTCPSGGSQGPSHYMARYSTSAPAISRGPSEYPTKNYV

SEQ ID NO: 55341 - protein, 1002 aa, Homo sapiens
MAAHEWDWFQREELIGQISDIRVQNLQVERENVQKRTFTRWINLHLEKCNPPLEVKDLFVDIQDGKILMALLEVLSGRNLLHEYKSSSHRIFRLNNIAKALKFLEDSNVKLVSIDAAEIADGNPSLVLGLIWNIILFFQIKELTGNLSRNSPSSSLSPGSGGTDSDSSFPPTPTAERSVAISVKDQRKAIKALLAWVQRKTRKYGVAVQDFAGSWRSGLAFLAVIKAIDPSLVDMKQALENSTRENLEKAFSIAQDALHIPRLLEPEDIMVDTPDEQSIMTYVAQFLERFPELEAEDIFDSDKEVPIESTFVRIKETPSEQESKVFVLTENGERTYTVNHETSHPPPSKVFVCDKPESMKEFRLDGVSSHALSDSSTEFMHQIIDQVLQGGPGKTSDISEPSPESSILSSRKENGRSNSLPIKKTVHFEADTYKDPFCSKNLSLCFEGSPRVAKESLRQDGHVLAVEVAEEKEQKQESSKIPESSSDKVAGDIFLVEGTNNNSQSSSCNGALESTARHDEESHSLSPPGENTVMADSFQIKVNLMTVEALEEGDYFEAIPLKASKFNSDLIDFASTSQAFNKVPSPHETKPDEDAEAFENHAEKLGKRSIKSAHKKKDSPEPQVKMDKHEPHQDSGEEAEGCPSAPEETPVDKKPEVHEKAKRKSTRPHYEEEGEDDDLQGVGEELSSSPPSSCVSLETLGSHSEEGLDFKPSPPLSKVSVIPHDLFYFPHYEVPLAAVLEAYVEDPEDLKNEEMDLEEPEGYMPDLDSREEEADGSQSSSSSSVPGESLPSASDQVLYLSRGGVGTTPASEPAPLAPHEDHQQRETKENDPMDSHQSQESPNLENIANPLEENVTKESISSKKKEKRKHVDHVESSLFVAPGSVQSSDDLEEDSSDYSIPSRTSHSDSSIYLRRHTHRSSESDHFSYVQLRNAADLDDRRNRILTRKANSSGEAMSLGSHSPQSDSLTQLVQQPDMMYFILFLWLLVYCLLLFPQLDVSRL

SEQ ID NO: 55342 - protein, 633 aa, Homo sapiens
MSAGSERGAAATPGGLPAPCASKVELRLSCRHLLDRDPLTKSDPSVALLQQAQGQWVQVGRTEVVRSSLHPVFSKVFTVDYYFEEVQRLRFEVYDTHGPSGFSCQEDDFLGGMECTLGQPAQKWLLQVVMRVSVDVLGPAGHCAKHFLCCTESSHLARTGPSFLLRYDDLCLPWATAGAVRWWTCRGGHTQGWQIVAQKKVTRPLLLKFGRNAGKSTITVIAEDISGNNGYVELSFRARKLDDKDLFSKSDPFLELYRVNDDQGLQLVYRTEVVKNNLNPVWEAFKVSLSSLCSCEETRPLKCLVWDYDSRGKHDFIGEFSTTFEEMQKAFEEGQAQWDCVNPKYKQKRRSYKNSGVVVLADLKFHRVYSFLDYIMGGCQIHFTVAIDFTASNGDPRNSCSLHYINPYQPNEYLKALVSVGEICQDYDSDKRFSALGFGARIPPKYEVSHDFAINFNPEDDECEGIQGVVEAYQNCLPRVQLYGPTNVAPIISKVARVAAAEESTGKASQYYILLILTDGVVTDMADTREAIVRASRLPMSIIIVGVGNADFTDMQVLDGDDGVLRSPRGEPALRDIVQFVPFRELKNASPAALAKCVLAEVPKQVVEYYSHRGLPPRSLGVPAGEASPGCTP

SEQ ID NO: 55343 - protein, 558 aa, Homo sapiens
MSAGSERGAAATPGGLPAPCASKVELRLSCRHLLDRDPLTKSDPSVALLQQAQGQWVQVGRTEVVRSSLHPVFSKVFTVDYYFEEVQRLRFEVYDTHGPSGFSCQEDDFLGGMECTLGQIVAQKKVTRPLLLKFGRNAGKSTITVIAEDISGNNGYVELSFRARKLDDKDLFSKSDPFLELYRVNDDQGLQLVYRTEVVKNNLNPVWEAFKVSLSSLCSCEETRPLKCLVWDYDSRGKHDFIGEFSTTFEEMQKAFEEGQAQWDCVNPKYKQKRRSYKNSGVVVLADLKFHRVYSFLDYIMGGCQIHFTVAIDFTASNGDPRNSCSLHYINPYQPNEYLKALVSVGEICQDYDSDKRFSALGFGARIPPKYEVSHDFAINFNPEDDECEGIQGVVEAYQNCLPRVQLYGPTNVAPIISKVARVAAAEESTGKASQYYILLILTDGVVTDMADTREAIVRASRLPMSIIIVGVGNADFTDMQVLDGDDGVLRSPRGEPALRDIVQFVPFRELKNASPAALAKCVLAEVPKQVVEYYSHRGLPPRSLGVPAGEASPGCTP

SEQ ID NO: 55344 - protein, 173 aa, Homo sapiens
MDVTIQHPWFKRTLGPFYPSRLFDQFFGEGLFEYDLLPFLSSTISPYYRQSLFRTVLDSGISEVRSDRDKFVIFLDVKHFSPEDLTVKVQDDFVEIHGKHNERQDDHGYISREFHRRYRLPSNVDQSALSCSLSADGMLTFCGPKIQTGLDATHAERAIPVSREEKPTSAPSS

SEQ ID NO: 55345 - protein, 412 aa, Homo sapiens
MQPSSLLPLALCLLAAPASALVRIPLHKFTSIRRTMSEVGGSVEDLIAKGPVSKYSQAVPAVTEGPIPEVLKNYMDAQYYGEIGIGTPPQCFTVVFDTGSSNLWVPSIHCKLLDIACWIHHKYNSDKSSTYVKNGTSFDIHYGSGSLSGYLSQDTVSVPCQSASSASALGGVKVERQVFGEATKQPGITFIAAKFDGILGMAYPRISVNNVLPVFDNLMQQKLVDQNIFSFYLSRDPDAQPGGELMLGGTDSKYYKGSLSYLNVTRKAYWQVHLDQVEVASGLTLCKEGCEAIVDTGTSLMVGPVDEVRELQKAIGAVPLIQGEYMIPCEKVSTLPAITLKLGGKGYKLSPEDYTLKVSQAGKTLCLSGFMGMDIPPPSGPLWILGDVFIGRYYTVFDRDNNRVGFAEAARL

SEQ ID NO: 55346 - protein, 514 aa, Homo sapiens
MSSPISKSRSLAAFLQQLRSPRQPPRLVTSTAYTSPQPREVPVCPLTAGGETQNAAALPGPTSWPLLGSLLQILWKGGLKKQHDTLVEYHKKYGKIFRMKLGSFESVHLGSPCLLEALYRTESAYPQRLEIKPWKAYRDYRKEGYGLLILEGEDWQRVRSAFQKKLMKPGEVMKLDNKINEVLADFMGRIDELCDERGHVEDLYSELNKWSFESICLVLYEKRFGLLQKNAGDEAVNFIMAIKTMMSTFGRMMVTPVELHKSLNTKVWQDHTLAWDTIFKSVKACIDNRLEKYSQQPSADFLCDIYHQNRLSKKELYAAVTELQLAAVETTANSLMWILYNLSRNPQVQQKLLKEIQSVLPENQVPRAEDLRNMPYLKACLKESMRLTPSVPFTTRTLDKATVLGEYALPKGTVLMLNTQVLGSSEDNFEDSSQFRPERWLQEKEKINPFAHLPFGVGKRMCIGRRLAELQLHLALCWIVRKYDIQATDNEPVEMLHSGTLVPSRELPIAFCQR

SEQ ID NO: 55347 - protein, 846 aa, Homo sapiens
MSSSHFASRHRKDISTEMIRTKIAHRKSLSQKENRHKEYERNRHFGLKDVNIPTLEGRILVELDETSQELVPEKTNVKPRAMKTILGDQRKQMLQKYKEEKQLQKLKEQREKAKRGIFKVGRYRPDMPCFLLSNQNAVKAEPKKAIPSSVRITRSKAKDQMEQTKIDNESDVRAIRPGPRQTSEKKVSDKEKKVVQPVMPTSLRMTRSATQAAKQVPRTVSSTTARKPVTRAANENEPEGKVPSKGRPAKNVETKPDKGISCKVDSEENTLNSQTNATSGMNPDGVLSKMENLPEINTAKIKGKNSFAPKDFMFQPLDGLKTYQVTPMTPRSANAFLTPSYTWTPLKTEVDESQATKEILAQKCKTYSTKTIQQDSNKLPCPLGPLTVWHEEHVLNKNEATTKNLNGLPIKEVPSLERNEGRIAQPHHGVPYFRNILQSETEKLTSHCFEWDRKLELDIPDDAKDLIRTAVGQTRLLMKERFKQFEGLVDDCEYKRGIKETTCTDLDGFWDMVSFQIEDVIHKFNNLIKLEESGWQVNNNMNHNMNKNVFRKKVVSGIASKPKQDDAGRIAARNRLAAIKNAMRERIRQEECAETAVSVIPKEVDKIVFDAGFFRVESPVKLFSGLSVSSEGPSQRLGTPKSVNKAVSQSRNEMGIPQQTTSPENAGPQNTKSEHVKKTLFLSIPESRSSIEDAQCPGLPDLIEENHVVNKTDLKVDCLSSERMSLPLLAGGVADDINTNKKEGISDVVEGMELNSSITSQDVLMSSPEKNTASQNSILEEGETKISQSELFDNKSLTTECHLLDSPGLNCSNPFTQLERRHQEHARHISFGGNLITFSPLQPGEF

SEQ ID NO: 55348 - protein, 190 aa, Homo sapiens
MEPEAAAGARKARGRGCHCPGDAPWRPPPPRGPESPAPWRPWIQTPGDAELTRTGRPLEPRADQHTFGSKGAFGFQHPVRVYLPMSKRQEYLRSSGEQVLASFPVQATIDFYDDESTESASEAEEPEEGPPPLHLLPQEVGGRQENGPGGKGRDQGINQGQRSSGGGDHWGEGPLPQGVSSRGGKCSSSK

SEQ ID NO: 55349 - protein, 257 aa, Homo sapiens
MFQPAAKRGFTIESLVAKDGGTGGGTGGGGAGSHLLAAAASEEPLRPTALNYPHPSAAEAAFVSGFPAAAAAGAGRSLYGGPELVFPEAMNHPALTVHPAHQLGASPLQPPHSFFGAQHRDPLHFYPWVLRNRFFGHRFQASDVPQDGLLLHGPFARKPKRIRTAFSPSQLLRLERAFEKNHYVVGAERKQLAGSLSLSETQVKVWFQNRRTKYKRQKLEEEGPESEQKKKGSHHINRWRIATKQANGEDIDVTSND

SEQ ID NO: 55350 - protein, 238 aa, Homo sapiens
MASRWQNMGTSVRRRSLQHQEQLEDSKELQPVVSHQETSVGALGSLCRQFQRRLPLRTVNLNLRAGPSWKRLETPEPGQQGLQAAARSAKSALGAVSQRIQESCQSGTKWLVETQVKARRRKRGAQKGSGSPTHSLSQKSTRLSGAAPAHSAADPWEKEHHRLSVRMGSHAHPLRRSRREAAFRSPYSSTEPLCSPSESDSDLEPVGAGIQHLQKLSQELDEAIMAEESGDIVSLIHD

SEQ ID NO: 55351 - protein, 534 aa, Homo sapiens
MDGEATVKPGEQVPLWTHGWPPDDPSPSFAAGSSFALPQKRPHPRWLWEGSLPSRTHLRAMGTLRPSSPLCWREESSFAAPNSLKGSRLVSGEPGGAVTIQCHYAPSSVNRHQRKYWCRLGPPRWICQTIVSTNQYTHHRYRDRVALTDFPQRGLFVVRLSQLSPDDIGCYLCGIGSENNMLFLSMNLTISAGPASTLPTATPAAGELTMRSYGTASPVANRWTPGTTQTLGQGTAWDTVASTPGTSKTTASAEGRRTPGATRPAAPGTGSWAEGSVKAPAPIPESPPSKSRSMSNTTEGVWEGTRSSVTNRARASKDRREMTTTKADRPREDIEGVRIALDAAKKVLGTIGPPALVSETLAWEILPQATPVSKQQSQGSIGETTPAAGMWTLGTPAADVWITSMEAASGEGSAAGDLDAATGDRGPQATLSQTPAVGPWGPPGKESSVKRATCPGLSTLKEIKVSAVLTQNPHSLLCVSAAQEAERVTLIQMTHFLEVNPQADQLPHVERKMLQDDSLPAGASLTAPERNPGP

SEQ ID NO: 55352 - protein, 373 aa, Homo sapiens
MTAESGPPPPQPEVLATVKEERGETAAGAGVPGEATGRGAGGRRRKRPLQRGKPPYSYIALIAMAIAHAPERRLTLGGIYKFITERFPFYRDNPKKWQNSIRHNLTLNDCFLKIPREAGRPGKGNYWALDPNAEDMFESGSFLRRRKRFKRSDLSTYPAYMHDAAAAAAAAAAAAAAAAIFPGAVPAARPPYPGAVYAGYAPPSLAAPPPVYYPAASPGPCRVFGLVPERPLSPELGPAPSGPGGSCAFASAGAPATTTGYQPAGCTGARPANPSAYAAAYAGPDGAYPQGAGSAIFAAAGRLAGPASPPAGGSSGGVETTVDFYGRTSPGQFGALGACYNPGGQLGGASAGAYHARHAAAYPGGIDRFVSAM

SEQ ID NO: 55353 - protein, 378 aa, Homo sapiens
MSSFDLPAPSPPRCSPQFPSIGQEPPEMNLYYENFFHPQGVPSPQRPSFEGGGEYGATPNPYLWFNGPTMTPPPYLPGPNASPFLPQAYGVQRPLLPSVSGLGGSDLGWLPIPSQEELMKLVRPPYSYSALIAMAIHGAPDKRLTLSQIYQYVADNFPFYNKSKAGWQNSIRHNLSLNDCFKKVPRDEDDPGKGNYWTLDPNCEKMFDNGNFRRKRKRKSDVSSSTASLALEKTESSLPVDSPKTTEPQDILDGASPGGTTSSPEKRPSPPPSGAPCLNSFLSSMTAYVSGGSPTSHPLVTPGLSPEPSDKTGQNSLTFNSFSPLTNLSNHSGGGDWANPMPTNMLSYGGSVLSQFSPHFYNSVNTSGVLYPREGTEV

SEQ ID NO: 55354 - protein, 283 aa, Homo sapiens
MSSFDLPAPSPPRCSPQFPSIGQEPPEMNLYYENFFHPQGVPSPQRPSFEGGGEYGATPNPYLWFNGPTMTPPPYLPGPNASPFLPQAYGVQRPLLPSVSGLGGSDLGWLPIPSQEELMKLVRPPYSYSALIAMAIHGAPDKRLTLSQIYQYVADNFPFYNKSKAGWQNSIRHNLSLNDCFKKVPRDEDDPAYVSGGSPTSHPLVTPGLSPEPSDKTGQNSLTFNSFSPLTNLSNHSGGGDWANPMPTNMLSYGGSVLSQFSPHFYNSVNTSGVLYPREGTEV

SEQ ID NO: 55355 - protein, 552 aa, Homo sapiens
MRRLTRRLVLPVFGVLWITVLLFFWVTKRKLEVPTGPEVQTPKPSDADWDDLWDQFDERRYLNAKKWRVGDDPYKLYAFNQRESERISSNRAIPDTRHLRCTLLVYCTDLPPTSIIITFHNEARSTLLRTIRSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQRQNNQETPNLKLSPCAKVKGEDAKSQVWAFTYTQQILQEELCLSVITLFPGAPVVLVLCKNGDDRQQWTKTGSHIEHIASHLCLDTDMFGDGTENGKEIVVNPCESSLMSQHWDMVSS

SEQ ID NO: 55356 - protein, 217 aa, Homo sapiens
MAYPGYGGGFGNFSIQVPGMQMGQPVPETGPAILLDGYSGPAYSDTYSSAGDSVYTYFSAVAGQDGEVDAEELQRCLTQSGINGTYSPFSLETCRIMIAMLDRDHTGKMGFNAFKELWAALNAWKENFMTVDQDGSGTVEHHELRQAIGLMGYRLSPQTLTTIVKRYSKNGRIFFDDYVACCVKLRALTDFFRKRDHLQQGSANFIYDDFLQGTMAI

SEQ ID NO: 55357 - protein, 1020 aa, Homo sapiens
MQSCARAWGLRLGRGVGGGRRLAGGSGPCWAPRSRDSSSGGGDSAAAGASRLLERLLPRHDDFARRHIGPGDKDQREMLQTLGLASIDELIEKTVPANIRLKRPLKMEDPVCENEILATLHAISSKNQIWRSYIGMGYYNCSVPQTILRNLLENSGWITQYTPYQPEVSQGRLESLLNYQTMVCDITGLDMANASLLDEGTAAAEALQLCYRHNKRRKFLVDPRCHPQTIAVVQTRAKYTGVLTELKLPCEMDFSGKDVSGVLFQYPDTEGKVEDFTELVERAHQSGSLACCATDLLALCILRPPGEFGVDIALGSSQRFGVPLGYGGPHAAFFAVRESLVRMMPGRMVGVTRDATGKEVYRLALQTREQHIRRDKATSNICTAQALLANMAAMFRIYHGSHGLEHIARRVHNATLILSEGLKRAGHQLQHDLFFDTLKIHCGCSVKEVLGRAAQRQINFRLFEDGTLGISLDETVNEKDLDDLLWIFGCESSAELVAESMGEECRGIPGSVFKRTSPFLTHQVFNSYHSETNIVRYMKKLENKDISLVHSMIPLGSCTMKLNSSSELAPITWKEFANIHPFVPLDQAQGYQQLFRELEKDLCELTGYDQVCFQPNSGAQGEYAGLATIRAYLNQKGEGHRTVCLIPKSAHGTNPASAHMAGMKIQPVEVDKYGNIDAVHLKAMVDKHKENLAAIMITYPSTNGVFEENISDVCDLIHQHGGQVYLDGANMNAQVGICRPGDFGSDVSHLNLHKTFCIPHGGGGPGMGPIGVKKHLAPFLPNHPVISLKRNEDACPVGTVSAAPWGSSSILPISWAYIKMMGGKGLKQATETAILNANYMAKRLETHYRILFRGARGYVGHEFILDTRPFKKSANIEAVDVAKRLQDYGFHAPTMSWPVAGTLMVEPTESEDKAELDRFCDAMISIRQEIADIEEGRIDPRVNPLKMSPHSLTCVTSSHWDRPYSREVAAFPLPFMKPENKFWPTIARIDDIYGDQHLVCTCPPMEVYESPFSEQKRASS

SEQ ID NO: 55358 - protein, 720 aa, Homo sapiens
MDDPKKEDILLLADEKFDFDLSLSSSSANEDDEVFFGPFGHKERCIAASLELNNPVPEQPPLPTSESPFAWSPLAGEKFVEVYKEAHLLALHIESSSRNQAAQAAKPEDPRSQGVERFIQESKLKINLFEKEKEMKKSPTSLKRETYYLSDSPLLGPPVGEPRLLASSPALPSSGAQARLTRAPGPPHSAHALPRESCTAHAASQAATQRKPGTKLLLPRAASVRGRSIPGAAEKPKKEIPASPSRTKIPAEKESHRDVLPDKPAPGAVNVPAAGSHLGQGKRAIPVPNKLGLKKTLLKAPGSTSNLARKSSSGPVWSGASSACTSPAVGKAKSSEFASIPANSSRPLSNISKSGRMGPAMLRPALPAGPVGASSWQAKRVDVSELAAEQLTAPPSASPTQPQTPEGGGQWLNSSCAWSESSQLNKTRSIRRRDSCLNSKTKVMPTPTNQFKIPKFSIGDSPDSSTPKLSRAQRPQSCTSVGRVTVHSTPVRRSSGPAPQSLLSARRVSALPTPASRRCSGLPPMTPKTMPRAVGSPLCVPARRRSSEPRKNSAMRTEPTRESNRKTDSRLVDVSPDRGSPPSRVPQALNFSPEESDSTFSKSTATEVAREEAKPGGDAAPSEALLVDIKLEPLAVTPDAASQPLIDLPLIDFCDTPEAHVAVGSESRPLIDLMTNTPDMNKNVAKPSPVVGQLIDLSSPLIQLSPEADKENVDSPLLKF

SEQ ID NO: 55359 - protein, 359 aa, Homo sapiens
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPTTTVPTTMSIPTTTTVPTTMTVSTTTSVPTTTSIPTTTSVPVTTTVSTFVPPMPLPRQNHEPVATSPSSPQPAETHPTTLQGAIRREPTSSPLYSYTTDGNDTVTESSDGLWNNNQTQLFLEHSLLTANTTKGIYAGVCISVLVLLALLGVIIAKKYFFKKEVQQLSVSFSSLQIKALQNAVEKEVQAEDNIYIENSLYATD

SEQ ID NO: 55360 - protein, 224 aa, Homo sapiens
MAPPAAPGRDRVGREDEDGWETRGDRKARKPLVEKKRRARINESLQELRLLLAGAEVQAKLENAEVLELTVRRVQGVLRGRAREREQLQAEASERFAAGYIQCMHEVHTFVSTCQAIDATVAAELLNHLLESMPLREGSSFQDLLGDALAGPPRAPGRSGWPAGGAPGSPIPSPPGPGDDLCSDLEEAPEAELSQAPAEGPDLVPAALGSLTTAQIARSVWRPW

SEQ ID NO: 55361 - protein, 250 aa, Homo sapiens
MSISGTLSSYYVDSIISHESEDAPPAKFPSGQYASSRQPGHAEHLEFPSCSFQPKAPVFGASWAPLSPHASGSLPSVYHPYIQPQGVPPAESRYLRTWLEPAPRGEAAPGQGQAAVKAEPLLGAPGELLKQGTPEYSLETSAGREAVLSNQRPGYGDNKICEGSEDKERPDQTNPSANWLHARSSRKKRCPYTKYQTLELEKEFLFNMYLTRDRRHEVARLLNLSERQVKIWFQNRRMKMKKMNKEQGKE

SEQ ID NO: 55362 - protein, 1051 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRARTRALYEAKRQKAEMKSQPSETERLTDDY

SEQ ID NO: 55363 - protein, 1066 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCDFFKRTRYYQIMPKYHAVRIREEERYPPPGSTLPTKKHWVTSWQTRDQYY

SEQ ID NO: 55364 - protein, 769 aa, Homo sapiens
MCGSALAFFTAAFVCLQNDRRGPASFLWAAWVFSLVLGLGQGEDNRCASSNAASCARCLALGPECGWCVQEDFISGGSRSERCDIVSNLISKGCSVDSIEYPSVHVIIPTENEINTQVTPGEVSIQLRPGAEANFMLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVLFNVTVTMKKCDVTGGKNYAIIKPIGFNETAKIHIHRNCSCQCEDNRGPKGKCVDETFLDSKCFQCDENKCHFDEDQFSSESCKSHKDQPVCSGRGVCVCGKCSCHKIKLGKVYGKYCEKDDFSCPYHHGNLCAGHGECEAGRCQCFSGWEGDRCQCPSAAAQHCVNSKGQVCSGRGTCVCGRCECTDPRSIGRFCEHCPTCYTACKENWNCMQCLHPHNLSQAILDQCKTSCALMEQQHYVDQTSECFSSPSYLRIFFIIFIVTFLIGLLKVLIIRQVILQWNSNKIKSSSDYRVSASKKDKLILQSVCTRAVTYRREKPEEIKMDISKLNAHETFRCNF

SEQ ID NO: 55365 - protein, 84 aa, Homo sapiens
MDDDAAPRVEGVPVAVHKHALHDGLRQVAGPGAAAAHLPRWPPPQLAASRREAPPLSQRPHRTQGAGSPPETNEKLTNPQVKEK

SEQ ID NO: 55366 - protein, 391 aa, Homo sapiens
MNASSRNVFDTLIRVLTESMFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIFLLIFQSILGVIINSFMCGAILAKISRPKKRAKTITFSKNAVISKRGGKLCLLIRVANLRKSLLIGSHIYGKLLKTTVTPEGETIILDQININFVVDAGNENLFFISPLTIYHVIDHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 55367 - protein, 372 aa, Homo sapiens
MFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIFLLIFQSILGVIINSFMCGAILAKISRPKKRAKTITFSKNAVISKRGGKLCLLIRVANLRKSLLIGSHIYGKLLKTTVTPEGETIILDQININFVVDAGNENLFFISPLTIYHVIDHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 55368 - protein, 389 aa, Homo sapiens
MPTVYLCSEQIRVLTESMFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIFLLIFQSILGVIINSFMCGAILAKISRPKKRAKTITFSKNAVISKRGGKLCLLIRVANLRKSLLIGSHIYGKLLKTTVTPEGETIILDQININFVVDAGNENLFFISPLTIYHVIDHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 55369 - protein, 372 aa, Homo sapiens; identical to SEQ ID NO: 55367

SEQ ID NO: 55370 - protein, 372 aa, Homo sapiens; identical to SEQ ID NO: 55367

SEQ ID NO: 55371 - protein, 375 aa, Homo sapiens
MDAIHIGMSSTPLVKHTAGAGLKANRPRVMSKSGHSNVRIDKVDGIYLLYLQDLWTTVIDMKWRYKLTLFAATFVMTWFLFGVIYYAIAFIHGDLEPGEPISNHTPCIMKVDSLTGAFLFSLESQTTIGYGVRSITEECPHAIFLLVAQLVITTLIEIFITGTFLAKIARPKKRAETIKFSHCAVITKQNGKLCLVIQVANMRKSLLIQCQLSGKLLQTHVTKEGERILLNQATVKFHVDSSSESPFLILPMTFYHVLDETSPLRDLTPQNLKEKEFELVVLLNATVESTSAVCQSRTSYIPEEIYWGFEFVPVVSLSKNGKYVADFSQFEQIRKSPDCTFYCADSEKQQLEEKYRQEDQRERELRTLLLQQSNV

SEQ ID NO: 55372 - protein, 375 aa, Homo sapiens; identical to SEQ ID NO: 55371

SEQ ID NO: 55373 - protein, 375 aa, Homo sapiens; identical to SEQ ID NO: 55371

SEQ ID NO: 55374 - protein, 418 aa, Homo sapiens
MSYYGSSYHIINADAKYPGYPPEHIIAEKRRARRRLLHKDGSCNVYFKHIFGEWGSYVVDIFTTLVDTKWRHMFVIFSLSYILSWLIFGSVFWLIAFHHGDLLNDPDITPCVDNVHSFTGAFLFSLETQTTIGYGYRCVTEECSVAVLMVILQSILSCIINTFIIGAALAKMATARKRAQTIRFSYFALIGMRDGKLCLMWRIGDFRPNHVVEGTVRAQLLRYTEDSEGRMTMAFKDLKLVNDQIILVTPVTIVHEIDHESPLYALDRKAVAKDNFEILVTFIYTGDSTGTSHQSRSSYVPREILWGHRFNDVLEVKRKYYKVNCLQFEGSVEVYAPFCSAKQLDWKDQQLHIEKAPPVRESCTSDTKARRRSFSAVAIVSSCENPEETTTSATHEYRETPYQKALLTLNRISVESQM

SEQ ID NO: 55375 - protein, 418 aa, Homo sapiens; identical to SEQ ID NO: 55374

SEQ ID NO: 55376 - protein, 418 aa, Homo sapiens; identical to SEQ ID NO: 55374

SEQ ID NO: 55377 - protein, 464 aa, Homo sapiens
  VARIANT 79,150,159,205,208,254,301,354,379: Xaa = Any Amino Acid
MSIRVIQKSYKVSTFGPQAFSSHPYTSGPSACTSSLSFSLVGSFTVQLLGWPGRRLWWGQQYARHHHHHGKPEPAEPPXPGGGLQHPGCIHPGEGADQDPQQQVCLLHRPGMVPGAAEQGAGDQVEPSAAAQDGWEQHGQHVRELYQQPXAAAGARRSXGWKRSLATCRGWWRTSGTSMRMRSISLQRWRINLSSSRRMWMKLTXTTXSWSLTWKGRLYEVEIRELQSQISNMSVVLSMDSSHSWTWTASSLRXRGSTRRLPTAAGLRLRARTRSSMWSCRRWLGSTGMTCGIQRLRSPRXTGTSASSRLRLRASKARGLPWRPPSQMLSIVGSWPLRMPMPSSPSWRPLCNVXVPGADESQAGLEMEVATYRKLRESXESQLESGMQNMSIHTKTTSGYAGDLSSAYVGLTTRDLSYGLGSSFGSGTGFSSFRCTSSTRAVVVKKIETRDGKLVSESSDFLPK

SEQ ID NO: 55378 - protein, 464 aa, Homo sapiens; identical to SEQ ID NO: 55377
  VARIANT 79,150,159,205,208,254,301,354,379: Xaa = Any Amino Acid

SEQ ID NO: 55379 - protein, 493 aa, Homo sapiens
MTCGFNSIGCGFRPGNFSCVSACGPRPSRCCITAAPYRGISCYRGLTGGFGSHSVCGGFRAGSCGRSFGYRSGGVCGPSPPCITTVSVNESLLTPLNLEIDPNAQCVKQEEKEQIKSLNSRFAAFIDKVRFLEQQNKLLETKLQFYQNCECCQSNLEPLFAGYIETLRREAECVEADSGRLASELNHVQEVLEGYKKKYEEEVALRATAENEFVALKKDVDCAYLRKSDLEANVEALIQEIDFLRRLYEEEIRILQSHISDTSVVVKLDNSRDLNMDCIVAEIKAQYDDIATRSRAEAESWYRSKCEEMKATVIRHGETLRRTKEEINELNRMIQRLTAEVENAKCQNSKLEAAVAQSEQQGEAALSDARCKLAELEGALQKAKQDMACLIREYQEVMNSKLGLDIEIATYRRLLEGEEQRLCEGVEAVNVCVSSSRGGVVCGDLCVSGSRPVTGSVCSAPCNGNLVVSTGLCKPCGQLNTTCGGGSCGQGRY

SEQ ID NO: 55380 - protein, 1257 aa, Homo sapiens
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYRSLESDNEEKAFGSSQPSLNGDIKPLGSDDSLADYGGSVDVQFNEDGSFIGQYSGKKEKEAAGGNDSSGATSPINPAVALE

SEQ ID NO: 55381 - protein, 1253 aa, Homo sapiens
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYSDNEEKAFGSSQPSLNGDIKPLGSDDSLADYGGSVDVQFNEDGSFIGQYSGKKEKEAAGGNDSSGATSPINPAVALE

SEQ ID NO: 55382 - protein, 202 aa, Homo sapiens
MKVLAAGVVPLLLVLHWKHGAGSPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGPDTSGKDVFQKKKLGCQLLGKYKQIIAVLAQAF

SEQ ID NO: 55383 - protein, 78 aa, Homo sapiens [sequence omitted]

SEQ ID NO: 55384 - protein, 78 aa, Homo sapiens [sequence omitted]

SEQ ID NO: 55385 - protein, 174 aa, Homo sapiens [sequence omitted]

SEQ ID NO: 55386 - protein, 262 aa, Homo sapiens
MCGPRRLAAPGSSLGSFGRASRGGRRGSSGGRAAEPGLGDTMRRVLRLLLGCFLTELCARVCRAQERAGHGQLAQLGGVLLLAGGNRSGAASGEASEGAEASDAPPTRAPTPDFCRGYFDVMGQWDPPFNCSSGDFIFCCGTCGFRFCCTFKKRRLNQSTCTNYDTPLWLNTGKPPARKDDPLHDPTKDKTNLIVYIICGVVAVMVLVGIFTKLGLEKAHRPQREHMSRLYDNLLFMEAQISFQEDEPAPGEWSVGLQTWTV

SEQ ID NO: 55387 - protein, 90 aa, Homo sapiens
MIQRALLGRKLPRWNPSPEKQVAGPRRGLTQWLNTRKELALGVQTSKIWYRALDPPQSAEIISPGPVDQPAGHRPSDPNDPAMRPHCQWR

SEQ ID NO: 55388 - protein, 46 aa, Homo sapiens
MVAEGKADRTGGGGSSRPERTRRSLEGAIDGTIGGAQELWAPEVSS

SEQ ID NO: 55389 - protein, 88 aa, Homo sapiens
MERLARAACSRPPRKINTVAEHQEGTGTWSPDIYNLAQPPRPPLNISRLGAVRGWEQLCQPLQSDSEEDDKPCSGHTRKLTGSRMAEA

SEQ ID NO: 55390 - protein, 309 aa, Homo sapiens
MLRYIATLRRTRKALDEEDVGCCQHLCTDRQKVLCFLQALASTSPGLPAEPAFFFDFPLLPGVFSKHTQRITGRKLSYYQVDMAPKVPTEHSNSDEARGAAVSPRLSFAGTGMHRRWLSGRKIPFHFVLSLPPQGSQPPLGSAGPDPVPAALHGHSRIRCRSSRHPQEPPGPSRRRRRGPDPHTMPSEKTFKQRRTFEQRVEDVRLIREQHPTKIPVIIERYKGEKQLPVLDKTKFLVPDHVNMSELIKIIRRRLQLNANQAFFLLVNGHSMVSVSTPISEVYESEKDEDGFLYMVCASQETFGMKLSV

SEQ ID NO: 55391 - protein, 96 aa, Homo sapiens [sequence omitted]

SEQ ID NO: 55392 - protein, 424 aa, Homo sapiens
MGGITAVMVNQSLLSPLVLEVDPNIQAVCTQEKEQIKTLNNKFASFTDKVRFLEQQNKMLETKWSLLQQQKMARSNMDNMFESYINNLRRQLETLGQEKLKLEAELGNMQRLVEDFKNKYEDEINKHTEMENEFVLIKKDVDEAYMNKVELESRLEGLTDEINFLRQLYEKEIRELQSQISDTSVVLSMDNSRSLDMDSIIAEVKAQYEDIANQRRAEAESMYQIKYEELQSLAGKHGDDLWRTKTEISEMNWNISQLQAEIEGLKGQRASLEAAIADAEQRGELAIKDANAKLSELEAALQRAKQDMARQLREYQELMNVKLALDIEIATYRKLLEGKESRLKSGMQNMSIHTKTTSGYAGGLSSAYGGLTSPGLSYGLGSSFGSGAGSSSLSRTSSSRAVVVKKIETCDGKLVSESSDILPK

SEQ ID NO: 55393 - protein, 279 aa, Homo sapiens
MNKVELESRLEGLTDEINFLRQLYEKEIRELQSQISDTSVVLSMDNSRSLDMDSIIAEVKAQYEDIANQRRAEAESMYQIKYEELQSLAGKHGDDLWRTKTEISEMNWNISQLQAEIEGLKGQRASLEAAIADAEQRGELAIKDANAKLSELEAALQRAKQDMARQLREYQELMNVKLALDIEIATYRKLLEGKESRLKSGMQNMSIHTKTTSGYAGGLSSAYGGLTSPGLSYGLGSSFGSGAGSSSLSRTSSSRAVVVKKIETCDGKLVSESSDILPK

SEQ ID NO: 55394 - protein, 295 aa, Homo sapiens
MENEFVLIKKDVDEAYMNKVELESRLEGLTDEINFLRQLYEKEIRELQSQISDTSVVLSMDNSRSLDMDSIIAEVKAQYEDIANQRRAEAESMYQIKYEELQSLAGKHGDDLWRTKTEISEMNWNISQLQAEIEGLKGQRASLEAAIADAEQRGELAIKDANAKLSELEAALQRAKQDMARQLREYQELMNVKLALDIEIATYRKLLEGKESRLKSGMQNMSIHTKTTSGYAGGLSSAYGGLTSPGLSYGLGSSFGSGAGSSSLSRTSSSRAVVVKKIETCDGKLVSESSDILPK

SEQ ID NO: 55395 - protein, 179 aa, Homo sapiens
MGGITAVMVNQSLLSPLVLEVDPNIQAVCTQEKEQIKTLNNKFASFTDKVRFLEQQNKMLETKWSLLQQQKMARSNMDNMFESYINNLRRQLETLGQEKLKLEAELGNMQRLVEDFKNKYEDEINKHTEMENEFVLIKKDVDEAYMNKVELESRLEGLTDEINFLRQLYEKEIPPEAQP

SEQ ID NO: 55396 - protein, 408 aa, Homo sapiens
MSIRVDPNIQAVCTQEKEQIKTLNNKFASFTDKVRFLEQQNKMLETKWSLLQQQKMARSNMDNMFESYINNLRRQLETLGQEKLKLEAELGNMQRLVEDFKNKYEDEINKHTEMENEFVLIKKDVDEAYMNKVELESRLEGLTDEINFLRQLYEKEIRELQSQISDTSVVLSMDNSRSLDMDSIIAEVKAQYEDIANQRRAEAESMYQIKYEELQSLAGKHGDDLWRTKTEISEMNWNISQLQAEIEGLKGQRASLEAAIADAEQRGELAIKDANAKLSELEAALQRAKQDMARQLREYQELMNVKLALDIEIATYRKLLEGKESRLKSGMQNMSIHTKTTSGYAGGLSSAYGGLTSPGLSYGLGSSFGSGAGSSSLSRTSSSRAVVVKKIETCDGKLVSESSDILPK

SEQ ID NO: 55397 - protein, 393 aa, Homo sapiens
MGGITAVMVNQSLLSPLVLEVDPNIQAVCTQEKEQIKTLNNKFASFTDKVRFLEQQNKMLETKWSLLQQQKMARSNMDNMFESYINNLRRQLETLGQEKLKLEAELGNMQRLVEDFKNKYEDEINKHTEMENEFVLIKKDVDEAYMNKVELESRLEGLTDEINFLRQLIIAEVKAQYEDIANQRRAEAESMYQIKYEELQSLAGKHGDDLWRTKTEISEMNWNISQLQAEIEGLKGQRASLEAAIADAEQRGELAIKDANAKLSELEAALQRAKQDMARQLREYQELMNVKLALDIEIATYRKLLEGKESRLKSGMQNMSIHTKTTSGYAGGLSSAYGGLTSPGLSYGLGSSFGSGAGSSSLSRTSSSRAVVVKKIETCDGKLVSESSDILPK

SEQ ID NO: 55398 - protein, 270 aa, Homo sapiens
MGGITAVMVNQSLLSPLVLEVDPNIQAVCTQEKEQIKTLNNKFASFTDKVRFLEQQNKMLETKWSLLQQQKMARSNMDNMFESYINNLRRQLETLGQEKLKLEAELGNMQRLVEDFKNKYEDEINKHTEMENEFVLIKKDVDEAYMNKVELESRLEGLTDEINFLRQLYEKEIRELQSQISDTSVVLSMDNSRSLDMDSIIAEVKAQYEDIANQRRAEAESMYQIKYEELQSLAGKHGDDLWRTKTEISEMNWNISQLQAEIEGLKGQVV

SEQ ID NO: 55399 - protein, 163 aa, Homo sapiens
MSSCPVHDCPSWDPERLEPVETGSRGALRLRGGAPGSAAGFRASIWGPAGYPSPVGLGHPASLPRPAYSPRCPEPDARHGWGSGSNAGYRGPDRAGTPCPAQDREGRSSSPVPPPRLKAMTSQARKQNGGALIDTVDWTREAPDSDPVMSMQKTQKPQTTVGQ

SEQ ID NO: 55400 - protein, 93 aa, Homo sapiens
MQIKAIKLQMILQMEPQMSSAHGFYRGPLDQPAGPSITLENSPLEDTKLQGPFFTPNQQEVARTTATRFPTAVGVSCLEAGLRGGASWASWVK

SEQ ID NO: 55401 - protein, 129 aa, Homo sapiens
MVGRFCPESPPGFVRVAATSAVSLDPPSGEPRPGCGYPGPRSAASRVYGCTAPARETGGWAWETLAGAGAKKIYSSETTTGTSSNSSQSTSNSGLAPNPTNATTKAAGGALQSTASLFVVSLSLLHLYS

SEQ ID NO: 55402 - protein, 129 aa, Homo sapiens; identical to SEQ ID NO: 55401

SEQ ID NO: 55403 - protein, 129 aa, Homo sapiens; identical to SEQ ID NO: 55401

SEQ ID NO: 55404 - protein, 88 aa, Homo sapiens; identical to SEQ ID NO: 55389

SEQ ID NO: 55405 - protein, 424 aa, Homo sapiens; identical to SEQ ID NO: 55392

SEQ ID NO: 55406 - protein, 279 aa, Homo sapiens; identical to SEQ ID NO: 55393

SEQ ID NO: 55407 - protein, 295 aa, Homo sapiens; identical to SEQ ID NO: 55394

SEQ ID NO: 55408 - protein, 179 aa, Homo sapiens; identical to SEQ ID NO: 55395

SEQ ID NO: 55409 - protein, 408 aa, Homo sapiens; identical to SEQ ID NO: 55396

SEQ ID NO: 55410 - protein, 393 aa, Homo sapiens; identical to SEQ ID NO: 55397

SEQ ID NO: 55411 - protein, 270 aa, Homo sapiens; identical to SEQ ID NO: 55398

SEQ ID NO: 55412 - protein, 198 aa, Homo sapiens [sequence omitted]

SEQ ID NO: 55413 - protein, 96 aa, Homo sapiens [sequence omitted]

SEQ ID NO: 55414 - protein, 90 aa, Homo sapiens; identical to SEQ ID NO: 55387

SEQ ID NO: 55415 - protein, 93 aa, Homo sapiens; identical to SEQ ID NO: 55400

SEQ ID NO: 55416 - protein, 104 aa, Homo sapiens
MLSAWSLWKRAPEAPYASGEEPLALRQVFGPASGAPPRYPSPVGLGHPASLPRPAYSPRCPEPDARHGWGSGSNAGYRGPDRAGRHSLPCTGSRRKELLPSAPS

SEQ ID NO: 55417 - protein, 219 aa, Homo sapiens
MAPRTLLLLLSGTLALAETWAGSHSMRYFSTAVSWPGRGEPSFIAVGYVDDTQFVRVDSDAVSLRMKTRARWVEQEGPEYWDLQTLGAKAQAQTDRVNLRTLLRYYNQSEADPPQDTRDPPPSLNMRHNEVLGSGLLPCGDHIDLAAGWGGPDPGHGARGDQAHRGWNLPEVGGCGSAFWRGTEIHMPCAAQGAAQAPHPEMGHTFLETSRGSKTRRFL

SEQ ID NO: 55418 - protein, 46 aa, Homo sapiens; identical to SEQ ID NO: 55388

SEQ ID NO: 55419 - protein, 262 aa, Homo sapiens
MCGPRRLAAPGSSLGSFGRASRGGRRGSSGGRAAEPGLGDTMRRVLRLLLGCFLTELCARVCRAQERAGHGQLAQLGGVLLLAGGNRSGAASGEASEGAEASDAPPTRAPTPDFCRGYFDVMGQWDPPFNCSSGDFIFCCGTCGFRFCCTFKKRRLNQSTCTNYDTPLWLNTGKPPARKDDPLHDPTKDKTNLIVYIICGVVAVMVLVGIFTKLGLEKAHRPQREHMSRLYDNLLFTEAQISFQEDEPAPGEWSVGLQTWTV

SEQ ID NO: 55420 - protein, 309 aa, Homo sapiens; identical to SEQ ID NO: 55390

SEQ ID NO: 55421 - protein, 188 aa, Homo sapiens
MDCRKMVRFSYSVIWIMAISKAFELGLVAGLGHQEFARPSRGDLAFRDDSIWPQEEPAIRPRSSQRVLPMGIQHSKELNRTCCLNGGTCMLESFCACPPSFYGRNCEHDVRKENCGSVPHDTWLPKKCSLCKCWHGQLRCFPQAFLPGCDGLVMDEHLVASRTPELPPSARTTTFMLAGICLSIQSYY

SEQ ID NO: 55422 - protein, 188 aa, Homo sapiens; identical to SEQ ID NO: 55421

SEQ ID NO: 55423 - protein, 4655 aa, Homo sapiens
MDRGPAAVACTLLLALVACLAPASGQECDSAHFRCGSGHCIPADWRCDGTKDCSDDADEIGCAVVTCQQGYFKCQSEGQCIPSSWVCDQDQDCDDGSDERQDCSQSTCSSHQITCSNGQCIPSEYRCDHVRDCPDGADENDCQYPTCEQLTCDNGACYNTSQKCDWKVDCRDSSDEINCTEICLHNEFSCGNGECIPRAYVCDHDNDCQDGSDEHACNYPTCGGYQFTCPSGRCIYQNWVCDGEDDCKDNGDEDGCESGPHDVHKCSPREWSCPESGRCISIYKVCDGILDCPGREDENNTSTGKYCSMTLCSALNCQYQCHETPYGGACFCPPGYIINHNDSRTCVEFDDCQIWGICDQKCESRPGRHLCHCEEGYILERGQYCKANDSFGEASIIFSNGRDLLIGDIHGRSFRILVESQNRGVAVGVAFHYHLQRVFWTDTVQNKVFSVDINGLNIQEVLNVSVETPENLAVDWVNNKIYLVETKVNRIDMVNLDGSYRVTLITENLGHPRGIAVDPTVGYLFFSDWESLSGEPKLERAFMDGSNRKDLVKTKLGWPAGVTLDMISKRVYWVDSRFDYIETVTYDGIQRKTVVHGGSLIPHPFGVSLFEGQVFFTDWTKMAVLKANKFTETNPQVYYQASLRPYGVTVYHSLRQPYATNPCKDNNGGCEQVCVLSHRTDNDGLGFRCKCTFGFQLDTDERHCIAVQNFLIFSSQVAIRGIPFTLSTQEDVMVPVSGNPSFFVGIDFDAQDSTIFFSDMSKHMIFKQKIDGTGREILAANRVENVESLAFDWISKNLYWTDSHYKSISVMRLADKTRRTVVQYLNNPRSVVVHPFAGYLFFTDWFRPAKIMRAWSDGSHLLPVINTTLGWPNGLAIDWAASRLYWVDAYFDKIEHSTFDGLDRRRLGHIEQMTHPFGLAIFGEHLFFTDWRLGAIIRVRKADGGEMTVIRSGIAYILHLKSYDVNIQTGSNACNQPTHPNGDCSHFCFPVPNFQRVCGCPYGMRLASNHLTCEGDPTNEPPTEQCGLFSFPCKNGRCVPNYYLCDGVDDCHDNSDEQLCGTLNNTCSSSAFTCGHGECIPAHWRCDKRNDCVDGSDEHNCPTHAPASCLDTQYTCDNHQCISKNWVCDTDNDCGDGSDEKNCNSTETCQPSQFNCPNHRCIDLSFVCDGDKDCVDGSDEVGCVLNCTASQFKCASGDKCIGVTNRCDGVFDCSDNSDEAGCPTRPPGMCHSDEFQCQEDGICIPNFWECDGHPDCLYGSDEHNACVPKTCPSSYFHCDNGNCIHRAWLCDRDNDCGDMSDEKDCPTQPFRCPSWQWQCLGHNICVNLSVVCDGIFDCPNGTDESPLCNGNSCSDFNGGCTHECVQEPFGAKCLCPLGFLLANDSKTCEDIDECDILGSCSQHCYNMRGSFRCSCDTGYMLESDGRTCKVTASESLLLLVASQNKIIADSVTSQVHNIYSLVENGSYIVAVDFDSISGRIFWSDATQGKTWSAFQNGTDRRVVFDSSIILTETIAIDWVGRNLYWTDYALETIEVSKIDGSHRTVLISKNLTNPRGLALDPRMNEHLLFWSDWGHHPRIERASMDGSMRTVIVQDKIFWPCGLTIDYPNRLLYFMDSYLDYMDFCDYNGHHRRQVIASDLIIRHPYALTLFEDSVYWTDRATRRVMRANKWHGGNQSVVMYNIQWPLGIVAVHPSKQPNSVNPCAFSRCSHLCLLSSQGPHFYSCVCPSGWSLSPDLLNCLRDDQPFLITVRQHIIFGISLNPEVKSNDAMVPIAGIQNGLDVEFDDAEQYIYWVENPGEIHRVKTDGTNRTVFASISMVGPSMNLALDWISRNLYSTNPRTQSIEVLTLHGDIRYRKTLIANDGTALGVGFPIGITVDPARGKLYWSDQGTDSGVPAKIASANMDGTSVKTLFTGNLEHLECVTLDIEEQKLYWAVTGRGVIERGNVDGTDRMILVHQLSHPWGIAVHDSFLYYTDEQYEVIERVDKATGANKIVLRDNVPNLRGLQVYHRRNAAESSNGCSNNMNACQQICLPVPGGLFSCACATGFKLNPDNRSCSPYNSFIVVSMLSAIRGFSLELSDHSETMVPVAGQGRNALHVDVDVSSGFIYWCDFSSSVASDNAIRRIKPDGSSLMNIVTHGIGENGVRGIAVDWVAGNLYFTNAFVSETLIEVLRINTTYRRVLLKVTVDMPRHIVVDPKNRYLFWADYGQRPKIERSFLDCTNRTVLVSEGIVTPRGLAVDRSDGYVYWVDDSLDIIARIRINGENSEVIRYGSRYPTPYGITVFENSIIWVDRNLKKIFQASKEPENTEPPTVIRDNINWLRDVTIFDKQVQPRSPAEVNNNPCLENNGGCSHLCFALPGLHTPKCDCAFGTLQSDGKNCAISTENFLIFALSNSLRSLHLDPENHSPPFQTINVERTVMSLDYDSVSDRIYFTQNLASGVGQISYATLSSGIHTPTVIASGIGTADGIAFDWITRRIYYSDYLNQMINSMAEDGSNRTVIARVPKPRAIVLDPCQGYLYWADWDTHAKIERATLGGNFRVPIVNSSLVMPSGLTLDYEEDLLYWVDASLQRIERSTLTGVDREVIVNAAVHAFGLTLYGQYIYWTDLYTQRIYRANKYDGSGQIAMTTNLLSQPRGINTVVKNQKQQCNNPCEQFNGGCSHICAPGPNGAECQCPHEGNWYLANNRKHCIVDNGERCGASSFTCSNGRCISEEWKCDNDNDCGDGSDEMESVCALHTCSPTAFTCANGRCVQYSYRCDYYNDCGDGSDEAGCLFRDCNATTEFMCNNRRCIPREFICNGVDNCHDNNTSDEKNCPDRTCQSGYTKCHNSNICIPRVYLCDGDNDCGDNSDENPTYCTTHTCSSSEFQCASGRCIPQHWYCDQETDCFDASDEPASCGHSERTCLADEFKCDGGRCIPSEWICDGDNDCGDMSDEDKRHQCQNQNCSDSEFLCVNDRPPDRRCIPQSWVCDGDVDCTDGYDENQNCTRRTCSENEFTCGYGLCIPKIFRCDRHNDCGDYSDERGCLYQTCQQNQFTCQNGRCISKTFVCDEDNDCGDGSDELMHLCHTPEPTCPPHEFKCDNGRCIEMMKLCNHLDDCLDNSDEKGCGINECHDPSISGCDHNCTDTLTSFYCSCRPGYKLMSDKRTCVDIDECTEMPFVCSQKCENVIGSYICKCAPGYLREPDGKTCRQNSNIEPYLIFSNRYYLRNLTIDGYFYSLILEGLDNVVALDFDRVEKRLYWIDTQRQVIERMFLNKTNKETIINHRLPAAESLAVDWVSRKLYWLDARLDGLFVSDLNGGHRRMLAQHCVDANNTFCFDNPRGLALHPQYGYLYWADWGHRAYIGRVGMDGTNKSVIISTKLEWPNGITIDYTNDLLYWADAHLGYIEYSDLEGHHRHTVYDGALPHPFAITIFEDTIYWTDWNTRTVEKGNKYDGSNRQTLVNTTHRPFDIHVYHPYRQPIVSNPCGTNNGGCSHLCLIKPGGKGFTCECPDDFRTLQLSGSTYCMPMCSSTQFLCANNEKCIPIWWKCDGQKDCSDGSDELALCPQRFCRLGQFQCSDGNCTSPQTLCNAHQNCPDGSDEDRLLCENHHCDSNEWQCANKRCIPESWQCDTFNDCEDNSDEDSSHCASRTCRPGQFRCANGRCIPQAWKCDVDNDCGDHSDEPIEECMSSAHLCDNFTEFSCKTNYRCIPKWAVCNGVDDCRDNSDEQGCEERTCHPVGDFRCKNHHCIPLRWQCDGQNDCGDNSDEENCAPRECTESEFRCVNQQCIPSRWICDHYNDCGDNSDERDCEMRTCHPEYFQCTSGHCVHSELKCDGSADCLDASDEADCPTRFPDGAYCQATMFECKNHVCIPPYWKCDGDDDCGDGSDEELHLCLDVPCNSPNRFRCDNNRCIYSHEVCNGVDDCGDGTDETEEHCRKPTPKPCTEYEYKCGNGHCIPHDNVCDDADDCGDWSDELGCNKGKERTCAENICEQNCTQLNEGGFICSCTAGFETNVFDRTSCLDINECEQFGTCPQHCRNTKGSYECVCADGFTSMSDRPGKRCAAEGSSPLLLLPDNVRIRKYNLSSERFSEYLQDEEYIQAVDYDWDPKDIGLSVVYYTVRGEGSRFGAIKRAYIPNFESGRNNLVQEVDLKLKYVMQPDGIAVDWVGRHIYWSDVKNKRIEVAKLDGRYRKWLISTDLDQPAAIAVNPKLGLMFWTDWGKEPKIESAWMNGEDRNILVFEDLGWPTGLSIDYLNNDRIYWSDFKEDVIETIKYDGTDRRVIAKEAMNPYSLDIFEDQLYWISKEKGEVWKQNKFGQGKKEKTLVVNPWLTQVRIFHQLRYNKSVPNLCKQICSHLCLLRPGGYSCACPQGSSFIEGSTTECDAAIELPINLPPPCRCMHGGNCYFDETDLPKCKCPSGYTGKYCEMAFSKGISPGTTAVAVLLTILLIVVIGALAIAGFFHYRRTGSLLPALPKLPSLSSLVKPSENGNGVTFRSGADLNMDIGVSGFGPETAIDRSMAMSEDFVMEMGKQPIIFENPMYSARDSAVKVVQPIQVTVSENVDNKNYGSPINPSEIVPETNPTSPAADGTQVTKWNLFKRKSKQTTNFENPIYAQMENEQKESVAATPPPSPSLPAKPKPPSRRDPTPTYSATEDTFKDTANLVKEDSEV

SEQ ID NO: 55424 - protein, 153 aa, Homo sapiens
MAPAAATGGSTLPSGFSVFTTLPDLLFIFEFIFGGLVWILVASSLVPWPLVQGWVMFVSVFCFVATTTLIILYIIGAHGGETSWVTLDAAYHCTAALFYLSASVLEALATITMQDGFTYRHYHENIAAVVFSYIATLLYVVHAVFSLIRWKSS

SEQ ID NO: 55425 - protein, 111 aa, Homo sapiens
MAPAAATGGSTLPSGFSVFTTLPDLLFIFEFIFGGLVWILVASSLVPWPLVQGWVMFVSVFCFVATTTLIILYIIGAHGGETSWVTLVFSYIATLLYVVHAVFSLIRWKSS

SEQ ID NO: 55426 - protein, 97 aa, Homo sapiens
MAPAAATGGSTLPSGFSVFTTLPDLLFIFEFDAAYHCTAALFYLSASVLEALATITMQDGFTYRHYHENIAAVVFSYIATLLYVVHAVFSLIRWKSS

SEQ ID NO: 55427 - protein, 55 aa, Homo sapiens
MAPAAATGGSTLPSGFSVFTTLPDLLFIFEFVFSYIATLLYVVHAVFSLIRWKSS

SEQ ID NO: 55428 - protein, 651 aa, Homo sapiens
MKDYDELLKYYELHETIGTGGFAKVKLACHILTGEMVAIKIMDKNTLGSDLPRIKTEIEALKNLRHQHICQLYHVLETANKIFMVLEYCPGGELFDYIISQDRLSEEETRVVFRQIVSAVAYVHSQGYAHRDLKPENLLFDEYHKLKLIDFGLCAKPKGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 55429 - protein, 267 aa, Homo sapiens
MRLTVLCAVCLLPGSLALPLPQEAGGMSELQWEQAQDYLKRFYLYDSETKNANSLEAKLKEMQKFFGLPITGMLNSRVIEIMQKPRCGVPDVAEYSLFPNSPKWTSKVVTYRIVSYTRDLPHITVDRLVSKALNMWGKEIPLHFRKVVWGTADIMIGFARGAHGDSYPFDGPGNTLAHAFAPGTGLGGDAHFDEDERWTDGSSLGINFLYAATHELGHSLGMGHSSDPNAVMYPTYGNGDPQNFKLSQDDIKGIQKLYGKRSNSRKK

SEQ ID NO: 55430 - protein, 313 aa, Homo sapiens
MALRICVTYTPALPIGLCTRCCLCLEQSPSWCHCLRGVSFLTFHLHQSVPLGDRDSLLMFTRQAGHFVEGSKAGRSRGRLCLSQALRVAVRGAFVSLWFAAGAGDRERNKGDKGAQTGAGLSQEAEDVDVSRARRVTDAPQGTLCGTGNRNSGSQSARVVGVAHLGEAFRVGVEQAISSCPEEVHGRHGLSMEIMWARMDVALRSPGRGLLAGAGALCMTLAESSCPDYERGRRACLTLHRHPTPHCSTWGLPLRVAGSWLTVVTVEALGGWRMGVRRTGQVGPTMHPPPVSGASPLLLHHLLLLLLIIILTC

SEQ ID NO: 55431 - protein, 522 aa, Homo sapiens
MNSFFGTPAASWCLLESDVSSAPDKEAGRERRALSVQQRGGPAWSGSLEWSRQSAGDRRRLGLSRQTAKSSWSRSRDRTCCCRRAWWILVPAADRARRERFIMNEKWDTNSSENWHPIWNVNDTKHHLYSDINITYVNYYLHQPQVAAIFIISYFLIFFLCMMGNTVVCFIVMRNKHMHTVTNLFILNLAISDLLVGIFCMPITLLDNIIAGWPFGNTMCKISGLVQGISVAASVFTLVAIAVDRFQCVVYPFKPKLTIKTAFVIIMIIWVLAITIMSPSAVMLHVQEEKYYRVRLNSQNKTSPVYWCREDWPNQEMRKIYTTVLFANIYLAPLSLIVIMYGRIGISLFRAAVPHTGRKNQEQWHVVSRKKQKIIKMLLIVALLFILSWLPLWTLMMLSDYADLSPNELQIINIYIYPFAHWLAFGNSSVNPIIYGFFNENFRRGFQEAFQLQLCQKRAKPMEAYTLKAKSHVLINTSNQLVQESTFQNPHGETLLYRKSAEKPQQELVMEELKETTNSSEI

SEQ ID NO: 55432 - protein, 420 aa, Homo sapiens
MNEKWDTNSSENWHPIWNVNDTKHHLYSDINITYVNYYLHQPQVAAIFIISYFLIFFLCMMGNTVVCFIVMRNKHMHTVTNLFILNLAISDLLVGIFCMPITLLDNIIAGWPFGNTMCKISGLVQGISVAASVFTLVAIAVDRFQCVVYPFKPKLTIKTAFVIIMIIWVLAITIMSPSAVMLHVQEEKYYRVRLNSQNKTSPVYWCREDWPNQEMRKIYTTVLFANIYLAPLSLIVIMYGRIGISLFRAAVPHTGRKNQEQWHVVSRKKQKIIKMLLIVALLFILSWLPLWTLMMLSDYADLSPNELQIINIYIYPFAHWLAFGNSSVNPIIYGFFNENFRRGFQEAFQLQLCQKRAKPMEAYALKAKSHVLINTSNQLVQESTFQNPHGETLLYRKSAEKPQQELVMEELKETTNSSEI

SEQ ID NO: 55433 - protein, 383 aa, Homo sapiens
MERRARSSSRESRGRGGRTPHKENKRAKAERSGGGRGRQEAGPEPSGSGRAGTPGEPRAPAATVVDVDEVRGSGEEGTEVVALLESERPEEGTKSSGLGACEWLLVLISLLFIIMTFPFSIWFCVKVVQEYERVIIFRLGHLLPGRAKGPGLFFFLPCLDTYHKVDLRLQTLEIPFHEIVTKDMFIMEIDAICYYRMENASLLLSSLAHVSKAVQFLVQTTMKRLLAHRSLTEILLERKSIAQDAKVALDSVTCIWGIKVERIEIKDVRLPAGLQHSLAVEAEAQRQAKVRMIAAEAEKAASESLRMAAEILSGTPAAVQLRYLHTLQSLSTEKPSTVVLPLPFDLLNCLSSPSNRTQGSLPFPSPSKPVEPLNPKKKDSPML

SEQ ID NO: 55434 - protein, 438 aa, Homo sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGTNVCDNELLHCQNGGTCHNNVRCLCPAAYTGILCEKLRCEEAGSCGSDSGQGAPPHGSPALLLLTTLLGTASPLVF

SEQ ID NO: 55435 - protein, 168 aa, Homo sapiens
MKKFFTVAILAGSVLSTAHGSLLNLKAMVEAVTGRSAILSFVGYGCYCGLGGRGQPKDEVDWCCHAHDCCYQELFDQGCHPYVDHYDHTIENNTEIVCSDLNKTECDKQTCMCDKNMVLCLMNQTYREEYRGFLNVYCQGPTPNCSIYGPPPEEVTCSHQSPAPPAPP

SEQ ID NO: 55436 - protein, 1194 aa, Homo sapiens
MAKPYEFNWQKEVPSFLQEGTVFDRYEEESFVFEPNCLFKVDEFGFFLTWRSEGKEGQVLECSLINSIRSGAIPKDPKILAALEAVGKSENDLEGRIVCVCSGTDLVNISFTYMVAENPEVTKQWVEGLRSIIHNFRANNVSPMTCLKKHWMKLAFMTNTNGKIPVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQLLKSCHAVSQTQGEGDAADGEIGSRDGPQTSNSSMKLQNAN

SEQ ID NO: 55437 - protein, 1175 aa, Homo sapiens
MAKPYEFNWQKEVPSFLQEGTVFDRYEEESFVFEPNCLFKVDEFGFFLTWRSEGKEGQVLECSLINSIRSGAIPKDPKILAALEAVGKSENDLEGRIVCVCSGTDLVNISFTYMVAENPEVTKQWVEGLRSIIHNFRANNVSPMTCLKKHWMKLAFMTNTNGKIPVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQAKEMQQMVKLEAEMDRRPATVV

SEQ ID NO: 55438 - protein, 406 aa, Homo sapiens
MDGWRRMPRWGLLLLLWGSCTFGLPTDTTTFKRIFLKRMPSIRESLKERGVDMARLGPEWSQPMKRLTLGNTTSSVILTNYMDTQYYGEIGIGTPPQTFKVVFDTGSSNVWVPSSKCSRLYTACVYHKLFDASDSSSYKHNGTELTLRYSTGTVSGFLSQDIITVGGITVTQMFGEVTEMPALPFMLAEFDGVVGMGFIEQAIGRVTPIFDNIISQGVLKEDVFSFYYNRDSENSQSLGGQIVLGGSDPQHYEGNFHYINLIKTGVWQIQMKGVSVGSSTLLCEDGCLALVDTGASYISGSTSSIEKLMEALGAKKRLFDYVVKCNEGPTLPDISFHLGGKEYTLTSADYVFQESYSSKKLCTLAIHAMDIPPPTGPTWALGATFIRKFYTEFDRRNNRIGFALAR

SEQ ID NO: 55439 - protein, 211 aa, Homo sapiens
MDAPGALAQTAAPGPGRKELKIVIVGDGGCGKTSLLMVYSQGSFPEHYAPSVFEKYTASVTVGSKEVTLNLYDTAGQEDYDRLRPLSYQNTHLVLICYDVMNPTSYDNVLIKWFPEVTHFCRGIPMVLIGCKTDLRKDKEQLRKLRAAQLEPITYMQGLSACEQIRAALYLECSAKFRENVEDVFREAAKVALSALKKAQRQKKRRLCLLL

SEQ ID NO: 55440 - protein, 440 aa, Homo sapiens
MAATDLERFSNAEPEPRSLSLGGHVGFDSLPDQLVSKSVTQGFSFNILCVGETGIGKSTLMNTLFNTTFETEEASHHEACVRLRPQTYDLQESNVQLKLTIVDAVGFGDQINKDERPIVDYIDAQFENYLQEELKIRRSLFDYHDTRIHVCLYFITPTGHSLKSLDLVTMKKLDSKVNIIPIIAKADTISKSELHKFKIKIMGELVSNGVQIYQFPTDDEAVAEINAVMNAHLPFAVVGSTEEVKVGNKLVRARQYPWGVVQVENENHCDFVKLREMLIRVNMEDLREQTHSRHYELYRRCKLEEMGFQDSDGDSQPFSLQETYEAKRKEFLSELQRKEEEMRQMFVNKVKETELELKEKERELHEKFEHLKRVHQEEKRKVEEKRRELEEETNAFNRRKAAVEALQSQALHATSQQPLRKDKDKKKASGWSSIYSVTIP

SEQ ID NO: 55441 - protein, 440 aa, Homo sapiens; identical to SEQ ID NO: 55440

SEQ ID NO: 55442 - protein, 427 aa, Homo sapiens
MQGLLTSGRKPSGGGRCTGRGGWRGQWCLKPWMGGADPPTPTLSCLLLPVPPELPDHCYRMNSSPAGTPSPQPSRANGNINLGPSANPNAQPTDFDFLKVIGKGNYGKVLLAKRKSDGAFYAVKVLQKKSILKKKEQSHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPEYLAPEVLRKEPYDRAVDWWCLGAVLYEMLHGLPPFYSQDVSQMYENILHQPLQIPGGRTVAACDLLQSLLHKDQRQRLGSKADFLEIKNHVFFSPINWDDLYHKRLTPPFNPNVTGPADLKHFDPEFTQEAVSKSIGCTPDTVASSSGASSAFLGFSYAPEDDDILDC

SEQ ID NO: 55443 - protein, 367 aa, Homo sapiens
MNSSPAGTPSPQPSRANGNINLGPSANPNAQPTDFDFLKVIGKGNYGKVLLAKRKSDGAFYAVKVLQKKSILKKKEQSHIMAERSVLLKNVRHPFLVGLRYSFQTPEKLYFVLDYVNGGELFFHLQRERRFLEPRARFYAAEVASAIGYLHSLNIIYRDLKPENILLDCQGHVVLTDFGLCKEGVEPEDTTSTFCGTPEYLAPEVLRKEPYDRAVDWWCLGAVLYEMLHGLPPFYSQDVSQMYENILHQPLQIPGGRTVAACDLLQSLLHKDQRQRLGSKADFLEIKNHVFFSPINWDDLYHKRLTPPFNPNVTGPADLKHFDPEFTQEAVSKSIGCTPDTVASSSGASSAFLGFSYAPEDDDILDC

SEQ ID NO: 55444 - protein, 550 aa, Homo sapiens
MAFSKLLEQAGGVGLFQTLQVLTFILPCLMIPSQMLLENFSAAIPGHRCWTHMLDNGSAVSTNMTPKALLTISIPPGPNQGPHQCRRFRQPQWQLLDPNATATSWSEADTEPCVDGWVYDRSVFTSTIVAKWDLVCSSQGLKPLSQSIFMSGILVGSFIWGLLSYRFGRKPMLSWCCLQLAVAGTSTIFAPTFVIYCGLRFVAAFGMAGIFLSSLTLMVEWTTTSRRAVTMTVVGCAFSAGQAALGGLAFALRDWRTLQLAASVPFFAISLISWWLPESARWLIIKGKPDQALQELRKVARINGHKEAKNLTIEVLMSSVKEEVASAKEPRSVLDLFCVPVLRWRSCAMLVVNFSLLISYYGLVFDLQSLGRDIFLLQALFGAVDFLGRATTALLLSFLGRRTIQAGSQAMAGLAILANMLVPQDLQTLRVVFAVLGKGCFGISLTCLTIYKAELFPTPVRMTADGILHTVGRLGAMMGPLILMSRQALPLLPPLLYGVISIASSLVVLFFLPETQGLPLPDTIQDLESQKSTAAQGNRQEAVTVESTSL

SEQ ID NO: 55445 - protein, 542 aa, Homo sapiens
MTFSEILDRVGSMGHFQFLHVAILGLPILNMANHNLLQIFTAATPVHHCRPPHNASTGPWVLPMGPNGKPERCLRFVHPPNASLPNDTQRAMEPCLDGWVYNSTKDSIVTEWDLVCNSNKLKEMAQSIFMAGILIGGLVLGDLSDRFGRRPILTCSYLLLAASGSGAAFSPTFPIYMVFRFLCGFGISGITLSTVILNVEWVPTRMRAIMSTALGYCYTFGQFILPGLAYAIPQWRWLQLTVSIPFFVFFLSSWWTPESIRWLVLSGKSSKALKILRRVAVFNGKKEEGERLSLEELKLNLQKEISLAKAKYTASDLFRIPMLRRMTFCLSLAWFATGFAYYSLAMGVEEFGVNLYILQIIFGGVDVPAKFITILSLSYLGRHTTQAAALLLAGGAILALTFVPLDLQTVRTVLAVFGKGCLSSSFSCLFLYTSELYPTVIRQTGMGVSNLWTRVGSMVSPLVKITGEVQPFIPNIIYGITALLGGSAALFLPETLNQPLPETIEDLENWSLRAKKPKQEPEVEKASQRIPLQPHGPGLGSS

SEQ ID NO: 55446 - protein, 639 aa, Homo sapiens
MLSYGERLGSPAVSPLPVRGGHVMRGTAFAYVPSPQVLHRIPGTSAYAFPSLGPVALAEHTCPCGEVLERHEPLPAKLALEEEQKPESRLVPKLRQAGAMLLKVPLMLTFLYLFVCSLDMLSSAFQLAGGKVAGDIFKDNAILSNPVAGLVVGILVTVLVQSSSTSTSIIVSMVSSGLLEVSSAIPIIMGSNIGTSVTNTIVALMQAGDRTDFRRAFAGATVHDCFNWLSVLVLLPLEAATGYLHHITRLVVASFNIHGGRDAPDLLKIITEPFTKLIIQLDESVITSIATGDESLRNHSLIQIWCHPDSLQAPTSMSRAEANSSQTLGNATMEKCNHIFVDTGLPDLAVGLILLAGALVLLCTCLILLVKMLNSLLKGQVAKVIQKVINTDFPAPFTWVTGYFAMVVGASMTFVVQSSSVFTSAITPLIGLGVISIERAYPLTLGSNIGTTTTAILAALASPREKLSSAFQIALCHFFFNISGILLWYPVPCTRLPIRMAKALGKRTAKYRWFAVLYLLVCFLLLPSLVFGISMAGWQVMVGVGTPFGALLAFVVLINVLQSRSPGHLPKWLQTWDFLPRWMHSLKPLDHLITRATLCCARPEPRSPPLPPRVFLEELPPATPSPRLALPAHHNATRL

SEQ ID NO: 55447 - protein, 672 aa, Homo sapiens
MEEHTEAGSAPEMGAQKALIDNPADILVIAAYFLLVIGVGLWSMCRTNRGTVGGYFLAGRSMVWWPVGASLFASNIGSGHFVGLAGTGAASGLAVAGFEWNALFVVLLLGWLFAPVYLTAGVITMPQYLRKRFGGRRIRLYLSVLSLFLYIFTKISVDMFSGAVFIQQALGWNIYASVIALLGITMIYTVTGGLAALMYTDTVQTFVILGGACILMGYAFHEVGGYSGLFDKYLGAATSLTVSEDPAVGNISSFCYRPRPDSYHLLRHPVTGDLPWPALLLGLTIVSGWYWCSDQVIVQRCLAGKSLTHIKAGCILCGYLKLTPMFLMVMPGMISRILYPDEVACVVPEVCRRVCGTEVGCSNIAYPRLVVKLMPNGLRGLMLAVMLAALMSSLASIFNSSSTLFTMDIYTRLRPRAGDRELLLVGRLWVVFIVVVSVAWLPVVQAAQGGQLFDYIQAVSSYLAPPVSAVFVLALFVPRVNEQGAFWGLIGGLLMGLARLIPEFSFGSGSCVQPSACPAFLCGVHYLYFAIVLFFCSGLLTLTVSLCTAPIPRKHLHRLVFSLRHSKEEREDLDADEQQGSSLPVQNGCPESAMEMNEPQAPAPSLFRQCLLWFCGMSRGGVGSPPPLTQEEAAAAARRLEDISEDPSWARVVNLNALLMMAVAVFLWGFYA

SEQ ID NO: 55448 - protein, 620 aa, Homo sapiens
MATKEKLQCLKDFHKDILKPSPGKSPGTRPEDEAEGKPPQREKWSSKIDFVLSVAGGFVGLGNVWRFPYLCYKNGGGAFLIPYFIFLFGSGLPVFFLEIIIGQYTSEGGITCWEKICPLFSGIGYASVVIVSLLNVYYIVILAWATYYLFQSFQKELPWAHCNHSWNTPHCMEDTMRKNKSVWITISSTNFTSPVIEFWERNVLSLSPGIDHPGSLKWDLALCLLLVWLVCFFCIWKGVRSTGKVVYFTATFPFAMLLVLLVRGLTLPGAGAGIKFYLYPDITRLEDPQVWIDAGTQIFFSYAICLGAMTSLGSYNKYKYNSYRDCMLLGCLNSGTSFVSGFAIFSILGFMAQEQGVDIADVAESGPGLAFIAYPKAVTMMPLPTFWSILFFIMLLLLGLDSQFVEVEGQITSLVDLYPSFLRKGYRREIFIAFVCSISYLLGLTMVTEGGMYVFQLFDYYAASGVCLLWVAFFECFVIAWIYGGDNLYDGIEDMIGYRPGPWMKYSWAVITPVLCVGCFIFSLVKYVPLTYNKTYVYPNWAIGLGWSLALSSMLCVPLVIVIRLCQTEGPFLVRVKYLLTPREPNRWAVEREGATPYNSRTVMNGALVKPTHIIVETMM

SEQ ID NO: 55449 - protein, 94 aa, Homo sapiens
MAAFPHKIIFFLVCSTLTHVAFSGIFNKRDFTRWPKPRCKMYIPLDPDYNADCPNVTAPVCASNGHTFQNECFFCVEQREFHYRIKFEKYGKCD

SEQ ID NO: 55450 - protein, 94 aa, Homo sapiens; identical to SEQ ID NO: 55449

SEQ ID NO: 55451 - protein, 188 aa, Homo sapiens
MDCRKMARFSYSVIWIMAISKVFELGLVAGLGHQEFARPSRGYLAFRDDSIWPQEEPAIRPRSSQRVPPMGIQHSKELNRTCCLNGGTCMLGSFCACPPSFYGRNCEHDVRKENCGSVPHDTWLPKKCSLCKCWHGQLRCFPQAFLPGCDGLVMDEHLVASRTPELPPSARTTTFMLVGICLSIQSYY

SEQ ID NO: 55452 - protein, 449 aa, Homo sapiens
MLWKLVENVKYEDIYEDRHDGVPSHSSRLSQLGSVSQGPYSSAPPLSHTPSSDFQPPYFPPPYQPLPYHQSQDPYSHVNDPYSLNPLHQPQQHPWGQRQRQEVGSEAGSLLPQPRAALPQLSGLDPRRDYHSVRRPDVLLHSAHHGLDAGMGDSLSLHGLGHPGMEDVQSVEDANNSGMNLLDQSVIKKVPVPPKSVTSLMMNKDGFLGGMSVNTGEVFCSVPGRLSLLSSTSKYKVTVGEVQRRLSPPECLNASLLGGVLRRAKSKNGGRSLRERLEKIGLNLPAGRRKAANVTLLTSLVEGEAVHLARDFGYICETEFPAKAVSEYLNRQHTDPSDLHSRKNMLLATKQLCKEFTDLLAQDRTPIGNSRPSPILEPGIQSCLTHFSLITHGFGAPAICAALTALQNYLTEALKGMDKMFLNNTTTNRHTSGEGPGSKTGDKEEKHRK

SEQ ID NO: 55453 - protein, 476 aa, Homo sapiens
MWTGYKILIFSYLTTEIWMEKRYLSQREVDLEAYFTRNHTVLQGTRFKRAIFQGQYCRNFGCCEDRDDGCVTEFYAANALCYCDKFCDRENSDCCPDYKSFCREEKEWPPHTQPWYPEGCFKDGQHYEEGSVIKENCNSCTCSGQQWKCSQHVCLVRSELIEQVNKGDYGWTAQNYSQFWGMTLEDGFKFRLGTLPPSLMLLSMNEMTASLPATTDLPEFFVASYKWPGWTHGPLDQKNCAASWAFSTASVAADRIAIQSKGRYTANLSPQNLISCCAKNRHGCNSGSIDRAWWYLRKRGLVSHACYPLFKDQNATNNGCAMASRSDGRGKRHATKPCPNNVEKSNRIYQCSPPYRVSSNETEIMKEIMQNGPVQAIMQVHEDFFHYKTGIYRHVTSTNKESEKYRKLQTHAVKLTGWGTLRGAQGQKEKFWIAANSWGKSWGENGYFRILRGVNESDIEKLIIAAWGQLTSSDEP

SEQ ID NO: 55454 - protein, 222 aa, Homo sapiens
MLWLLFFLVTAIHAELCQPGAENAFKVRLSIRTALGDKAYAWDTNEEYLFKAMVAFSMRKVPNREATEISHVLLCNVTQRVSFWFVVTDPSKNHTLPAVEVQSAIRMNKNRINNAFFLNDQTLEFLKIPSTLAPPMDPSVPIWIIIFGVIFCIIIVAIALLILSGIWQRRRKNKEPSEVDDAEDKCENMITIENGIPSDPLDMKGGHINDAFMTEDERLTPL

SEQ ID NO: 55455 - protein, 295 aa, Homo sapiens
MWGARRSSVSSSWNAASLLQLLLAALLAAGARASGEYCHGWLDAQGVWRIGFQCPERFDGGDATICCGSCALRYCCSSAEARLDQGGCDNDRQQGAGEPGRADKDGPDGSAVPIYVPFLIVGSVFVAFIILGSLVAACCCRCLRPKQDPQQSRAPGGNRLMETIPMIPSASTSRGSSSRQSSTAASSSSSANSGARAPPTRSQTNCCLPEGTMNNVYVNMPTNFSVLNCQQATQIVPHQGQYLHPPYVGYTVQHDSVPMTAVPPFMDGLQPGYRQIQSPFPHTNSEQKMYPAVTV

SEQ ID NO: 55456 - protein, 747 aa, Homo sapiens
MSQVKSSYSYDAPSDFINFSSLDDEGDTQNIDSWFEEKANLENKLLGKNGTGGLFQGKTPLRKANLQQAIVTPLKPVDNTYYKEAEKENLVEQSIPSNACSSLEVEAAISRKTPAQPQRRSLRLSAQKDLEQKEKHHVKMKAKRCATPVIIDEILPSKKMKVSNNKKKPEEEGSAHQDTAEKNASSPEKAKGRHTVPCMPPAKQKFLKSTEEQELEKSMKMQQEVVEMRKKNEEFKKLALAGIGQPVKKSVSQVTKSVDFHFRTDERIKQHPKNQEEYKEVNFTSELRKHPSSPARVTKGCTIVKPFNLSQGKKRTFDETVSTYVPLAQQVEDFHKRTPNRYHLRSKKDDINLLPSKSSVTKICRDPQTPVLQTKHRARAVTCKSTAELEAEELEKLQQYKFKARELDPRILEGGPILPKKPPVKPPTEPIGFDLEIEKRIQERESKKKTEDEHFEFHSRPCPTKILEDVVGVPEKKVLPITVPKSPAFALKNRIRMPTKEDEEEDEPVVIKAQPVPHYGVPFKPQIPEARTVEICPFSFDSRDKERQLQKEKKIKELQKGEVPKFKALPLPHFDTINLPEKKVKNVTQIEPFCLETDRRGALKAQTWKHQLEEELRQQKEAACFKARPNTVISQEPFVPKKEKKSVAEGLSGSLVQEPFQLATEKRAKERQELEKRMAEVEAQKAQQLEEARLQEEEQKKEELARLRRELVHKANPIRKYQGLEIKSSDQPLTVPVSPKFSTRFHC

SEQ ID NO: 55457 - protein, 729 aa, Homo sapiens
MGGFLPKAEGPGSQLQKLLPSFLVREQDWDQHLDKLHMLQQKRILESPLLRASKENDLSVLRQLLLDCTCDVRQRGALGETALHIAALYDNLEAALVLMEAAPELVFEPTTCEAFAGQTALHIAVVNQNVNLVRALLTRRASVSARATGTAFRRSPRNLIYFGEHPLSFAACVNSEEIVRLLIEHGADIRAQDSLGNTVLHILILQPNKTFACQMYNLLLSYDGHGDHLQPLDLVPNHQGLTPFKLAGVEGNTVMFQHLMQKRRHIQWTYGPLTSILYDLTEIDSWGEELSFLELVVSSDKREARQILEQTPVKELVSFKWNKYGRPYFCILAALYLLYMICFTTCCVYRPLKFRGGNRTHSRDITILQQKLLQEAYETREDIIRLVGELVSIVGAVIILLLEIPDIFRVGASRYFGKTILGGPFHVIIITYASLVLVTMVMRLTNTNGEVVPMSFALVLGWCSVMYFTRGFQMLGPFTIMIQKMIFGDLMRFCWLMAVVILGFASAFYIIFQTEDPTSLGQFYDYPMALFTTFELFLTVIDAPANYDVDLPFMFSIVNFAFAIIATLLMLNLFIAMMGDTHWRVAQERDELWRAQVVATTVMLERKLPRCLWPRSGICGCEFGLGDRWFLRVENHNDQNPLRVLRYVEVFKNSDKEDDQEHPSEKQPSGAESGTLARASLALPTSSLSRTASQSSSHRGWEILRQNTLGHLNLGLNLSEGDGEEVYHF

SEQ ID NO: 55458 - protein, 518 aa, Homo sapiens
MCPQESSFQPSQFLLLVGVPVASVLLLAQCLRWHCPRRLLGACWTLNGQEEPVSQPTPQLENEVSRQHLPATLPEMVAFYQELHTPTQGQTMVRQLMHKLLVFSAREVDHRGGCLMLQDTGISLLIPPGAVAVGRQERVSLILVWDLSDAPSLSQAQGLVSPVVACGPHGASFLKPCTLTFKHCAEQPSHARTYSSNTTLLDAKVWRPLGRPGAHASRDECRIHLSHFSLYTCVLEAPVGREARKWLQLAVFCSPLVPGQSHLQLRIYFLNNTPCALQWALTNEQPHGGRLRGPCQLFDFNGARGDQCLKLTYISEGWENVDDSSCQLVPHLHIWHGKCPFRSFCFRRKAADENEDCSALTNEIIVTMHTFQDGLETKYMEILRFQASEEESWAAPPPVSQPPPCNRLPPELFEQLRMLLEPNSITGNDWRGLASHLGLCGMKIRFLSCQRSPAAAILELFEEQNGSLQELHYLMTVMERLDCASAIQNYLSGTHGGSPGPERGGARDNQGLELDEKL

SEQ ID NO: 55459 - protein, 258 aa, Homo sapiens
MEEMKKTAIRLPKGKQKPIKTEWNSRCVLFTYFQGDISSVVDEHFSRALSNIKSPQELTPSSQSEGVMLKNDDSMSPNQWRYSSPWTKPQPEVPVTNRAANCNLHVPGPMAVNQFSPSLARRASVRPGELWHFSSLAGTSSLEPGYSHPFPARHLVPEPQPDGKREPLLSLLQQDRCLARPQESAARENGNPGQIAGSTGLLFNLPPGSVHYKKLYVSRGSASTSLPNETLSELETPGKYSLTPPNHWGHPHRYLQHL

SEQ ID NO: 55460 - protein, 400 aa, Homo sapiens
MNPASAPPPLPPPGQQVIHVTQDLDTDLEALFNSVMNPKPSSWRKKILPESFFKEPDSGSHSRQSSTDSSGGHPGPRLAGGAQHVRSHSSPASLQLGTGAGAAGSPAQQHAHLRQQSYDVTDELPLPPGWEMTFTATGQRYFLNHIEKITTWQDPRKAMNQPLNHMNLHPAVSSTPVPQRSMAVSQPNLVMNHQHQQQMAPSTLSQQNHPTQNPPAGLMSMPNALTTQQQQQQKLRLQRIQMERERIRMRQEELMRQEAALCRQLPMEAETLAPVQAAVNPPTMTPDMRSITNNSSDPFLNGGPYHSREQSTDSGLGLGCYSVPTTPEDFLSNVDEMDTGENAGQTPMNINPQQTRFPDFLDCLPGTNVDLGTLESEDLIPLFNDVESALNKSEPFLTWL

SEQ ID NO: 55461 - DNA, 20 bp, Homo sapiens
gatctcttcccccaagaaaa

SEQ ID NO: 55462 - DNA, 20 bp, Homo sapiens
gatcaacgaatagtaaataa

SEQ ID NO: 55463 - DNA, 20 bp, Homo sapiens
gatccagaacttgctaccag

SEQ ID NO: 55464 - DNA, 20 bp, Homo sapiens
gatctttatttctggatgtt

SEQ ID NO: 55465 - DNA, 20 bp, Homo sapiens
gatcacacacaccaaaccag

SEQ ID NO: 55466 - DNA, 20 bp, Homo sapiens
gatcggacccctggtgggcg

SEQ ID NO: 55467 - DNA, 20 bp, Homo sapiens
gatctcggcttctccagctg

SEQ ID NO: 55468 - DNA, 20 bp, Homo sapiens
gatcggatctgtttcattta

SEQ ID NO: 55469 - DNA, 20 bp, Homo sapiens
gatcatggagggcctctctg

SEQ ID NO: 55470 - DNA, 20 bp, Homo sapiens
gatcatgttaaaaattggac

SEQ ID NO: 55471 - DNA, 20 bp, Homo sapiens
gatccaccagcttcttcagg

SEQ ID NO: 55472 - DNA, 20 bp, Homo sapiens
gatcaaatgagattcagcaa

SEQ ID NO: 55473 - DNA, 20 bp, Homo sapiens
gatcaccaattaaaagcccc

SEQ ID NO: 55474 - DNA, 20 bp, Homo sapiens
gatccacaattcattgcgca

SEQ ID NO: 55475 - DNA, 20 bp, Homo sapiens
gatccgtccatccagacaag

SEQ ID NO: 55476 - DNA, 20 bp, Homo sapiens
gatcaggaaagtgacactgg

SEQ ID NO: 55477 - DNA, 20 bp, Homo sapiens
gatcaaagaagctaaatata

SEQ ID NO: 55478 - DNA, 20 bp, Homo sapiens
gatcatcttagacagcacaa

SEQ ID NO: 55479 - DNA, 20 bp, Homo sapiens
gatcaagaataagaatacta

SEQ ID NO: 55480 - DNA, 20 bp, Homo sapiens
gatcgttgtgaattaaagtt

SEQ ID NO: 55481 - DNA, 20 bp, Homo sapiens
gatccatacaaaactatcgg

SEQ ID NO: 55482 - DNA, 20 bp, Homo sapiens
gatcgtgatggcaatgggaa

SEQ ID NO: 55483 - DNA, 20 bp, Homo sapiens
gatcggttcatgcagaataa

SEQ ID NO: 55484 - DNA, 20 bp, Homo sapiens
gatctgggggtagattctca

SEQ ID NO: 55485 - DNA, 20 bp, Homo sapiens
gatcgtcaacatctcggtgc

SEQ ID NO: 55486 - DNA, 20 bp, Homo sapiens
gatccttcggctcagtggaa

SEQ ID NO: 55487 - DNA, 20 bp, Homo sapiens
gatcaagccatggtcttggc

SEQ ID NO: 55488 - DNA, 20 bp, Homo sapiens
gatcaccaggggtgcagaag

SEQ ID NO: 55489 - DNA, 20 bp, Homo sapiens
gatcactcgaaccaggagct

SEQ ID NO: 55490 - DNA, 20 bp, Homo sapiens
gatccagcaggggacaggac

SEQ ID NO: 55491 - DNA, 20 bp, Homo sapiens
gatcttgggtgctgggctct

SEQ ID NO: 55492 - DNA, 20 bp, Homo sapiens
gatcaagactatgattacct

SEQ ID NO: 55493 - DNA, 20 bp, Homo sapiens
gatcattactttatcattag

SEQ ID NO: 55494 - DNA, 20 bp, Homo sapiens
gatccaatgttagagacttt

SEQ ID NO: 55495 - DNA, 20 bp, Homo sapiens
gatctcaaactatgacagaa

SEQ ID NO: 55496 - DNA, 20 bp, Homo sapiens
gatcagatctttgtttgtct

SEQ ID NO: 55497 - DNA, 20 bp, Homo sapiens
gatccgagggcagcagtgct

SEQ ID NO: 55498 - DNA, 20 bp, Homo sapiens
gatcctggtgggcatagtgc

SEQ ID NO: 55499 - DNA, 20 bp, Homo sapiens
gatcatttgtttttccaggg

SEQ ID NO: 55500 - DNA, 20 bp, Homo sapiens
gatcctgggagtcgtcctga

SEQ ID NO: 55501 - DNA, 20 bp, Homo sapiens
gatctgttaacaaaggactg

SEQ ID NO: 55502 - DNA, 20 bp, Homo sapiens
gatcattttagctatgttca

SEQ ID NO: 55503 - DNA, 20 bp, Homo sapiens
gatcatgagggacttggagg

SEQ ID NO: 55504 - DNA, 20 bp, Homo sapiens
gatccagactggcctggatg

SEQ ID NO: 55505 - DNA, 20 bp, Homo sapiens
gatccagagcacagatctgt

SEQ ID NO: 55506 - DNA, 20 bp, Homo sapiens
gatcccagcactcagtccgc

SEQ ID NO: 55507 - DNA, 20 bp, Homo sapiens
gatcctaaatcaagtactgc

SEQ ID NO: 55508 - DNA, 20 bp, Homo sapiens
gatctgttatataacatttg

SEQ ID NO: 55509 - DNA, 20 bp, Homo sapiens
gatccaccatggtggagcac

SEQ ID NO: 55510 - DNA, 20 bp, Homo sapiens
gatctatttagatttacagc

SEQ ID NO: 55511 - DNA, 20 bp, Homo sapiens
gatctttgatgaagtgtacc

SEQ ID NO: 55512 - DNA, 20 bp, Homo sapiens
gatcaaaatgtgtccatgac

SEQ ID NO: 55513 - DNA, 20 bp, Homo sapiens
gatcactcttattgtacgct

SEQ ID NO: 55514 - DNA, 20 bp, Homo sapiens
gatccagtctatctttacca

SEQ ID NO: 55515 - DNA, 20 bp, Homo sapiens
gatccgcccgcctttgcatc

SEQ ID NO: 55516 - DNA, 20 bp, Homo sapiens
gatcctatttttcatccttt

SEQ ID NO: 55517 - DNA, 20 bp, Homo sapiens
gatcttggtttggcttcatg

SEQ ID NO: 55518 - DNA, 20 bp, Homo sapiens
gatcttgtctgtccactcac

SEQ ID NO: 55519 - DNA, 20 bp, Homo sapiens
gatcatatggctctcaggaa

SEQ ID NO: 55520 - DNA, 20 bp, Homo sapiens
gatctctggaagcaggtagg

SEQ ID NO: 55521 - DNA, 20 bp, Homo sapiens
gatcaaacttgaggaatctg

SEQ ID NO: 55522 - DNA, 20 bp, Homo sapiens
gatcagcaaagaaaacacca

SEQ ID NO: 55523 - DNA, 20 bp, Homo sapiens
gatcccaaagccaaggagaa

SEQ ID NO: 55524 - DNA, 20 bp, Homo sapiens
gatcaggtgatgaattcttc

SEQ ID NO: 55525 - DNA, 20 bp, Homo sapiens
gatcactaaactacagtggt

SEQ ID NO: 55526 - DNA, 20 bp, Homo sapiens
gatccccagtgtcccccttc

SEQ ID NO: 55527 - DNA, 20 bp, Homo sapiens
gatcaaggcgggaggctgcc

SEQ ID NO: 55528 - DNA, 20 bp, Homo sapiens
gatcaaaggccttcaggacc

SEQ ID NO: 55529 - DNA, 20 bp, Homo sapiens
gatcctagccaccaggcact

SEQ ID NO: 55530 - DNA, 20 bp, Homo sapiens
gatccaaattgtggggaatc

SEQ ID NO: 55531 - DNA, 20 bp, Homo sapiens
gatcacacagagaccccctg

SEQ ID NO: 55532 - DNA, 20 bp, Homo sapiens
gatctcttgggatttctcct

SEQ ID NO: 55533 - DNA, 20 bp, Homo sapiens
gatcaggcccccattgcgaa

SEQ ID NO: 55534 - DNA, 20 bp, Homo sapiens
gatcttcgctggactggcct

SEQ ID NO: 55535 - DNA, 20 bp, Homo sapiens
gatcaggaggcttctttatg

SEQ ID NO: 55536 - DNA, 20 bp, Homo sapiens
gatcctccaggaggagctgt

SEQ ID NO: 55537 - DNA, 20 bp, Homo sapiens
gatcaaataatcagagaaaa

SEQ ID NO: 55538 - DNA, 20 bp, Homo sapiens
gatcaaaatgcttttattag

SEQ ID NO: 55539 - DNA, 20 bp, Homo sapiens
gatctttaccctaaaatagt

SEQ ID NO: 55540 - DNA, 20 bp, Homo sapiens
gatcccataatgcatcctca

SEQ ID NO: 55541 - DNA, 20 bp, Homo sapiens
gatccccaatacccagcccc

SEQ ID NO: 55542 - DNA, 20 bp, Homo sapiens
gatcctgcaaggggacattc

SEQ ID NO: 55543 - DNA, 20 bp, Homo sapiens
gatcgggcatccgcaaaggt

SEQ ID NO: 55544 - DNA, 20 bp, Homo sapiens
gatcattatcagcctgtgcc

SEQ ID NO: 55545 - DNA, 20 bp, Homo sapiens
gatcctctgaagagcactga

SEQ ID NO: 55546 - DNA, 20 bp, Homo sapiens
gatcgcctcctgaaacgaac

SEQ ID NO: 55547 - DNA, 20 bp, Homo sapiens
gatccccacctgcatcattc

SEQ ID NO: 55548 - DNA, 20 bp, Homo sapiens
gatctgaagaagactttcac

SEQ ID NO: 55549 - DNA, 20 bp, Homo sapiens
gatcaaaggaaaagattgat

SEQ ID NO: 55550 - DNA, 20 bp, Homo sapiens
gatcatacagatgaggtgag

SEQ ID NO: 55551 - DNA, 20 bp, Homo sapiens
gatcctccagtccatcttaa

SEQ ID NO: 55552 - DNA, 20 bp, Homo sapiens
gatcttaaaataatgcaaaa

SEQ ID NO: 55553 - DNA, 20 bp, Homo sapiens
gatctttattattaagtaac

SEQ ID NO: 55554 - DNA, 20 bp, Homo sapiens
gatcaggttgcaaaggacat

SEQ ID NO: 55555 - DNA, 20 bp, Homo sapiens
gatctacaatgagactgtcc

SEQ ID NO: 55556 - DNA, 20 bp, Homo sapiens
gatcaaaggagaagccagga

SEQ ID NO: 55557 - DNA, 20 bp, Homo sapiens
gatcacagcccggacaacag

SEQ ID NO: 55558 - DNA, 20 bp, Homo sapiens
gatccaaaaaaccattcagg

SEQ ID NO: 55559 - DNA, 20 bp, Homo sapiens
gatccacaggggatgttacc

SEQ ID NO: 55560 - DNA, 20 bp, Homo sapiens
gatccaccctgactatgatg

SEQ ID NO: 55561 - DNA, 20 bp, Homo sapiens
gatctcagtctttgtgcgcc

SEQ ID NO: 55562 - DNA, 20 bp, Homo sapiens
gatctcatcctcatacttgt

SEQ ID NO: 55563 - DNA, 20 bp, Homo sapiens
gatcaagagcagaggaggaa

SEQ ID NO: 55564 - DNA, 20 bp, Homo sapiens
gatcacacagagaaatgtga

SEQ ID NO: 55565 - DNA, 20 bp, Homo sapiens
gatctgtgtttcaataaatt

SEQ ID NO: 55566 - DNA, 20 bp, Homo sapiens
gatcgccacctacaggcgcc

SEQ ID NO: 55567 - DNA, 20 bp, Homo sapiens
gatctcccacatgccagggg

SEQ ID NO: 55568 - DNA, 20 bp, Homo sapiens
gatctcttcctttgtgctgg

SEQ ID NO: 55569 - DNA, 20 bp, Homo sapiens
gatcactttagcccaggaat

SEQ ID NO: 55570 - DNA, 20 bp, Homo sapiens
gatcattagcctgcagtata

SEQ ID NO: 55571 - DNA, 20 bp, Homo sapiens
gatcatatttgcctatggat

SEQ ID NO: 55572 - DNA, 20 bp, Homo sapiens
gatctggatgcaccgtaaca

SEQ ID NO: 55573 - DNA, 20 bp, Homo sapiens
gatcaccatctattagaata

SEQ ID NO: 55574 - DNA, 20 bp, Homo sapiens
gatccaaagagccctcctgg

SEQ ID NO: 55575 - DNA, 20 bp, Homo sapiens
gatccttagaaggagccata

SEQ ID NO: 55576 - DNA, 20 bp, Homo sapiens
gatcagtggacaggtagctg

SEQ ID NO: 55577 - DNA, 20 bp, Homo sapiens
gatcatcaaacagtagtgtt

SEQ ID NO: 55578 - DNA, 20 bp, Homo sapiens
gatcaccaagttccctttca

SEQ ID NO: 55579 - DNA, 20 bp, Homo sapiens
gatcaacccgctggtccctc

SEQ ID NO: 55580 - DNA, 20 bp, Homo sapiens
gatcaaagtgttaggggaaa

SEQ ID NO: 55581 - DNA, 20 bp, Homo sapiens
gatcaggctttgaatttaat

SEQ ID NO: 55582 - DNA, 20 bp, Homo sapiens
gatccatctggtggtaagaa

SEQ ID NO: 55583 - DNA, 20 bp, Homo sapiens
gatcacattgacctggcagc

SEQ ID NO: 55584 - DNA, 20 bp, Homo sapiens
gatcaaactacatattgtaa

SEQ ID NO: 55585 - DNA, 20 bp, Homo sapiens
gatcgcgtcattgcagtcca

SEQ ID NO: 55586 - DNA, 20 bp, Homo sapiens
gatcttaacatggatattgg

SEQ ID NO: 55587 - DNA, 20 bp, Homo sapiens
gatcctctgctgacccctgg

SEQ ID NO: 55588 - DNA, 20 bp, Homo sapiens
gatcttggtttgtgataaaa

SEQ ID NO: 55589 - DNA, 20 bp, Homo sapiens
gatctgttcaattatttttc

SEQ ID NO: 55590 - DNA, 20 bp, Homo sapiens
gatcataacagtctttatgt

SEQ ID NO: 55591 - DNA, 20 bp, Homo sapiens
gatccggttccactccttct

SEQ ID NO: 55592 - DNA, 20 bp, Homo sapiens
gatctgacaaatactgccca

SEQ ID NO: 55593 - DNA, 20 bp, Homo sapiens
gatccccaaaattttaaact

SEQ ID NO: 55594 - DNA, 20 bp, Homo sapiens
gatctgctggaggaaggaaa

SEQ ID NO: 55595 - DNA, 20 bp, Homo sapiens
gatcccggggccgcctctgt

SEQ ID NO: 55596 - DNA, 20 bp, Homo sapiens
gatcacagactccctacctt

SEQ ID NO: 55597 - DNA, 20 bp, Homo sapiens
gatctctttctgtgtgtatt

SEQ ID NO: 55598 - DNA, 20 bp, Homo sapiens
gatcataaacaatcttatgt

SEQ ID NO: 55599 - DNA, 20 bp, Homo sapiens
gatccctcactgaaattctt

SEQ ID NO: 55600 - DNA, 20 bp, Homo sapiens
gatctcatgaaaaggtatct

SEQ ID NO: 55601 - DNA, 20 bp, Homo sapiens
gatctcagacataaaggtgc

SEQ ID NO: 55602 - DNA, 20 bp, Homo sapiens
gatctttttctgctaactgt

SEQ ID NO: 55603 - DNA, 20 bp, Homo sapiens
gatcgagccggactctcggc

SEQ ID NO: 55604 - DNA, 20 bp, Homo sapiens
gatcgtgacgactcgaaata

SEQ ID NO: 55605 - DNA, 20 bp, Homo sapiens
gatctctctcccctgcgagc

SEQ ID NO: 55606 - DNA, 20 bp, Homo sapiens
gatcaggatagctgccgact

SEQ ID NO: 55607 - DNA, 20 bp, Homo sapiens
gatcccttgcattcacagcc

SEQ ID NO: 55608 - DNA, 20 bp, Homo sapiens
gatcgctctatgggctcctt

SEQ ID NO: 55609 - DNA, 20 bp, Homo sapiens
gatctgcagcaagtcggctc

SEQ ID NO: 55610 - DNA, 20 bp, Homo sapiens
gatctctgagctcaagcaaa

SEQ ID NO: 55611 - DNA, 20 bp, Homo sapiens
gatcatgtgtgcaggctccg

SEQ ID NO: 55612 - DNA, 20 bp, Homo sapiens
gatcctgaccgtcggaaaca

SEQ ID NO: 55613 - DNA, 20 bp, Homo sapiens
gatcaaggtgaacttgccct

SEQ ID NO: 55614 - DNA, 20 bp, Homo sapiens
gatcacaggcttttctggga

SEQ ID NO: 55615 - DNA, 20 bp, Homo sapiens
gatccattccacaatgtata

SEQ ID NO: 55616 - DNA, 20 bp, Homo sapiens
gatcacaccatcgagaacaa

SEQ ID NO: 55617 - DNA, 20 bp, Homo sapiens
gatcagttgaaaaaagtcca

SEQ ID NO: 55618 - DNA, 20 bp, Homo sapiens
gatccaaagaaatttctctc

SEQ ID NO: 55619 - DNA, 20 bp, Homo sapiens
gatcaaactctgtgtagaac

SEQ ID NO: 55620 - DNA, 20 bp, Homo sapiens
gatcctcaccaactacatgg

SEQ ID NO: 55621 - DNA, 20 bp, Homo sapiens
gatcggcgtaacaaccgcat

SEQ ID NO: 55622 - DNA, 20 bp, Homo sapiens
gatccccatggtgctcatcg

SEQ ID NO: 55623 - DNA, 20 bp, Homo sapiens
gatcaactcttgtacaaaat

SEQ ID NO: 55624 - DNA, 20 bp, Homo sapiens
gatcaaaaggcataaaccag

SEQ ID NO: 55625 - DNA, 20 bp, Homo sapiens
gatcattgctacagaatgaa

SEQ ID NO: 55626 - DNA, 20 bp, Homo sapiens
gatcaaaaatactgtgaaat

SEQ ID NO: 55627 - DNA, 20 bp, Homo sapiens
gatcagaagtcttagaaatc

SEQ ID NO: 55628 - DNA, 20 bp, Homo sapiens
gatcagaggaagagatggct

SEQ ID NO: 55629 - DNA, 20 bp, Homo sapiens
gatctggggtctgttttgtt

SEQ ID NO: 55630 - DNA, 20 bp, Homo sapiens
gatcagttcattattttatt

SEQ ID NO: 55631 - DNA, 20 bp, Homo sapiens
gatctcataattgaaaagag

SEQ ID NO: 55632 - DNA, 20 bp, Homo sapiens
gatcattctcatttcacaga

SEQ ID NO: 55633 - DNA, 20 bp, Homo sapiens
gatcttagcaccggccaaat

SEQ ID NO: 55634 - DNA, 20 bp, Homo sapiens
gatcatgcccaccaccgtgg

SEQ ID NO: 55635 - DNA, 20 bp, Homo sapiens
gatcctgccaaattcttcca

SEQ ID NO: 55636 - DNA, 20 bp, Homo sapiens
gatccggcagacaggcatgg

SEQ ID NO: 55637 - DNA, 20 bp, Homo sapiens
gatcctagccaggcacctta

SEQ ID NO: 55638 - DNA, 20 bp, Homo sapiens
gatcagcattgagagggcct

SEQ ID NO: 55639 - DNA, 20 bp, Homo sapiens
gatcagccgcattctgtacc

SEQ ID NO: 55640 - DNA, 20 bp, Homo sapiens
gatcaagggccttatgtgga

SEQ ID NO: 55641 - DNA, 20 bp, Homo sapiens
gatcaattcaagtggtaaaa

SEQ ID NO: 55642 - DNA, 20 bp, Homo sapiens
gatcactccagttctctgtg

SEQ ID NO: 55643 - DNA, 20 bp, Homo sapiens
gatcatatgagttgatgtga

SEQ ID NO: 55644 - DNA, 20 bp, Homo sapiens
gatccattttctttcaaaat

SEQ ID NO: 55645 - DNA, 20 bp, Homo sapiens
gatctcaacaaaatagtaaa

SEQ ID NO: 55646 - DNA, 20 bp, Homo sapiens
gatcaaattgtttatggttt

SEQ ID NO: 55647 - DNA, 20 bp, Homo sapiens
gatcaaatggctgcctttcc

SEQ ID NO: 55648 - DNA, 20 bp, Homo sapiens
gatcttcatggaacatactg

SEQ ID NO: 55649 - DNA, 20 bp, Homo sapiens
gatccctggaggggctgaat

SEQ ID NO: 55650 - DNA, 20 bp, Homo sapiens
gatccagagctgcctcacgc

SEQ ID NO: 55651 - DNA, 20 bp, Homo sapiens
gatctgtctcctgcccctag

SEQ ID NO: 55652 - DNA, 20 bp, Homo sapiens
gatcaattaaatgtaggtat

SEQ ID NO: 55653 - DNA, 20 bp, Homo sapiens
gatcagtaattaaagaaaac

SEQ ID NO: 55654 - DNA, 20 bp, Homo sapiens
gatctatcaatgttctcctc

SEQ ID NO: 55655 - DNA, 20 bp, Homo sapiens
gatcacttatatcactctgt

SEQ ID NO: 55656 - DNA, 20 bp, Homo sapiens
gatcatatattttgtttcac

SEQ ID NO: 55657 - DNA, 20 bp, Homo sapiens
gatcatctttctattctgtt

SEQ ID NO: 55658 - DNA, 20 bp, Homo sapiens
gatcgatagatatctataga

SEQ ID NO: 55659 - DNA, 20 bp, Homo sapiens
gatctcacagagttcaaaca

SEQ ID NO: 55660 - DNA, 20 bp, Homo sapiens
gatcttcatttacaagtata

SEQ ID NO: 55661 - DNA, 20 bp, Homo sapiens
gatcccagaatacttgaagg

SEQ ID NO: 55662 - DNA, 20 bp, Homo sapiens
gatctgttaatttactacaa

SEQ ID NO: 55663 - DNA, 20 bp, Homo sapiens
gatccttcgtcaaaacaccc

SEQ ID NO: 55664 - DNA, 20 bp, Homo sapiens
gatcaatcccgtgtcctgaa

SEQ ID NO: 55665 - DNA, 20 bp, Homo sapiens
gatcatcatccgtgacctca

SEQ ID NO: 55666 - DNA, 20 bp, Homo sapiens
gatctatgacactcccactt

SEQ ID NO: 55667 - DNA, 20 bp, Homo sapiens
gatctcatctgccaggtaga

SEQ ID NO: 55668 - DNA, 20 bp, Homo sapiens
gatcatcttgaagtttctac

SEQ ID NO: 55669 - DNA, 20 bp, Homo sapiens
gatccatggggaaaatatcc

SEQ ID NO: 55670 - DNA, 20 bp, Homo sapiens
gatctaagacagagagagag

SEQ ID NO: 55671 - DNA, 20 bp, Homo sapiens
gatccacgagatacatatag

SEQ ID NO: 55672 - DNA, 20 bp, Homo sapiens
gatctgccagtaccagcctt

SEQ ID NO: 55673 - DNA, 20 bp, Homo sapiens
gatcaggtcttcagattcca

SEQ ID NO: 55674 - DNA, 20 bp, Homo sapiens
gatccccctcttcaatgatg

SEQ ID NO: 55675 - DNA, 20 bp, Homo sapiens
gatctccgtaaccatttgca

SEQ ID NO: 55676 - DNA, 3386 bp, Homo sapiens
ttgctgcagacgctcaccccagacactcactgcaccggagtgagcgcgaccatcatgtccatgctcgtggtctttctcttgctgtggggtgtcacctggggcccagtgacagaagcagccatattttatgagacgcagcccagcctgtgggcagagtccgaatcactgctgaaacccttggccaatgtgacgctgacgtgccaggcccacctggagactccagacttccagctgttcaagaatggggtggcccaggagcctgtgcaccttgactcacctgccatcaagcaccagttcctgctgacgggtgacacccagggccgctaccgctgccgctcgggcttgtccacaggatggacccagctgagcaagctcctggagctgacagggccaaagtccttgcctgctccctggctctcgatggcgccagtgtcctggatcacccccggcctgaaaacaacagcagtgtgccgaggtgtgctgcggggtgtgacttttctgctgaggcgggagggcgaccatgagtttctggaggtgcctgaggcccaggaggatgtggaggccacctttccagtccatcagcctggcaactacagctgcagctaccggaccgatggggaaggcgccctctctgagcccagcgctactgtgaccattgaggagctcgctgcaccaccaccgcctgtgctgatgcaccatggagagtcctcccaggtcctgcaccctggcaacaaggtgaccctcacctgcgtggctcccctgagtggagtggacttccagctacggcgcggggagaaagagctgctggtacccaggagcagcaccagcccagatcgcatcttctttcacctgaacgcggtggccctgggggatggaggtcactacacctgccgctaccggctgcatgacaaccaaaacggctggtccggggacagcgcgccggtcgagctgattctgagcgatgagacgctgcccgcgccggagttctccccggagccggagtccggcagggccttgcggctgcggtgcctggcgcccctggagggcgcgcgcttcgccctggtgcgcgaggacaggggcgggcgccgcgtgcaccgtttccagagccccgctgggaccgaggcgctcttcgagctgcacaacatttccgtggctgactccgccaactacagctgcgtctacgtggacctgaagccgcctttcgggggctccgcgcccagcgagcgcttggagctgcacgtggacggaccccctcccaggcctcagctccgggcgacgtggagtggggcggtcctggcgggccgagatgccgtcctgcgctgcgagggacccatccccgacgtcaccttcgagctgctgcgcgagggcgagacgaaggccgtgaagacggtccgcacccccggggccgcggcgaacctcgagctgatcttcgtggggccccagcacgccggcaactacaggtgccgctaccgctcctgggtgccccacaccttcgaatcggagctcagcgaccctgtggagctcctggtggcagaaagctgatgcagccgcgggcccagggtgctgttggtgtcctcagaagtgccggggattctggactggctccctcccctcctgttgcagcacaaggccggggtctctggggggctggagaagcctccctcattcctcccaggaattaataaatgtgaagagagctctgtttaaaatgtctttggactcccagggctgagtgggctgggatctcgtgtcctcaaagtggatgggttctggggtggctcctgaggtagaggagtggagaactggctcttaagagcacagttttcttttcttttttcttttttgagacagggtctcacactgtcacccaggctggagtgcagtgttgcagtccggctcactgcagttttgacctcccaggctcaagcgatcctcctgcctcagcctcccaagtagctgggagcctgggcatgcatcgccacgtctggctaattattattttttgtagacagggtctcactgtgttgcccaagcttgtcttgaactcctggccttaagtgatcctcccacctcagcctcctgagtagctgggactacaggcatgagccaccatgcctggccaactcacatttttctttctattatttattttttgtagagatgagtctcactatgttgcccaggctggtcttgaactcttgggctcaagtgatcctcccgcctcagcctcccaaagtgttgggattacaggtgtgagccacagcacctggccaaccaacacttctcagggcctctttcatctgtgctcttccaggatgctgcctcttactccctgggcacctcggcctggtcccagcaggtatgggcaggttgcttgaggctccagacatactcacctctacctcgaccacatcaaccccatcaccaagaggaggttcagggaagctgcattttgtggtcttgtcctcccagtccagggtggtagtgctgggctgttcccagcctcccacagcagagctggacgctgtggaaatggctggattcctctgtgttctttcccattatccctcagctctgagtcctcttgtgccatctgacatctgatgccttcccaaccactgccgagtttctgcctggagcagggcctcaaggccctggcacacagaagatgcgtatcagtattatcaaccaatagttgatgaattgtgtttttcaacgaatttgctagtgatctggtttactgccttagtaatatctagttcctaatatgcctatgccttttaatgtctgcacagtctgtgatgatgtcacttctctcaagcctgatgtgtcctctctctctttcttgctagtggtttatcaatttttaaaaccttttcttgtttatttgtttttgagacagaattttgctcttgttgcccaggctggagtgcaatggcgtgatcttggctcacagcaacctctacctcctgggttcaagtgattctcgtgcctcagcctcctgagtagctgggctgacaggcacccaccaccacacccagctaatttttatgtttttagtagagatggggtttcaccttgttgggtggccaggctggtctccaactcctgagctcaggtgatccacccgcctcagcctcccaaagtgctgggattacaggggtgagccaccacgcccagccccagcttagttttttaaaaagtttattttagccattctaataggtatgtagacatatctaatagtggttttccttgcgtttccttaatgtctgatgatgttaagcattttttccccaagtgcttagttgccatctatatagcatctttgatgaaatgtctgtttatatattttgcacactttaaaatattgggttgttttcttt

SEQ ID NO: 55677 - DNA, 1725 bp, Homo sapiens
aagcacactgcttattaaagtacactattcaggcatatcatgtaggtttactttctgtgtttctagagaccaagaagcgggacgttcaccatgggaagaaaatcgctgtaccttctgattgtggggatcctcatagcatattatatttatacgcctctcccagataacgttgaggagccatggagaatgatgtggataaacgcacatctgaaaactatacaaaatttggctacatttgtggagctcctgggacttcaccattttatggattcctttaaggttgtcgggagctttgatgaagtcccaccaacctcagatgaaaatgtcactgtgactgagacaaaattcaacaacattcttgttcgggtatatgtgccaaagagaaagtctgaagcactaagaagggggttgttttacatccatggtggaggctggtgcgtgggaagtgctgctctaagtggttatgacttgctgtcaagatggacagcagacagacttgatgctgtcgtcgtatcaaccaactacagattagcacctaagtatcatttcccaattcaatttgaagatgtatataatgccttaaggtggttcttacgtaaaaaagttcttgcaaaatatggtgtgaaccctgagagaatcggtatttctggagatagtgcaggagggaatttagctgcagcagtgactcaacagctccttgatgacccagatgtcaagatcaaactcaagatccagtctttaatttatcctgcccttcagcctcttgatgtagatttaccgtcatatcaagaaaattcaaattttctatttctatccaaatcactcatggtcagattctggagtgaatattttaccactgatagatcacttgaaaaagccatgctttccagacaacatgtacctgtggaatcaagtcatctcttcaaatttgttaattggagttccctgctccctgagaggtttataaaaggacatgtttataacaatccaaattatggcagttctgagctggctaaaaaatatccagggttcctagatgtgagggcagcccctttgttggctgatgacaacaaattacgtggcttacccctgacctatgtcatcacctgtcaatatgatctcttaagagatgatggactcatgtatgtcacccgacttcgcaacactggggttcaggtgactcataaccatgttgaggatggattccatggagcattttcatttctgggacttaaaattagtcacagacttataaatcagtatattgagtggctaaaggaaaatctatagtaaaacatgtagctataacatattttaaaaataaaatctgaaaacctcagaaaatttgcattagaaattggtctttcttagaatggtctagttaagttccacatgtagcataattcttaaataggcacttttctgttttttttttcttactgtgggatttcatttcaattttctacattgtctatctgctttttctgagattttccttcttacactgttaatcttattttaaaaaatattacattcttgtatactttatttttgtgagttggctactatttacgatgcaagagaataaatgtgagcaaatattgccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 55678 - DNA, 4763 bp, Homo sapiens
ggctcactgcaaccccgcctcctgggttcaagcaattctcctgcctcagcctcccaaggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgtccccataggttacagccaccccgccctgctgaaactcatccaacagcctcaaaatgcgagcatgtttgtcaacagacccgccctcggaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggcttctcccaggaggagctggagacgtgcatgattaaccaggcccctggctgccccgactacagcatcctctccttcatgggcgcgttccatgggaggaccatgggttgcttagcgaccacgcactctaaagccattcacaagatcgacatcccttcctttgactggcccatcgcaccgttcccacggctgaaataccctctggaagagtttgtgaaagagaaccaacaggaggaggcccgctgtctggaagaggtggaggatctgattgtgaaatatcggaaaaagaagaagacggtggccgggatcatcgtggagcccatccagtccgagggtggagacaaccacgcatccgatgacttctttcggaagctgagagacatcgccaggaagcatggctgcgccttcttggtggacgaggtccagaccggaggaggctgcacgggcaagttctgggcccatgagcactggggcctggatgacccagcagacgtgatgaccttcagcaagaagatgatgactgggggcttcttccacaaggaggagttcaggcctaatgctccctaccggatcttcaacacctggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaaggtgtggtgttgggtggctgtggtgacaaatccattcgtttccgtcccacgctggtcttcagggatcaccacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatcagaggtgaatgcacagtgaagggtgatttgtggggagggagcatttttggtggtcttgggggaggggaggggagggaagggctggtgttgattttcctccctgcagagccaatggtgcacattggtttaagcccagagatcctgcttgagccctggactcatcttgggaagggccatgggaggtcctggctagagttctgcccaaccttgaccaaccccagcaatttttccaaaagccagtcaagggcattacatttgttcctgggactggcagctgggcctcctgggtgccagtccatctcaagtgccatattctgtgatcacggatgttggctccccctcgccctatgcaagcaaacacactctcacctcctctcccagcctcccggagctctgagcacgccccacgcatggtgcaggagggactggacagatctgaggaaggccgtaaaatggggacaggaggattcagctcaggagtaagggaagaggtcctctggccccctgaagatgagaatcacccctctcagtgcacctggggatccccctaaactgtgaattctgccctggacagggctttgcccttggaggatccccaggtggccttacccgtgattcttactcggcatcctccattccccaaactccctcctccctgttaaatgtcaacctagacctggacctgggtgggaggaaactgtagcctgagtgtccacagggacacacgtgagccacagggctagaagcacaggcccgtcaccccaggaggaaaagcccagggtctggggcagcagagccatcgcatcatgtttcccagggcaacttgaggtctgacttttggctccctcgccctaagaggctcttcctctcttttgctcatccaccttcacaccacttgtgagctgacccccaggaacagcttggctgttccaccagagcagagggaatcattgctggactggatttcttctggagggaagcaccatgaattaaaggtgccagagctccatgcatggaaaagtggcctgttggttcaacgtggtttccttgtacttgatcctcctgaaatgagagattttcctgagatgactgagtatggagattaccaggcagatgataccgaaatgcttaaaggggctgtggctgaggctgtagcatctctgctggaggtgagacactctgggaactgatttgacctcgaatgctcctaaaagagaacttgatagcctgacagcagagaagtattatttggtggggagtctgagaaagcctggcttgtattatctgtccaaaaggaagcctcttcatctcccggtgccttggttgactattttggaaataggcatatcaaggttcctgattcagcactttgctcttttaataacaaatcgtccaaagatctcaaagtaagggtttttttttttagcttccactcttccgcagacttggtcatcgacctatttttgttgaagaatgaaaggcaatgacaagtttaacatatacaaattcgtgaattcttgttcattttgcattcctgcagtcagtgctaatccgtcgttcttaatcaggagttctgccaggtttaaggtcacctgcactcccagccaagtggtgatgtatgcctcccactctctgcaaggttttcctcatttttatattcatttattcatcattcattcattcacctaactttcattaaatagctgcaccatcccaggccctgtgcggagcatcgggaatacaaagatgagataaaacattgtccctgcccccgggggctcacatgccactggaaacaacagactcttaaactaacaattcaagcaggcgccaagtgctacgacagaggtgtgaataaaagcatcaggaaatcggatggagaaccaccattcacccaagggtcagaggaggtttcaaagaaaaggtgtcattggagcagtgttttgcagaatgagccagagttcaccaagcaggcaaggcaaggaagggtgttgcagagagggaacagcatatgcaaaggcatatcagttcatggcatcacatctttcactggggaagccagtttccacaggcagcatcccaaggttcaataaggccttatttaacaagcaagcaaaatgcaaaccaaaccattattcatttattggcttaagtatgctttctcctgaaaactttagcattgggtgcaaatattcagtatggttctcggagtccaaagggttttaagccagggcacaaccagaaaagtggctctctttggtagggagaggggctccaatatttcgttctctccccatggggcactgacagagaaatgaaatagttttatctggaaaattccagagctattatttactccttaccaagggaagttacttcttgtaaaaacttttaagccatttatcaacaagttcttgttgactcagggcataatgagttcctgagacatgctcttttgggggctggggctttaggtagaagaatttcaaggaaaagaattctcagcagagctcaagattgtagaaactcagcagaagctggtaaaaacatggggagcccggaggacaggctgctgtccagggcagaggccatgaagaagtgcttccgtggccgacagtctggaaatgaatccatcatacattagtgccatagagtttagtaaccgtccagcaagtgtcatcacttttacagaaaacaaggtccagtaatagcaagtcttagtacatcctcacttttattataaatgggtgttttttcataatttttactgacgctcagtaaccatgcaaaattgtgtatagcattaatgtatctacatacctacacctatctatatataagctcatggtagaaaaccatagctaagtagcatcgcagacttaagcgtacaaagtgatcttgttcacaagtaatctgttgacagtgccaataaatgataaaaaaaaaattaacatgtcacaatgtaacggatgaccatatgcacaattccatgaattaaatctgtttcctgtgttagtcagtattcttaaataaaatttataattgaaacatgaaaaaaaaaaaaaaaaaa

SEQ ID NO: 55679 - DNA, 4830 bp, Homo sapiens
gggagtccggcgagtcgctgggggaagtcgagcagacacccagcgctgccggaactcggggcgcgcatcccgcaagtcggaacccggcggatcggatcccgcagatcggagacggggcctggagggtggcagcacgcaaagggtgtccctgtccctcaaggggtcatggcctccatgttgctcgcccagcgcctggcctgcagcttccagcacagctaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgtccccataggttacagccaccccgccctgctgaaactcatccaacagcctcaaaatgcgagcatgtttgtcaacagacccgccctcggaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggcttctcccaggaggagctggagacgtgcatgattaaccaggcccctggctgccccgactacagcatcctctccttcatgggcgcgttccatgggaggaccatgggttgcttagcgaccacgcactctaaagccattcacaagatcgacatcccttcctttgactggcccatcgcaccgttcccacggctgaaataccctctggaagagtttgtgaaagagaaccaacaggaggaggcccgctgtctggaagaggtggaggatctgattgtgaaatatcggaaaaagaagaagacggtggccgggatcatcgtggagcccatccagtccgagggtggagacaaccacgcatccgatgacttctttcggaagctgagagacatcgccaggaagcatggctgcgccttcttggtggacgaggtccagaccggaggaggctgcacgggcaagttctgggcccatgagcactggggcctggatgacccagcagacgtgatgaccttcagcaagaagatgatgactgggggcttcttccacaaggaggagttcaggcctaatgctccctaccggatcttcaacacctggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaaggtgtggtgttgggtggctgtggtgacaaatccattcgtttccgtcccacgctggtcttcagggatcaccacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatcagaggtgaatgcacagtgaagggtgatttgtggggagggagcatttttggtggtcttgggggaggggaggggagggaagggctggtgttgattttcctccctgcagagccaatggtgcacattggtttaagcccagagatcctgcttgagccctggactcatcttgggaagggccatgggaggtcctggctagagttctgcccaaccttgaccaaccccagcaatttttccaaaagccagtcaagggcattacatttgttcctgggactggcagctgggcctcctgggtgccagtccatctcaagtgccatattctgtgatcacggatgttggctccccctcgccctatgcaagcaaacacactctcacctcctctcccagcctcccggagctctgagcacgccccacgcatggtgcaggagggactggacagatctgaggaaggccgtaaaatggggacaggaggattcagctcaggagtaagggaagaggtcctctggccccctgaagatgagaatcacccctctcagtgcacctggggatccccctaaactgtgaattctgccctggacagggctttgcccttggaggatccccaggtggccttacccgtgattcttactcggcatcctccattccccaaactccctcctccctgttaaatgtcaacctagacctggacctgggtgggaggaaactgtagcctgagtgtccacagggacacacgtgagccacagggctagaagcacaggcccgtcaccccaggaggaaaagcccagggtctggggcagcagagccatcgcatcatgtttcccagggcaacttgaggtctgacttttggctccctcgccctaagaggctcttcctctcttttgctcatccaccttcacaccacttgtgagctgacccccaggaacagcttggctgttccaccagagcagagggaatcattgctggactggatttcttctggagggaagcaccatgaattaaaggtgccagagctccatgcatggaaaagtggcctgttggttcaacgtggtttccttgtacttgatcctcctgaaatgagagattttcctgagatgactgagtatggagattaccaggcagatgataccgaaatgcttaaaggggctgtggctgaggctgtagcatctctgctggaggtgagacactctgggaactgatttgacctcgaatgctcctaaaagagaacttgatagcctgacagcagagaagtattatttggtggggagtctgagaaagcctggcttgtattatctgtccaaaaggaagcctcttcatctcccggtgccttggttgactattttggaaataggcatatcaaggttcctgattcagcactttgctcttttaataacaaatcgtccaaagatctcaaagtaagggtttttttttttagcttccactcttccgcagacttggtcatcgacctatttttgttgaagaatgaaaggcaatgacaagtttaacatatacaaattcgtgaattcttgttcattttgcattcctgcagtcagtgctaatccgtcgttcttaatcaggagttctgccaggtttaaggtcacctgcactcccagccaagtggtgatgtatgcctcccactctctgcaaggttttcctcatttttatattcatttattcatcattcattcattcacctaactttcattaaatagctgcaccatcccaggccctgtgcggagcatcgggaatacaaagatgagataaaacattgtccctgcccccgggggctcacatgccactggaaacaacagactcttaaactaacaattcaagcaggcgccaagtgctacgacagaggtgtgaataaaagcatcaggaaatcggatggagaaccaccattcacccaagggtcagaggaggtttcaaagaaaaggtgtcattggagcagtgttttgcagaatgagccagagttcaccaagcaggcaaggcaaggaagggtgttgcagagagggaacagcatatgcaaaggcatatcagttcatggcatcacatctttcactggggaagccagtttccacaggcagcatcccaaggttcaataaggccttatttaacaagcaagcaaaatgcaaaccaaaccattattcatttattggcttaagtatgctttctcctgaaaactttagcattgggtgcaaatattcagtatggttctcggagtccaaagggttttaagccagggcacaaccagaaaagtggctctctttggtagggagaggggctccaatatttcgttctctccccatggggcactgacagagaaatgaaatagttttatctggaaaattccagagctattatttactccttaccaagggaagttacttcttgtaaaaacttttaagccatttatcaacaagttcttgttgactcagggcataatgagttcctgagacatgctcttttgggggctggggctttaggtagaagaatttcaaggaaaagaattctcagcagagctcaagattgtagaaactcagcagaagctggtaaaaacatggggagcccggaggacaggctgctgtccagggcagaggccatgaagaagtgcttccgtggccgacagtctggaaatgaatccatcatacattagtgccatagagtttagtaaccgtccagcaagtgtcatcacttttacagaaaacaaggtccagtaatagcaagtcttagtacatcctcacttttattataaatgggtgttttttcataatttttactgacgctcagtaaccatgcaaaattgtgtatagcattaatgtatctacatacctacacctatctatatataagctcatggtagaaaaccatagctaagtagcatcgcagacttaagcgtacaaagtgatcttgttcacaagtaatctgttgacagtgccaataaatgataaaaaaaaaattaacatgtcacaatgtaacggatgaccatatgcacaattccatgaattaaatctgtttcctgtgttagtcagtattcttaaataaaatttataattgaaacatgaaaaaaaaaaaaaaaaaa

SEQ ID NO: 55680 - DNA, 5764 bp, Homo sapiens
atctctatccttcttctggtccttcctagaaaatcaggtggagatgatagtggcttgcatgatggtggtagagctggaggtgcagggcaaaggtcagattctgaatatattttgaaagtaaaggcaacaagatttcctgacagattgattatggtgtgtcaaagaaagagaggaatgcaggatgattccagtgtttttgttgacaactataagtctggagctgccaactggatgcagaagttcactggagggcccagcctggggaaaggatcaggagcaggttaggcatgttaagcttgagatgtctgttaaacatccagataggaatgtcaaagatgcacttgtgtttaagagtcaggaatgcaagagggaattttaggctagaaacaaaaagttagaaattattcgatacagatggtatttaaagctgtgtgactgactgacatgacagaagtggcgagaatagactgagaagtccaaggaatgagccttggaccactccagtgttaggtaagtagttgaaaaaaagagagagagagaaggcatcaaaggagactgaggaagagtgatcaggaaagcataggaaaatccgagaaacatatggtgtcctggaatctatatgaaaaagatatattcagaaagacagagtgataaatctgtcaaattattgaatttgtcaggtaaaataagaacagagaattgatctttggacttagcaaagcagagattatcagtgacttttataaaaatagtttcggtagtgtggaaagatcaaacttctgtttagagtgggtttcagagagaacaacaggaattgaagaagtaataaactttgccaaccagtttagctccaaaggaaaagagggaaatatgatggtagctggcaggggaagtgtggtcaagagaggttttttgtttgtttttcaagatggaagaaataacagtatgtatgtaagctcacaggagggatccagcaggcatggggaaattgatgatataggacagaaagggaagaatggctccttgtgaaagtgaaaggggatgggatctacaggatgaacatgcaaacaaagactggctgcaaagagaggcatgaatagttcatttacagaaacagcaaaggcagagtgttggtacagatgctggtaagtggaaaaatatcatggtaggaggttatggagttccattctaaacacttcaacttcatcagtgaaataagcacggtaatttagcagaatgtgaagatgtaaaagaacagaatttgagaaaacagacgatatgaaataattattagaaaagcagagactgaagaaactgtcatctccttatgtgctaatgagtttaataatgtcctccagtcaccacaagccttctttcaaactacacaattccaactgcttccgtctcagagtatcttgaaataatgatctgaccgcctgttagaccagtgaagggaaggaatttgggttgatttaagaagagaatcctcatggtcatggtagactgatatggagagaaaacattttgaggaaaaatactcaactaaattcatttctactccagcatgcagtttcaagtcaagttccaccttagctccaggtggcaggcagagcaggatgcagaggcacagcacaagtaagggatccaatgactgagtcaagaattacataacctggccagacagctggtacatgggaaagtgctaagagggcaccaacagcgttcctcctccccaaggagcataatgtgatggttcctgccggccctggctgactctcgccgtccttggagataattgggttcagtgccacctggaccagaactggggatgcggaagcaacctgccagacacgcgcgaggttcgaggctgagatggatcttgaggcggcaaagaacggaacagcctggcgccccacgagcgcggagggcgactttgaactgggcatcagcagcaaacaaaaaaggaaaaaaacgaagacagtgaaaatgattggagtattaacattgtttcgatactccgattggcaggataaattgtttatgtcgctgggtaccatcatggccatagctcacggatcaggtctccccctcatgatgatagtatttggagagatgactgacaaatttgttgatactgcaggaaacttctcctttccagtgaacttttccttgtcgctgctaaatccaggcaaaattctggaagaagaaatgactagatatgcatattactactcaggattgggtgctggagttcttgttgctgcctatatacaagtttcattttggactttggcagctggtcgacagatcaggaaaattaggcagaagttttttcatgctattctacgacaggaaataggatggtttgacatcaatgacaccactgaactcaatacgcggctaacagatgacatctccaaaatcagtgaaggaattggtgacaaggttggaatgttctttcaagcagtagccacgttttttgcaggattcatagtgggattcatcagaggatggaagctcacccttgtgataatggccatcagccctattctaggactctctgcagccgtttgggcaaagatactctcggcatttagtgacaaagaactagctgcttatgcaaaagcaggcgccgtggcagaagaggctctgggggccatcaggactgtgatagctttcgggggccagaacaaagagctggaaaggtatcagaaacatttagaaaatgccaaagagattggaattaaaaaagctatttcagcaaacatttccatgggtattgccttcctgttaatatatgcatcatatgcactggccttctggtatggatccactctagtcatatcaaaagaatatactattggaaatgcaatgacagtttttttttcaatcctaattggagctttcagtgttggccaggctgccccatgtattgatgcttttgccaatgcaagaggagcagcatatgtgatctttgatattattgataataatcctaaaattgacagtttttcagagagaggacacaaaccagacagcatcaaagggaatttggagttcaatgatgttcacttttcttacccttctcgagctaacgtcaagatcttgaagggcctcaacctgaaggtgcagagtgggcagacggtggccctggttggaagtagtggctgtgggaagagcacaacggtccagctgatacagaggctctatgaccctgatgagggcacaattaacattgatgggcaggatattaggaactttaatgtaaactatctgagggaaatcattggtgtggtgagtcaggagccggtgctgttttccaccacaattgctgaaaatatttgttatggccgtggaaatgtaaccatggatgagataaagaaagctgtcaaagaggccaacgcctatgagtttatcatgaaattaccacagaaatttgacaccctggttggagagagaggggcccagctgagtggtgggcagaagcagaggatcgccattgcacgtgccctggttcgcaaccccaagatccttctgctggatgaggccacgtcagcattggacacagaaagtgaagctgaggtacaggcagctctggataaggccagagaaggccggaccaccattgtgatagcacaccgactgtctacggtccgaaatgcagatgtcatcgctgggtttgaggatggagtaattgtggagcaaggaagccacagcgaactgatgaagaaggaaggggtgtacttcaaacttgtcaacatgcagacatcaggaagccagatccagtcagaagaatttgaactaaatgatgaaaaggctgccactagaatggccccaaatggctggaaatctcgcctatttaggcattctactcagaaaaaccttaaaaattcacaaatgtgtcagaagagccttgatgtggaaaccgatggacttgaagcaaatgtgccaccagtgtcctttctgaaggtcctgaaactgaataaaacagaatggccctactttgtcgtgggaacagtatgtgccattgccaatggggggcttcagccggcattttcagtcatattctcagagatcatagcgatttttggaccaggcgatgatgcagtgaagcagcagaagtgcaacatattctctttgattttcttatttctgggaattatttctttttttactttcttccttcagggtttcacgtttgggaaagctggcgagatcctcaccagaagactgcggtcaatggcttttaaagcaatgctaagacaggacatgagctggtttgatgaccataaaaacagtactggtgcactttctacaagacttgccacagatgctgcccaagtccaaggagccacaggaaccaggttggctttaattgcacagaatatagctaaccttggaactggtattatcatatcatttatctacggttggcagttaaccctattgctattagcagttgttccaattattgctgtgtcaggaattgttgaaatgaaattgttggctggaaatgccaaaagagataaaaaagaactggaagctgctggaaagattgcaacagaggcaatagaaaatattaggacagttgtgtctttgacccaggaaagaaaatttgaatcaatgtatgttgaaaaattgtatggaccttacaggaattctgtgcagaaggcacacatctatggaattacttttagtatctcacaagcatttatgtatttttcctatgccggttgttttcgatttggtgcatatctcattgtgaatggacatatgcgcttcagagatgttattctggtgttttctgcaattgtatttggtgcagtggctctaggacatgccagttcatttgctccagactatgctaaagctaagctgtctgcagcccacttattcatgctgtttgaaagacaacctctgattgacagctacagtgaagaggggctgaagcctgataaatttgaaggaaatataacatttaatgaagtcgtgttcaactatcccacccgagcaaacgtgccagtgcttcaggggctgagcctggaggtgaagaaaggccagacactagccctggtgggcagcagtggctgtgggaagagcacggtggtccagctcctggagcggttctacgaccccttggcggggacagtgcttctcgatggtcaagaagcaaagaaactcaatgtccagtggctcagagctcaactcggaatcgtgtctcaggagcctatcctatttgactgcagcattgccgagaatattgcctatggagacaacagccgggttgtatcacaggatgaaattgtgagtgcagccaaagctgccaacatacatcctttcatcgagacgttaccccacaaatatgaaacaagagtgggagataaggggactcagctctcaggaggtcaaaaacagaggattgctattgcccgagccctcatcagacaacctcaaatcctcctgttggatgaagctacatcagctctggatactgaaagtgaaaaggttgtccaagaagccctggacaaagccagagaaggccgcacctgcattgtgattgctcaccgcctgtccaccatccagaatgcagacttaatagtggtgtttcagaatgggagagtcaaggagcatggcacgcatcagcagctgctggcacagaaaggcatctatttttcaatggtcagtgtccaggctgggacacagaacttatgaacttttgctacagtatattttaaaaataaattcaaattattctacccatttt

SEQ ID NO: 55681 - DNA, 5785 bp, Homo sapiens
atctctatccttcttctggtccttcctagaaaatcaggtggagatgatagtggcttgcatgatggtggtagagctggaggtgcagggcaaaggtcagattctgaatatattttgaaagtaaaggcaacaagatttcctgacagattgattatggtgtgtcaaagaaagagaggaatgcaggatgattccagtgtttttgttgacaactataagtctggagctgccaactggatgcagaagttcactggagggcccagcctggggaaaggatcaggagcaggttaggcatgttaagcttgagatgtctgttaaacatccagataggaatgtcaaagatgcacttgtgtttaagagtcaggaatgcaagagggaattttaggctagaaacaaaaagttagaaattattcgatacagatggtatttaaagctgtgtgactgactgacatgacagaagtggcgagaatagactgagaagtccaaggaatgagccttggaccactccagtgttaggtaagtagttgaaaaaaagagagagagagaaggcatcaaaggagactgaggaagagtgatcaggaaagcataggaaaatccgagaaacatatggtgtcctggaatctatatgaaaaagatatattcagaaagacagagtgataaatctgtcaaattattgaatttgtcaggtaaaataagaacagagaattgatctttggacttagcaaagcagagattatcagtgacttttataaaaatagtttcggtagtgtggaaagatcaaacttctgtttagagtgggtttcagagagaacaacaggaattgaagaagtaataaactttgccaaccagtttagctccaaaggaaaagagggaaatatgatggtagctggcaggggaagtgtggtcaagagaggttttttgtttgtttttcaagatggaagaaataacagtatgtatgtaagctcacaggagggatccagcaggcatggggaaattgatgatataggacagaaagggaagaatggctccttgtgaaagtgaaaggggatgggatctacaggatgaacatgcaaacaaagactggctgcaaagagaggcatgaatagttcatttacagaaacagcaaaggcagagtgttggtacagatgctggtaagtggaaaaatatcatggtaggaggttatggagttccattctaaacacttcaacttcatcagtgaaataagcacggtaatttagcagaatgtgaagatgtaaaagaacagaatttgagaaaacagacgatatgaaataattattagaaaagcagagactgaagaaactgtcatctccttatgtgctaatgagtttaataatgtcctccagtcaccacaagccttctttcaaactacacaattccaactgcttccgtctcagagtatcttgaaataatgatctgaccgcctgttagaccagtgaagggaaggaatttgggttgatttaagaagagaatcctcatggtcatggtagactgatatggagagaaaacattttgaggaaaaatactcaactaaattcatttctactccagcatgcagtttcaagtcaagttccaccttagctccaggtggcaggcagagcaggatgcagaggcacagcacaagtaagggatccaatgactgagtcaagaattacataacctggccagacagctggtacatgggaaagtgctaagagggcaccaacagcgttcctcctccccaaggagcataatgtgatggttcctgccggccctggctgactctcgccgtccttggagataattgggttcagtgccacctggaccagaactggggatgcggaagcaacctgccagacacgcgcgaggttcgaggctgagatggatcttgaggcggcaaagaacggaacagcctggcgccccacgagcgcggagggcgactttgaactgggcatcagcagcaaacaaaaaaggaaaaaaacgaagacagtgaaaatgattggagtattaacattgtttcgatactccgattggcaggataaattgtttatgtcgctgggtaccatcatggccatagctcacggatcaggtctccccctcatgatgatagtatttggagagatgactgacaaatttgttgatactgcaggaaacttctcctttccagtgaacttttccttgtcgctgctaaatccaggcaaaattctggaagaagaaatgactagatatgcatattactactcaggattgggtgctggagttcttgttgctgcctatatacaagtttcattttggactttggcagctggtcgacagatcaggaaaattaggcagaagttttttcatgctattctacgacaggaaataggatggtttgacatcaatgacaccactgaactcaatacgcggctaacagatgacatctccaaaatcagtgaaggaattggtgacaaggttggaatgttctttcaagcagtagccacgttttttgcaggattcatagtgggattcatcagaggatggaagctcacccttgtgataatggccatcagccctattctaggactctctgcagccgtttgggcaaagatactctcggcatttagtgacaaagaactagctgcttatgcaaaagcaggcgccgtggcagaagaggctctgggggccatcaggactgtgatagctttcgggggccagaacaaagagctggaaaggtatcagaaacatttagaaaatgccaaagagattggaattaaaaaagctatttcagcaaacatttccatgggtattgccttcctgttaatatatgcatcatatgcactggccttctggtatggatccactctagtcatatcaaaagaatatactattggaaatgcaatgacagtttttttttcaatcctaattggagctttcagtgttggccaggctgccccatgtattgatgcttttgccaatgcaagaggagcagcatatgtgatctttgatattattgataataatcctaaaattgacagtttttcagagagaggacacaaaccagacagcatcaaagggaatttggagttcaatgatgttcacttttcttacccttctcgagctaacgtcaagatcttgaagggcctcaacctgaaggtgcagagtgggcagacggtggccctggttggaagtagtggctgtgggaagagcacaacggtccagctgatacagaggctctatgaccctgatgagggcacaattaacattgatgggcaggatattaggaactttaatgtaaactatctgagggaaatcattggtgtggtgagtcaggagccggtgctgttttccaccacaattgctgaaaatatttgttatggccgtggaaatgtaaccatggatgagataaagaaagctgtcaaagaggccaacgcctatgagtttatcatgaaattaccacagaaatttgacaccctggttggagagagaggggcccagctgagtggtgggcagaagcagaggatcgccattgcacgtgccctggttcgcaaccccaagatccttctgctggatgaggccacgtcagcattggacacagaaagtgaagctgaggtacaggcagctctggataaggccagagaaggccggaccaccattgtgatagcacaccgactgtctacggtccgaaatgcagatgtcatcgctgggtttgaggatggagtaattgtggagcaaggaagccacagcgaactgatgaagaaggaaggggtgtacttcaaacttgtcaacatgcagacatcaggaagccagatccagtcagaagaatttgaactaaatgatgaaaaggctgccactagaatggccccaaatggctggaaatctcgcctatttaggcattctactcagaaaaaccttaaaaattcacaaatgtgtcagaagagccttgatgtggaaaccgatggacttgaagcaaatgtgccaccagtgtcctttctgaaggtcctgaaactgaataaaacagaatggccctactttgtcgtgggaacagtatgtgccattgccaatggggggcttcagccggcattttcagtcatattctcagagatcatagcgatttttggaccaggcgatgatgcagtgaagcagcagaagtgcaacatattctctttgattttcttatttctgggaattatttctttttttactttcttccttcagggtttcacgtttgggaaagctggcgagatcctcaccagaagactgcggtcaatggcttttaaagcaatgctaagacaggacatgagctggtttgatgaccataaaaacagtactggtgcactttctacaagacttgccacagatgctgcccaagtccaaggagccacaggaaccaggttggctttaattgcacagaatatagctaaccttggaactggtattatcatatcatttatctacggttggcagttaaccctattgctattagcagttgttccaattattgctgtgtcaggaattgttgaaatgaaattgttggctggaaatgccaaaagagataaaaaagaactggaagctgctggaaagattgcaacagaggcaatagaaaatattaggacagttgtgtctttgacccaggaaagaaaatttgaatcaatgtatgttgaaaaattgtatggaccttacaggaattctgtgcagaaggcacacatctatggaattacttttagtatctcacaagcatttatgtatttttcctatgccggttgttttcgatttggtgcatatctcattgtgaatggacatatgcgcttcagagatgttattctggtgttttctgcaattgtatttggtgcagtggctctaggacatgccagttcatttgctccagactatgctaaagctaagctgtctgcagcccacttattcatgctgtttgaaagacaacctctgattgacagctacagtgaagaggggctgaagcctgataaatttgaaggaaatataacatttaatgaagtcgtgttcaactatcccacccgagcaaacgtgccagtgcttcaggggctgagcctggaggtgaagaaaggccagacactagccctggtgggcagcagtggctgtgggaagagcacggtggtccagctcctggagcggttctacgaccccttggcggggacagtgtttgtggactttggttttcagcttctcgatggtcaagaagcaaagaaactcaatgtccagtggctcagagctcaactcggaatcgtgtctcaggagcctatcctatttgactgcagcattgccgagaatattgcctatggagacaacagccgggttgtatcacaggatgaaattgtgagtgcagccaaagctgccaacatacatcctttcatcgagacgttaccccacaaatatgaaacaagagtgggagataaggggactcagctctcaggaggtcaaaaacagaggattgctattgcccgagccctcatcagacaacctcaaatcctcctgttggatgaagctacatcagctctggatactgaaagtgaaaaggttgtccaagaagccctggacaaagccagagaaggccgcacctgcattgtgattgctcaccgcctgtccaccatccagaatgcagacttaatagtggtgtttcagaatgggagagtcaaggagcatggcacgcatcagcagctgctggcacagaaaggcatctatttttcaatggtcagtgtccaggctgggacacagaacttatgaacttttgctacagtatattttaaaaataaattcaaattattctacccatttt

SEQ ID NO: 55682 - DNA, 5623 bp, Homo sapiens
atctctatccttcttctggtccttcctagaaaatcaggtggagatgatagtggcttgcatgatggtggtagagctggaggtgcagggcaaaggtcagattctgaatatattttgaaagtaaaggcaacaagatttcctgacagattgattatggtgtgtcaaagaaagagaggaatgcaggatgattccagtgtttttgttgacaactataagtctggagctgccaactggatgcagaagttcactggagggcccagcctggggaaaggatcaggagcaggttaggcatgttaagcttgagatgtctgttaaacatccagataggaatgtcaaagatgcacttgtgtttaagagtcaggaatgcaagagggaattttaggctagaaacaaaaagttagaaattattcgatacagatggtatttaaagctgtgtgactgactgacatgacagaagtggcgagaatagactgagaagtccaaggaatgagccttggaccactccagtgttaggtaagtagttgaaaaaaagagagagagagaaggcatcaaaggagactgaggaagagtgatcaggaaagcataggaaaatccgagaaacatatggtgtcctggaatctatatgaaaaagatatattcagaaagacagagtgataaatctgtcaaattattgaatttgtcaggtaaaataagaacagagaattgatctttggacttagcaaagcagagattatcagtgacttttataaaaatagtttcggtagtgtggaaagatcaaacttctgtttagagtgggtttcagagagaacaacaggaattgaagaagtaataaactttgccaaccagtttagctccaaaggaaaagagggaaatatgatggtagctggcaggggaagtgtggtcaagagaggttttttgtttgtttttcaagatggaagaaataacagtatgtatgtaagctcacaggagggatccagcaggcatggggaaattgatgatataggacagaaagggaagaatggctccttgtgaaagtgaaaggggatgggatctacaggatgaacatgcaaacaaagactggctgcaaagagaggcatgaatagttcatttacagaaacagcaaaggcagagtgttggtacagatgctggtaagtggaaaaatatcatggtaggaggttatggagttccattctaaacacttcaacttcatcagtgaaataagcacggtaatttagcagaatgtgaagatgtaaaagaacagaatttgagaaaacagacgatatgaaataattattagaaaagcagagactgaagaaactgtcatctccttatgtgctaatgagtttaataatgtcctccagtcaccacaagccttctttcaaactacacaattccaactgcttccgtctcagagtatcttgaaataatgatctgaccgcctgttagaccagtgaagggaaggaatttgggttgatttaagaagagaatcctcatggtcatggtagactgatatggagagaaaacattttgaggaaaaatactcaactaaattcatttctactccagcatgcagtttcaagtcaagttccaccttagctccaggtggcaggcagagcaggatgcagaggcacagcacaagtaagggatccaatgactgagtcaagaattacataacctggccagacagctggtacatgggaaagtgctaagagggcaccaacagcgttcctcctccccaaggagcataatgtgatggttcctgccggccctggctgactctcgccgtccttggagataattgggttcagtgccacctggaccagaactggggatgcggaagcaacctgccagacacgcgcgaggttcgaggctgagatggatcttgaggcggcaaagaacggaacagcctggcgccccacgagcgcggagggcgactttgaactgggcatcagcagcaaacaaaaaaggaaaaaaacgaagacagtgaaaatgattggagtattaacattgtttcgatactccgattggcaggataaattgtttatgtcgctgggtaccatcatggccatagctcacggatcaggtctccccctcatgatgatagtatttggagagatgactgacaaatttgttgatactgcaggaaacttctcctttccagtgaacttttccttgtcgctgctaaatccaggcaaaattctggaagaagaaatgactagatatgcatattactactcaggattgggtgctggagttcttgttgctgcctatatacaagtttcattttggactttggcagctggtcgacagatcaggaaaattaggcagaagttttttcatgctattctacgacaggaaataggatggtttgacatcaatgacaccactgaactcaatacgcggctaacagatgacatctccaaaatcagtgaaggaattggtgacaaggttggaatgttctttcaagcagtagccacgttttttgcaggattcatagtgggattcatcagaggatggaagctcacccttgtgataatggccatcagccctattctaggactctctgcagccgtttgggcaaagatactctcggcatttagtgacaaagaactagctgcttatgcaaaagcaggcgccgtggcagaagaggctctgggggccatcaggactgtgatagctttcgggggccagaacaaagagctggaaaggtatcagaaacatttagaaaatgccaaagagattggaattaaaaaagctatttcagcaaacatttccatgggtattgccttcctgttaatatatgcatcatatgcactggccttctggtatggatccactctagtcatatcaaaagaatatactattggaaatgcaatgacagtttttttttcaatcctaattggagctttcagtgttggccaggctgccccatgtattgatgcttttgccaatgcaagaggagcagcatatgtgatctttgatattattgataataatcctaaaattgacagtttttcagagagaggacacaaaccagacagcatcaaagggaatttggagttcaatgatgttcacttttcttacccttctcgagctaacgtcaagatcttgaagggcctcaacctgaaggtgcagagtgggcagacggtggccctggttggaagtagtggctgtgggaagagcacaacggtccagctgatacagaggctctatgaccctgatgagggcacaattaacattgatgggcaggatattaggaactttaatgtaaactatctgagggaaatcattggtgtggtgagtcaggagccggtgctgttttccaccacaattgctgaaaatatttgttatggccgtggaaatgtaaccatggatgagataaagaaagctgtcaaagaggccaacgcctatgagtttatcatgaaattaccacagaaatttgacaccctggttggagagagaggggcccagctgagtggtgggcagaagcagaggatcgccattgcacgtgccctggttcgcaaccccaagatccttctgctggatgaggccacgtcagcattggacacagaaagtgaagctgaggtacaggcagctctggataaggccagagaaggccggaccaccattgtgatagcacaccgactgtctacggtccgaaatgcagatgtcatcgctgggtttgaggatggagtaattgtggagcaaggaagccacagcgaactgatgaagaaggaaggggtgtacttcaaacttgtcaacatgcagacatcaggaagccagatccagtcagaagaatttgaactaaatgatgaaaaggctgccactagaatggccccaaatggctggaaatctcgcctatttaggcattctactcagaaaaaccttaaaaattcacaaatgtgtcagaagagccttgatgtggaaaccgatggacttgaagcaaatgtgccaccagtgtcctttctgaaggtcctgaaactgaataaaacagaatggccctactttgtcgtgggaacagtatgtgccattgccaatggggggcttcagccggcattttcagtcatattctcagagatcatagcgatttttggaccaggcgatgatgcagtgaagcagcagaagtgcaacatattctctttgattttcttatttctgggaattatttctttttttactttcttccttcagggtttcacgtttgggaaagctggcgagatcctcaccagaagactgcggtcaatggcttttaaagcaatgctaagacaggacatgagctggtttgatgaccataaaaacagtactggtgcactttctacaagacttgccacagatgctgcccaagtccaaggagccacaggaaccaggttggctttaattgcacagaatatagctaaccttggaactggtattatcatatcatttatctacggttggcagttaaccctattgctattagcagttgttccaattattgctgtgtcaggaattgttgaaatgaaattgttggctggaaatgccaaaagagataaaaaagaactggaagctgctggaaagattgcaacagaggcaatagaaaatattaggacagttgtgtctttgacccaggaaagaaaatttgaatcaatgtatgttgaaaaattgtatggaccttacagggtgttttctgcaattgtatttggtgcagtggctctaggacatgccagttcatttgctccagactatgctaaagctaagctgtctgcagcccacttattcatgctgtttgaaagacaacctctgattgacagctacagtgaagaggggctgaagcctgataaatttgaaggaaatataacatttaatgaagtcgtgttcaactatcccacccgagcaaacgtgccagtgcttcaggggctgagcctggaggtgaagaaaggccagacactagccctggtgggcagcagtggctgtgggaagagcacggtggtccagctcctggagcggttctacgaccccttggcggggacagtgcttctcgatggtcaagaagcaaagaaactcaatgtccagtggctcagagctcaactcggaatcgtgtctcaggagcctatcctatttgactgcagcattgccgagaatattgcctatggagacaacagccgggttgtatcacaggatgaaattgtgagtgcagccaaagctgccaacatacatcctttcatcgagacgttaccccacaaatatgaaacaagagtgggagataaggggactcagctctcaggaggtcaaaaacagaggattgctattgcccgagccctcatcagacaacctcaaatcctcctgttggatgaagctacatcagctctggatactgaaagtgaaaaggttgtccaagaagccctggacaaagccagagaaggccgcacctgcattgtgattgctcaccgcctgtccaccatccagaatgcagacttaatagtggtgtttcagaatgggagagtcaaggagcatggcacgcatcagcagctgctggcacagaaaggcatctatttttcaatggtcagtgtccaggctgggacacagaacttatgaacttttgctacagtatattttaaaaataaattcaaattattctacccatttt

SEQ ID NO: 55683 - DNA, 4868 bp, Homo sapiens
gcggccgcgtctttgttccagacgcagtccaggaatcatgctggagaagttctgcaactctactttttggaattcctcattcctggacagtccggaggcagacctgccactttgttttgagcaaactgttctggtgtggattcccttgggcttcctatggctcctggccccctggcagcttctccacgtgtataaatccaggaccaagagatcctctaccaccaaactctatcttgctaagcaggtattcgttggttttcttcttattctagcagccatagagctggcccttgtactcacagaagactctggacaagccacagtccctgctgttcgatataccaatccaagcctctacctaggcacatggctcctggttttgctgatccaatacagcagacaatggtgtgtacagaaaaactcctggttcctgtccctattctggattctctcgatactctgtggcactttccaatttcagactctgatccggacactcttacagggtgacaattctaatctagcctactcctgcctgttcttcatctcctacggattccagatcctgatcctgatcttttcagcattttcagaaaataatgagtcatcaaataatccatcatccatagcttcattcctgagtagcattacctacagctggtatgacagcatcattctgaaaggctacaagcgtcctctgacactcgaggatgtctgggaagttgatgaagagatgaaaaccaagacattagtgagcaagtttgaaacgcacatgaagagagagctgcagaaagccaggcgggcactccagagacggcaggagaagagctcccagcagaactctggagccaggctgcctggcttgaacaagaatcagagtcaaagccaagatgcccttgtcctggaagatgttgaaaagaaaaaaaagaagtctgggaccaaaaaagatgttccaaaatcctggttgatgaaggctctgttcaaaactttctacatggtgctcctgaaatcattcctactgaagctagtgaatgacatcttcacgtttgtgagtcctcagctgctgaaattgctgatctcctttgcaagtgaccgtgacacatatttgtggattggatatctctgtgcaatcctcttattcactgcggctctcattcagtctttctgccttcagtgttatttccaactgtgcttcaagctgggtgtaaaagtacggacagctatcatggcttctgtatataagaaggcattgaccctatccaacttggccaggaaggagtacaccgttggagaaacagtgaacctgatgtctgtggatgcccagaagctcatggatgtgaccaacttcatgcacatgctgtggtcaagtgttctacagattgtcttatctatcttcttcctatggagagagttgggaccctcagtcttagcaggtgttggggtgatggtgcttgtaatcccaattaatgcgatactgtccaccaagagtaagaccattcaggtcaaaaatatgaagaataaagacaaacgtttaaagatcatgaatgagattcttagtggaatcaagatcctgaaatattttgcctgggaaccttcattcagagaccaagtacaaaacctccggaagaaagagctcaagaacctgctggcctttagtcaactacagtgtgtagtaatattcgtcttccagttaactccagtcctggtatctgtggtcacattttctgtttatgtcctggtggatagcaacaatattttggatgcacaaaaggccttcacctccattaccctcttcaatatcctgcgctttcccctgagcatgcttcccatgatgatctcctccatgctccaggccagtgtttccacagagcggctagagaagtacttgggaggggatgacttggacacatctgccattcgacatgactgcaattttgacaaagccatgcagttttctgaggcctcctttacctgggaacatgattcggaagccacagtccgagatgtgaacctggacattatggcaggccaacttgtggctgtgataggccctgtcggctctgggaaatcctccttgatatcagccatgctgggagaaatggaaaatgtccacgggcacatcaccatcaagggcaccactgcctatgtcccacagcagtcctggattcagaatggcaccataaaggacaacatcctttttggaacagagtttaatgaaaagaggtaccagcaagtactggaggcctgtgctctcctcccagacttggaaatgctgcctggaggagatttggctgagattggagagaagggtataaatcttagtgggggtcagaagcagcggatcagcctggccagagctacctaccaaaatttagacatctatcttctagatgaccccctgtctgcagtggatgctcatgtaggaaaacatatttttaataaggtcttgggccccaatggcctgttgaaaggcaagactcgactcttggttacacatagcatgcactttcttcctcaagtggatgagattgtagttctggggaatggaacaattgtagagaaaggatcctacagtgctctcctggccaaaaaaggagagtttgctaagaatctgaagacatttctaagacatacaggccctgaagaggaagccacagtccatgatggcagtgaagaagaagacgatgactatgggctgatatccagtgtggaagagatccccgaagatgcagcctccataaccatgagaagagagaacagctttcgtcgaacacttagccgcagttctaggtccaatggcaggcatctgaagtccctgagaaactccttgaaaactcggaatgtgaatagcctgaaggaagacgaagaactagtgaaaggacaaaaactaattaagaaggaattcatagaaactggaaaggtgaagttctccatctacctggagtacctacaagcaataggattgttttcgatattcttcatcatccttgcgtttgtgatgaattctgtggcttttattggatccaacctctggctcagtgcttggaccagtgactctaaaatcttcaatagcaccgactatccagcatctcagagggacatgagagttggagtctacggagctctgggattagcccaaggtatatttgtgttcatagcacatttctggagtgcctttggtttcgtccatgcatcaaatatcttgcacaagcaactgctgaacaatatccttcgagcacctatgagattttttgacacaacacccacaggccggattgtgaacaggtttgccggcgatatttccacagtggatgacaccctgcctcagtccttgcgcagctggattacatgcttcctggggataatcagcacccttgtcatgatctgcatggccactcctgtcttcaccatcatcgtcattcctcttggcattatttatgtatctgttcagatgttttatgtgtctacctcccgccagctgaggcgtctggactctgtcaccaggtccccaatctactctcacttcagcgagaccgtatcaggtttgccagttatccgtgcctttgagcaccagcagcgatttctgaaacacaatgaggtgaggattgacaccaaccagaaatgtgtcttttcctggatcacctccaacaggtggcttgcaattcgcctggagctggttgggaacctgactgtcttcttttcagccttgatgatggttatttatagagataccctaagtggggacactgttggctttgttctgtccaatgcactcaatatcacacaaaccctgaactggctggtgaggatgacatcagaaatagagaccaacattgtggctgttgagcgaataactgagtacacaaaagtggaaaatgaggcaccctgggtgactgataagaggcctccgccagattggcccagcaaaggcaagatccagtttaacaactaccaagtgcggtaccgacctgagctggatctggtcctcagagggatcacttgtgacatcggtagcatggagaagattggtgtggtgggcaggacaggagctggaaagtcatccctcacaaactgcctcttcagaatcttagaggctgccggtggtcagattatcattgatggagtagatattgcttccattgggctccacgacctccgagagaagctgaccatcatcccccaggaccccatcctgttctctggaagcctgaggatgaatctcgaccctttcaacaactactcagatgaggagatttggaaggccttggagctggctcacctcaagtcttttgtggccagcctgcaacttgggttatcccacgaagtgacagaggctggtggcaacctgagcataggccagaggcagctgctgtgcctgggcagggctctgcttcggaaatccaagatcctggtcctggatgaggccactgctgcggtggatctagagacagacaacctcattcagacgaccatccaaaacgagttcgcccactgcacagtgatcaccatcgcccacaggctgcacaccatcatggacagtgacaaggtaatggtcctagacaacgggaagattatagagtgcggcagccctgaagaactgctacaaatccctggacccttttactttatggctaaggaagctggcattgagaatgtgaacagcacaaaattctagcagaaggccccatgggttagaaaaggactataagaataatttcttatttaattttattttttataaaatacagaatacatacaaaagtgtgtataaaatgtacgttttaaaaaaggataagtgaacacccatgaacctactacccaggttaagaaaataaatgtcaccaggtacttgagaaacccctcgattg

SEQ ID NO: 55684 - DNA, 5871 bp, Homo sapiens
cctgcggcgaggatggagggcctggcagtgcggttgctgcgcggcagcaggctgctaagaagaaatttcctgacttgtttgtcttcttggaagattcctcctcatgtctcaaaatcttcccagtcagaagctctactcaatataacaaataatggaatacactttgctcccctgcaaacatttacagatgaggaaatgatgataaagagttcagttaaaaaatttgctcaggaacaaattgcacctttggtttcaaccatggatgaaaattcgaaaatggagaaatcagtaatacaaggattatttcaacaagggttgatgggtattgaagttgacccagaatatggaggcacaggagcttcatttttatccactgtgctcgtgatagaggaattagccaaagttgatgcatctgtggctgtcttttgtgagatccagaacacattaattaacacactgattagaaaacatggaacagaagaacaaaaggccacctatttgcctcagctcactacagaaaaagtaggaagtttctgcctttcagaggctggagcaggtagtgactcatttgctttgaagaccagagctgataaagagggagattattatgtcctcaatggatcaaagatgtggatcagcagtgctgagcacgcagggctctttctggtgatggcaaatgtagaccctaccattggatataagggaattacctccttcttagtagatcgtgatactccgggccttcatatagggaaacctgaaaacaaattggggctcagagcttcttccacctgcccgttaacattcgaaaatgtcaaggttccagaagccaatatcttgggacaaattggacatggctataagtatgccatagggagtctcaatgaaggtagaataggaattgctgcacagatgctgggactggcgcaaggatgttttgactacactattccatatattaaagaaaggatacaatttggcaaaagactatttgattttcagggcctccaacaccaagtggctcacgtggccacccagctggaagctgcaagattactaacatacaatgctgctaggcttttagaagctggaaagccattcataaaagaagcgtcaatggccaaatactatgcatcagagattgcaggacaaacaacgagtaaatgtatcgagtggatggggggagtaggctacaccaaagattaccctgtggagaaatacttccgagatgcaaagattggtacgatatatgaaggagcttccaacatccagttgaacaccattgcaaagcatatcgatgcagaatactgacgtctataggagtgggacccctccctggtgtcactgctgtaaaattttaaacggttgtgtcttgttgggagtaagtgccttgcgtgggaataaacttccacagcattcgaatattttaatgaagcccttagtcagggtcctggtgttggcctttttggttttctcttttcaggctgtttaacttaggcacaggagatccacttttaaacttgggaaataagcacctgtatttttttccaaaactgtttttaaagctgtatacgcatacatatatatatttttactctgtcttactctgtcacccaggctagagtgcagtggcgcgatctcagctcactgcagccttgacctcctgggttccagtgattctcatgcctcatcctcccaagtagctggaactacaggtgtgcaccaccatgcctggttcatttttgtgtttttagtagagatggggttttaccatattgcccaggctggtcttctggcttctggatatcgcccaccttggcctcccaaagtgctgggattacagggatgagccaccgtgcctggctgggtatttatattatcattctagtttcagagtatacagaagtttcatcccatcatttggaaaaataaaggcatctgaagtacaatattacttatagaaatagtttatattcctattaaatcttaatcttgtggcatcagggaaatatttgttacatagtaggcaatttttatccagtactttatagattcaactctaagttgcaagcgaagtcaaaactgatgaaaatttatttagaaaaatctaaaaattctggttttaaatatgagaatcagtggaaaataagggtataattttgtaggtcatatgattgaagaaaatattattttaacaatgtaaagcaatatgatttgttactataattaacctgtataaaagatacattttatggtggtttcagtaggtcattttaaaaaccaatgtgcattagttttcaagtataaggtttaagtaatttggtttaataatcagaaaatattcaatacagtgttggatattctgtcatgcactatttttcagttgacaatttctgtattttaattgaatactgtttcttcagtcatggttattgcactttatcctgaataataattcagaaattgggttttggttcagtgattctcaagaaaaagatctcttgcccattaagaagtgtatcaaaatctcataaggaatgagggagagaagggggctgtagagtttgaaaaagcatattcaatattaaaatagttttatatttgggaaggcaaaaatgaatctattgttttgcaatataggttataaacaggcaaaatgcaataaaatatatatctggttgtattagtctgttttcacgctgctgataaagacatacctgagaccaggaagaaaaagaggtttaattggacttacagttccacatgactggggaggcctcagaatcatggtgggaggcaaaaagcacttcttacatggcggcagcaagagaaaatgagaaagaagcaaaagtggaaacccctaataaacctatcagatcttgtgagacttactatcacgagaatagcacaggaaagactggcccccatgattcaattacctcccccgggtccctcccacaacacatgggaattctgagagataccatttaagttgagatttcagtggggacacagccaaaccatatcattctacccctggcacctccaaatctcatgtcctcacatttcaaaaccaatcatgccttcccaacagtcccccaaagtcttaactcatttcagcattaacccaaaagtccgcagtccaaagtttcatctgagacaaggcaagtcccttccacttatgaacctgtaaaatcaaaagtaaactagttacttcctagatacaatgggggtacaggtattgggtaaatacagccattccaaatgggagaaattggccaacacaaaagggtaacagggcccatgcaagtccaaaattcagcagggcagtcaaattttaaacctccaaaatgatcacctttgactccacgtctcacaatcatctctctcaagttcgaagttccacaaatctctaaggcaagggaaagatgctgccagtctctttgctaaaacacagcaagagtcacctttactccagttcccaaaaagtttttcatctccatctgagaccacctcagcctgaattttattgtcaatattgctatcagcattttgggcaaagccattcagcaagtatctaggaagttccaaactttcccacattttcctgtcttcttctgagcccttcaaactgttccaacctctgcctgttacccagttccaaacttgctttcatatttttggctatcttttcagcaatgccccactctactgttagcagtttactgtattagtctgttttcacactgctgataaagacattcctcaagattgtgaagaaaaagaggtttaattggactgacagttccacatggccggggaggcctcagaatcatggcgggaggtgaaaagcacttcgtacatggtggtggcaagagaaaatgaagaagaagcaaaagtggaaacccctgataaacccatcagatctcatgagacttactatcatgagaatagcacaggaaagactggcccccctgattcgatgacctccccctgggtccctcccacaacatgtgggaattccagaagataaattcaagttgcaatttcagtggggacatagccaaaccatatcactggtgatgccacttcttcagtattagggattctcagtcagaagagaccccctgtgtggcctgagtcccctcaggaggaaggtggacaacagagaaatgagagttttgatattttctgaaagaggaacatgtgttagagatgaagaatcttccaaggctcatgcagttgcttagaataatcattactgttatatgagaaacattttagtaatttaataaaaggataatgtttatttaaaaaacctgacttttccagagtaattttgttttgcacattcatgtttattgaagtggactaatttctataatgcaaatcagagttaaatattaaaaattgtgtaaatacaattgacataggaattacattaaaatattaggaagaaacaaggacaaatttagaccttgaatccgaagagataaagcttacttgactttcaaatggagagatgatgaaaacccactcattcactctttcagaacaaaaagacagtcatctgataagagtatgacatggatgaaatgccctacaggggccttggacatctttaatttctgcgattatgtgaaagaggtggactttacagataatggagcagaagccaacattagtaaaaggaatcccaacttcttcccatagaattagaaacatgtgaaagtacaataaacttcttgttcaaattaccagcatcagagagcttcccatttgcatctagaccttgaatttatatttattgatcaagttctaatttgtatgtatattttgtgcatattcaccaataacagttaaaattaattatgtgttatagttaatatatgcacctaccttcttccgttagtgcatcagtaaatgtgttattttgtcatttttccaaagagagtgttgtaggttttccctgtagttcttcctttatagcttttcttctgataaccatgacttcaggagctttaaaactatctatcttgcatttgtgtctggcggagaactagccatcagcctcctgaagcctgccatcattgttaatttgaggactgggctgtcttggggctcagaaggtaaagaactatttgagcagatgtgtgtgggtggcactggattccacccaactgccaagttagtattgttagagatttcattttacaacacaaaaataagcctgtgtcaaagattttaaaatcatggaaagttaaaatctagaaagaccttagagaaccagccaaccaactctctcattttaaaagtgaaggattcatagcacagattacttgcctaagatcatccaggaacgaagacaagaatccaaatgtacttggggacaagaattagtccccaaattcagtgttcttcctagtattaaacattgcccctttcgacaaattttggatttcattcttgttatatttcagtactcttgctgatttattttaggtttaactggtaaagaatgaacatttcagaagtgttaggattagtcagtgtcatcgcttatgtatatgaatcacttgccaaagacactggctctcctcagctgtaaccagcatgtcaaatgtgaagattattgtgtgggatcctttggtttcattgttatgatgtattttataaatgtactagttatatccttgtttatgtatttttgctgatctttcataaagcagaatggtatgtatcggattgttttaatgttatatattggattgtattcgatgttacaaaaccaatattctatggagaatgaaaaaaataaaggactaaattaactggaaaaaaaaaaaaaaaaaaaaaaaaaaaaaaaaaaaa

SEQ ID NO: 55685 - DNA, 2128 bp, Homo sapiens
tttgatatgacgattagagcataacccgagtgacacgttgaattcgccataatcaaggaaaccttttccgggtggggatctctgaaattactcagataacagtgctgtgccaaaaacctgtggattttctctacaaaaattattgagcaaccctaattaacctgattttttgctgataatcactctcaatggaatcaaatcacaaatccggggatggattgagcggcactcagaaggaagcagccctccgcgcactggtccagcgcacaggatatagcttggtccaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagtaaaaaaaaaaaaaaaaa

SEQ ID NO: 55686 - DNA, 2152 bp, Homo sapiens
tttgatatgacgattagagcataacccgagtgacacgttgaattcgccataatcaaggaaaccttttccgggtggggatctctgaaattactcagataacagtgctgtgccaaaaacctgtggattttctctacaaaaattattgagcaaccctaattaacctgattttttgctgataatcactctcaatggaatcaaatcacaaatccggggatggattgagcggcactcagaaggaagcagccctccgcgcactggtccagcgcacaggatatagcttggtccaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagagaaatttacatgaatgtacctgtaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagtaaaaaaaaaaaaaaaaa

SEQ ID NO: 55687 - DNA, 2223 bp, Homo sapiens
tttgatatgacgattagagcataacccgagtgacacgttgaattcgccataatcaaggaaaccttttccgggtggggatctctgaaattactcagtgagcaaccctaattaacctgattttttgctgataatcactctcaatggaatcaaatcacaaatccggggatggattgagcggcactcagaaggaagcagccctccgcgcactggtccagcgcacaggatatagcttggtccaggaatttagaggttcctatagatggaagcagtgtgtctgggcacatgcccagagccagaagcgagcatgagcacagcaattcctggcctcaaaaaaggaaataatgctttgcagtccatcattttgcaaactttgctggaaaaggaaaatggacaaagaaaatatggtggccctccacctggttgggatgctgcaccccctgaaaggggctgtgaaatttttattggaaaacttccccgagacctttttgaggatgagcttataccattatgtgaaaaaatcggtaaaatttatgaaatgagaatgatgatggattttaatggcaacaatagaggatatgcatttgtaacattttcaaataaagtggaagccaagaatgcaatcaagcaacttaataattatgaaattagaaatgggcgcctcttaggggtttgtgccagtgtggacaactgccgattatttgttgggggcatcccaaaaaccaaaaagagagaagaaatcttatcggagatgaaaaaggttactgaaggtgttgtcgatgtcatcgtctacccaagcgctgcagataaaaccaaaaaccgaggctttgccttcgtggagtatgagagtcatcgagcagctgccatggcgaggaggaaactgctaccaggaagaattcagttatggggacatggtattgcagtagactgggcagagccagaagtagaagttgatgaagatacaatgtcttcagtgaaaatcctatatgtaagaaatcttatgctgtctacctctgaagagatgattgaaaaggaattcaacaatatcaaaccaggtgctgtggagagggtgaagaaaattcgagactatgcttttgtgcacttcagtaaccgagaagatgcagttgaggctatgaaagctttaaatggcaaggtgctggatggttcccccattgaagtcaccctagcaaaaccagtggacaaggacagttatgttaggtatacccgaggcacaggtggaaggggcaccatgctgcaaggagagtatacctactctttgggccaagtttatgatcccaccacaacctaccttggagctcctgtcttctatgccccccagacctatgcagcaattcccagtcttcatttcccagccaccaaaggacatctcagcaacagagccattatccgagccccttctgttagaggggctgcgggagtgagaggactgggcggccgtggctatttggcatacacaggcctgggtcgaggataccaggtcaaaggagacaaaagagaagacaaactctatgacattttacctgggatggagctcaccccaatgaatcctgtcacattaaaaccccaaggaattaaactcgctccccagatattagaagagatttgtcagaaaaataactggggacagccagtgtaccagctgcactctgctattggacaagaccaaagacagctattcttgtacaaaataactattcctgctctagccagccagaatcctgcaatccaccctttcacacctccaaagctgagtgcctttgtggatgaagcaaagacgtatgcagccgaatacaccctgcagaccctgggcatccccactgatggaggcgatggcaccatggctactgctgctgctgctgctactgctttcccaggatatgctgtccctaatgcaactgcacccgtgtctgcagcccagctcaagcaagcggtaacccttggacaagacttagcagcatatacaacctatgaggtctacccaacttttgcagtgactgcccgaggggatggatatggcaccttctgaagatgcttttttaaatttaagaataagacacacaaaactctattaaaaaaaaaaaagaaataaacctctaactcggtccccaatgatcataaataatatgtttcctaaagaaatgcctttccagagactgtatagcttataccaattatagaatcatgaagtaaaaaaaaaaaaaaaaa

SEQ ID NO: 55688 - DNA, 1820 bp, Homo sapiens
ggcttagcgctctcgccctggccatggagcggccggcgcccggcgaggtggtcatgagccaagccatccagccggcgcacgccactgcgcgcggcgagctgagcgcggggcagctgctcaagtggatcgacaccaccgcctgcctggcggctgagaaacatgctggagtttcctgcgttacagcctcagtggatgacatacagtttgaggagacagctagagttggacaagttataaccatcaaagcaaaagttactagagcattcagcacaagcatggagatcagtatcaaggtcatggtacaggatatgctcactggcattgagaagcttgttagtgtggctttctccacatttgtagccaaaccagttggaaaagaaaagattcatttaaaaccagtcacacttctaactgaacaagatcatgtggaacataatctggctgctgagagaaggaaagttcgattacaacatgaagatacctttaacaatttaatgaaggaaagtagcaaatttgatgatctcatttttgatgaagaggaaggagcggtttccacaaggggcacctccgttcagagcattgaactggtcctcccaccccatgcaaaccatcacggaaatacatttggtggccagattatggcgtggatggagacagtggctactatttctgcaagccgcctgtgttgggctcatccctttctgaagtccgtagatatgtttaagttccggggaccatctacagttggagatcgtcttgtcttcactgccattgtcaacaatacatttcagacctgtgttgaagttggagttcgcgtggaggcctttgactgtcaggaatgggccgagggccgagggcgtcacatcaacagtgcttttctcatttacaatgctgctgatgataaggaaaatctcatcacgtttcccagaatccaacccatttcaaaggatgatttcagacgctatcggggagctattgcacgcaagcgaattcgcctaggcagaaaatatgttatttcccacaaagaagaggttccactttgcatacactgggatatcagcaagcaggcatccctgagtgacagcaatgtggaggccctcaaaaaactggcagccaaaaggggttgggaggttaccagcactgtggaaaagataaaaatatatactctggaagagcatgatgttttatctgtttgggttgaaaagcacgtgggaagtccagcacatttggcttatcgtctcttgtctgactttacaaagcgacctttgtgggacccccattttgtgtcctgtgaagtcatagactgggtgagtgaagatgatcagctgtatcacatcacctgtcctatactgaatgatgacaaacccaaagacttggtagtactcgtatcacgaagaaaacccctcaaagatggtaacacttacacagtggcagtgaagtcggtcattttgccatcggtccccccgtctccacagtacatcagaagtgaaatcatatgtgccggatttctcatccatgctattgacagcaattcatgcatcgtatcttactttaaccatatgtctgctagcatccttccttactttgctggaaatcttggtggctggtcaaaatccattgaagaaacagcagcctcttgtatacagttcttagagaatcctcctgatgatgggtttgtaagcacattttaaaggtcaactttcaattactggtaatttaatttcccacttttaattccaagcacccttagccctgacatctgtcaagctttggggccacaaaataatttaatataacctaagcaaaatgcagtgacggag

SEQ ID NO: 55689 - DNA, 1456 bp, Homo sapiens
atgcacttgagcagggaagaaatccacaaggactcaccagtctcctggtctgcagagaagacagaatcaacatgagcacagcaggaaaagtaatcaaatgcaaagcagctgtgctatgggagttaaagaaacccttttccattgaggaggtggaggttgcacctcctaaggcccatgaagttcgtattaagatggtggctgtaggaatctgtggcacagatgaccacgtggttagtggtaccatggtgaccccacttcctgtgattttaggccatgaggcagccggcatcgtggagagtgttggagaaggggtgactacagtcaaaccaggtgataaagtcatcccactcgctattcctcagtgtggaaaatgcagaatttgtaaaaacccggagagcaactactgcttgaaaaacgatgtaagcaatcctcaggggaccctgcaggatggcaccagcaggttcacctgcaggaggaagcccatccaccacttccttggcatcagcaccttctcacagtacacagtggtggatgaaaatgcagtagccaaaattgatgcagcctcgcctctagagaaagtctgtctcattggctgtggattttcaactggttatgggtctgcagtcaatgttgccaaggtcaccccaggctctacctgtgctgtgtttggcctgggaggggtcggcctatctgctattatgggctgtaaagcagctggggcagccagaatcattgcggtggacatcaacaaggacaaatttgcaaaggccaaagagttgggtgccactgaatgcatcaaccctcaagactacaagaaacccatccaggaggtgctaaaggaaatgactgatggaggtgtggatttttcatttgaagtcatcggtcggcttgacaccatgatggcttccctgttatgttgtcatgaggcatgtggcacaagtgtcatcgtaggggtacctcctgattcccaaaacctctcaatgaaccctatgctgctactgactggacgtacctggaagggagctattcttggtggctttaaaagtaaagaatgtgtcccaaaacttgtggctgattttatggctaagaagttttcattggatgcattaataacccatgttttaccttttgaaaaaataaatgaaggatttgacctgcttcactctgggaaaagtatccgtaccattctgatgttttgagacaatacagatgttttcccttgtggcagtcttcagcctcctctaccctacatgatctggagcaacagctgggaaatatcattaattctgctcatcacagattttatcaataaattacatttgggggctttccaaagaaatggaaattgatgtaaaattatttttcaagcaaatgtttaaaatccaaatgagaactaaataaagtgttgaacatcagctggggaattgaagccaataaaccttccttcttaaccatt

SEQ ID NO: 55690 - DNA, 1497 bp, Homo sapiens
aacatacctgctttatgcactcaagcagagaagaaatccacaagtactcaccagcctcctggtctgcagagaagacagaatcaatatgagcacagcaggaaaagtaatcaaatgcaaagcagctgtgctatgggagttaaagaaacccttttccattgaggaggtagaggttgcacctcctaaggctcatgaagttcgcattaagatggtggctgcaggaatctgtcgttcagatgagcatgtggttagtggcaacctggtgaccccccttcctgtgattttaggccatgaggcagccggcatcgtggaaagtgttggagaaggggtgactacagtcaaaccaggtgataaagtcatcccgctctttactcctcagtgtggaaaatgcagaatttgtaaaaacccagaaagcaactactgcttgaaaaatgatctaggcaatcctcgggggaccctgcaggatggcaccaggaggttcacctgcagcgggaagcccatccaccacttcgtcggcgtcagcaccttctcccagtacacagtggtggatgagaatgcagtggccaaaattgatgcagcctcgcccctggagaaagtctgcctcattggctgtggattttcgactggttatgggtctgcagtcaaagttgccaaggtcaccccagggtctacctgtgctgtgtttggcctgggaggggtcggcctatctgttgttatgggctgtaaagcagctggagcagccagaatcattgctgtggacatcaacaaggacaaatttgcaaaggctaaagagttgggtgccactgaatgcatcaaccctcaagactacaagaaacccattcaggaagtgctaaaggaaatgactgatggaggtgtggatttttcgtttgaagtcatcggtcggcttgacaccatgatggcttccctgttatgttgtcatgaggcatgtggcacaagtgtcattgtaggggtacctcctgattcccagaacctctcaataaaccctatgctgctactgactggacgcacgtggaaaggagctatttttggaggctttaagagtaaagaatctgtccccaaacttgtggctgactttatggctaagaagttttcactggatgcattaataacaaatattttaccttttgaaaaaataaatgaaggatttgacctgcttcgctctggaaagagtatccgtaccgtcctgacgttttgaaacaatacagatgccttcccttgtagcagttttcagcctcctctaccctacatgatctggagcaacagctaggaaatatcattaattctgctcttcagagatgttaaaaataaattacacgtgggagctttccaaagaaatggaaattgatgggaaattatttgtcaagcaaatgtttaaaatccaaatgagaactaaataaagtgttgaacatcaactggggaattgaagccaataaaccttccttcttaaccattcaaaaaaaaaaaaaaaaaaaaaaaaaa

SEQ ID NO: 55691 - DNA, 1980 bp, Homo sapiens
cacggaactccctgggtaggagtttgaagctttcttaactcagaaagaaacttccaacacagtttcccaaagaaaaatgggcaccaagggcaaagttattaaatgcaaagcagccatcgcctgggaagcaggcaagcccctttgcattgaagaggttgaagtagctccccccaaggctcatgaagttcgcattcagatcattgctacctccctgtgccatactgatgccactgttatcgattctaaatttgagggcctagctttcccagtgatcgttggccatgaggctgcaggtattgtggaaagtattgggccaggagtgaccaacgtcaaaccaggtgacaaagtaattccactttatgcacctctatgtagaaaatgcaagttttgtctgagtccactcacaaatttgtgtgggaaaatcagtaatctcaaaagtcctgctagtgatcaacaactaatggaagacaaaaccagcaggtttacctgcaaaggaaaaccagtttaccatttctttggaaccagtacattctctcagtacactgtggtgtcagatatcaatcttgccaaaatagatgatgatgcaaatttagagagagtttgtctgcttggatgtgggttttcaactggctatggggctgcaatcaacaatgccaaggtcacccctggttcgacttgtgctgtctttggcctaggaggtgtgggtctttctgctgtaatgggttgtaaagcagcaggagcttccagaatcataggtattgacatcaacagtgagaagtttgtgaaggctaaagccctgggagccactgactgcctcaatcctagagacttacataaaccgatccaggaagttatcattgaattgaccaagggaggtgtggattttgcccttgactgtgcaggtggatctgaaaccatgaaagcagccctggactgtacaaccgcaggctggggatcatgtactttcattggagtagctgctggtagcaaaggattgactatttttccagaggagctaataatcggccgtactataaatggaacattctttggtggttggaaaagtgtagattctatcccaaagctggtcactgactataagaataagaaattcaatctggatgcactggtgacccataccctgccttttgacaaaatcagtgaggcatttgacctaatgaaccaaggaaaaagcgtccgaacaatcctcatcttttgaagatgccaggagcaattcagaatactatctgattgaatgtgaacctgcctggttaatttattacctgatttgatgaaccaaggaaagccatgagtttaaacaaatatttacatttaatatgggaacataaaagagctttaaatattatagactttgtacctgttatatatatgaatattccctatgttaaataataataataactagtgtttatgaatagaatcatatcatctttagaaattgtttaaaattagttctgggaagttgaaagtggggaatgaagagataataaataaaactagattggccatatgtttataatttttttagattgggtaatgaatacatggagtttcattatacttttctctccacttttgtctatgttgaaaattttctgggagctaaatgatgagaacacatggacacatgatggggaacaacacacactggggcctgttgagggcagggagtcggcagagagagagcatcaggaagaatagctaatggatgctgggcttcatacctgggtgatgagatgatctgtgcagcaaagcaccatggtacatgtttacctatgtaacaaacctgcacatcctgcacatgtaccctggaacttaataaaagttggaaatttttaaaaagaatgaataagacctggtatttgatagcacaacagggagactatagtcaacagcaatttaattgtatattttaatatgactaaaagagtataatggattgtttgtaacacaaataaa

SEQ ID NO: 55692 - DNA, 1398 bp, Homo sapiens
cagtcgcctgtgtacctttgtactttctacagtgaaagttgctacaggatctccctttctcaataaattcatctgcggtggagaaaatcagcatgagtactacaggccaagtcatcagatgcaaagcagccatactctggaagcctggtgcaccattttctattgaagaggtagaagtggccccaccaaaggcaaaggaggttcgcataaaggttgtggccaccggactgtgtggtacagagatgaaagtgttggggagtaaacacttggacctcttgtatcccaccatcttgggccatgaaggggctggaatcgttgagagtattggagaaggagtaagcacagtgaaaccaggtgacaaagttatcacactctttctgccacagtgtggagaatgtacctcttgcctgaattctgagggcaatttttgtatacaattcaaacagtcaaaaacccaactgatgtctgatggtaccagcaggtttacctgcaagggaaaatcaatatatcactttggtaataccagcaccttctgtgaatacacagtgataaaggaaatctcagttgccaagattgatgcagtcgctcctctagagaaagtatgcctaattagctgtggcttttccactgggtttggtgctgcaatcaatactgccaaggtgactccaggttctacctgtgctgtgtttggcctgggaggagtcggcttgtctgttgtcatgggttgtaaagcagcaggagcagccaggatcattggagtggatgtcaacaaggagaaatttaagaaggcacaggaattgggtgcgactgagtgcctcaaccctcaggacttaaagaaacccattcaagaagttttatttgatatgacagatgctggtatagacttctgctttgaggccattggaaatctggacgttctggcagctgccctcgcctcctgcaatgagagctatggggtctgtgtggttgttggggtgttgcctgccagtgttcaactcaaaatcagtggccagttgttcttctcaggacgttctttgaagggttctgtttttggaggctggaagagcagacagcacatccctaaactggttgctgattatatggcagagaagttgaatctagatccactaattactcatactctgaatcttgataaaatcaatgaagcagttgaattaatgaaaactggaaaatggtaaactgcccacataaattttatgtctgtgtgtttgagaccaagagaaagggtgtattggcttgggagtagaagaagggtcgtccctgctgcagaagctgtatactgataattgaagaggctttcaggaatttgtaaagcatctccttcccctctgcattttgttttatttctagctaataaaatacataatcctgaaagta

SEQ ID NO: 55693 - DNA, 2032 bp, Homo sapiens
tccatattgtgcttccaccactgccaataacaaaataactagcaaccatgaagtgggtggaatcaatttttttaattttcctactaaattttactgaatccagaacactgcatagaaatgaatatggaatagcttccatattggattcttaccaatgtactgcagagataagtttagctgacctggctaccatattttttgcccagtttgttcaagaagccacttacaaggaagtaagcaaaatggtgaaagatgcattgactgcaattgagaaacccactggagatgaacagtcttcagggtgtttagaaaaccagctacctgcctttctggaagaactttgccatgagaaagaaattttggagaagtacggacattcagactgctgcagccaaagtgaagagggaagacataactgttttcttgcacacaaaaagcccactccagcatcgatcccacttttccaagttccagaacctgtcacaagctgtgaagcatatgaagaagacagggagacattcatgaacaaattcatttatgagatagcaagaaggcatcccttcctgtatgcacctacaattcttctttgggctgctcgctatgacaaaataattccatcttgctgcaaagctgaaaatgcagttgaatgcttccaaacaaaggcagcaacagttacaaaagaattaagagaaagcagcttgttaaatcaacatgcatgtgcagtaatgaaaaattttgggacccgaactttccaagccataactgttactaaactgagtcagaagtttaccaaagttaattttactgaaatccagaaactagtcctggatgtggcccatgtacatgagcactgttgcagaggagatgtgctggattgtctgcaggatggggaaaaaatcatgtcctacatatgttctcaacaagacactctgtcaaacaaaataacagaatgctgcaaactgaccacgctggaacgtggtcaatgtataattcatgcagaaaatgatgaaaaacctgaaggtctatctccaaatctaaacaggtttttaggagatagagattttaaccaattttcttcaggggaaaaaaatatcttcttggcaagttttgttcatgaatattcaagaagacatcctcagcttgctgtctcagtaattctaagagttgctaaaggataccaggagttattggagaagtgtttccagactgaaaaccctcttgaatgccaagataaaggagaagaagaattacagaaatacatccaggagagccaagcattggcaaagcgaagctgcggcctcttccagaaactaggagaatattacttacaaaatgcgtttctcgttgcttacacaaagaaagccccccagctgacctcgtcggagctgatggccatcaccagaaaaatggcagccacagcagccacttgttgccaactcagtgaggacaaactattggcctgtggcgagggagcggctgacattattatcggacacttatgtatcagacatgaaatgactccagtaaaccctggtgttggccagtgctgcacttcttcatatgccaacaggaggccatgcttcagcagcttggtggtggatgaaacatatgtccctcctgcattctctgatgacaagttcattttccataaggatctgtgccaagctcagggtgtagcgctgcaaacgatgaagcaagagtttctcattaaccttgtgaagcaaaagccacaaataacagaggaacaacttgaggctgtcattgcagatttctcaggcctgttggagaaatgctgccaaggccaggaacaggaagtctgctttgctgaagagggacaaaaactgatttcaaaaactcgtgctgctttgggagtttaaattacttcaggggaagagaagacaaaacgagtctttcattcggtgtgaacttttctctttaattttaactgatttaacactttttgtgaattaatgaaatgataaagacttttatgtgagatttccttatcacagaaataaaatatctccaaatg

SEQ ID NO: 55694 - DNA, 2192 bp, Homo sapiens
gtgcacaggcagcctgggaacagctccatccccacccctcagctataaatagggcatcgtgacccggccgggggaagaagctgccgttgttctgggtactacagcagaagggtatgcggaagcgagcaccccagtctgagatggctcctgccggtgtgagcctgagggccaccatcctctgcctcctggcctgggctggcctggctgcaggtgaccgggtgtacatacaccccttccacctcgtcatccacaatgagagtacctgtgagcagctggcaaaggccaatgccgggaagcccaaagaccccaccttcatacctgctccaattcaggccaagacatcccctgtggatgaaaaggccctacaggaccagctggtgctagtcgctgcaaaacttgacaccgaagacaagttgagggccgcaatggtcgggatgctggccaacttcttgggcttccgtatatatggcatgcacagtgagctatggggcgtggtccatggggccaccgtcctctccccaacggctgtctttggcaccctggcctctctctatctgggagccttggaccacacagctgacaggctacaggcaatcctgggtgttccttggaaggacaagaactgcacctcccggctggatgcgcacaaggtcctgtctgccctgcaggctgtacagggcctgctagtggcccagggcagggctgatagccaggcccagctgctgctgtccacggtggtgggcgtgttcacagccccaggcctgcacctgaagcagccgtttgtgcagggcctggctctctatacccctgtggtcctcccacgctctctggacttcacagaactggatgttgctgctgagaagattgacaggttcatgcaggctgtgacaggatggaagactggctgctccctgatgggagccagtgtggacagcaccctggctttcaacacctacgtccacttccaagggaagatgaagggcttctccctgctggccgagccccaggagttctgggtggacaacagcacctcagtgtctgttcccatgctctctggcatgggcaccttccagcactggagtgacatccaggacaacttctcggtgactcaagtgcccttcactgagagcgcctgcctgctgctgatccagcctcactatgcctctgacctggacaaggtggagggtctcactttccagcaaaactccctcaactggatgaagaaactatctccccggaccatccacctgaccatgccccaactggtgctgcaaggatcttatgacctgcaggacctgctcgcccaggctgagctgcccgccattctgcacaccgagctgaacctgcaaaaattgagcaatgaccgcatcagggtgggggaggtgctgaacagcattttttttgagcttgaagcggatgagagagagcccacagagtctacccaacagcttaacaagcctgaggtcttggaggtgaccctgaaccgcccattcctgtttgctgtgtatgatcaaagcgccactgccctgcacttcctgggccgcgtggccaacccgctgagcacagcatgaggccagggccccagaacacagtgcctggcaaggcctctgcccctggcctttgaggcaaaggccagcagcagataacaaccccggacaaatcagcgatgtgtcacccccagtctcccaccttttcttctaatgagtcgactttgagctggaaagcagccgtttctccttggtctaagtgtgctgcatggagtgagcagtagaagcctgcagcggcacaaatgcacctcccagtttgctgggtttattttagagaatgggggtggggaggcaagaaccagtgtttagcgcgggactactgttccaaaaagaattccaaccgaccagcttgtttgtgaaacaaaaaagtgttcccttttcaagttgagaacaaaaattgggttttaaaattaaagtatacatttttgcattgccttcggtttgtatttagtgtcttgaatgtaagaacatgacctccgtgtagtgtctgtaataccttagttttttccacagatgcttgtgatttttgaacaatacgtgaaagatgcaagcacctgaatttctgtttgaatgcggaaccatagctggttatttctcccttgtgttagtaataaacgtcttgccacaataagcctccaaaaaaaa

SEQ ID NO: 55695 - DNA, 1600 bp, Homo sapiens
ccggaagcccatccaccaatcctcacctctcacctctgtgtccgccctgctgggaaatattccaggctttggccaaggccagtgcagccccaggttcccgagcggcaggttgggtgcggaccatggcctctcacaagctgctggtgaccccccccaaggccctgctcaagcccctctccatccccaaccagctcctgctggggcctggtccttccaacctgcctcctcgcatcatggcagccggggggctgcagatgatcgggtccatgagcaaggatatgtaccagatcatggacgagatcaaggaaggcatccagtacgtgttccagaccaggaacccactcacactggtcatctctggctcgggacactgtgccctggaggccgccctggtcaatgtgctggagcctggggactccttcctggttggggccaatggcatttgggggcagcgagccgtggacatcggggagcgcataggagcccgagtgcacccgatgaccaaggaccctggaggccactacacactgcaggaggtggaggagggcctggcccagcacaagccagtgctgctgttcttaacccacggggagtcgtccaccggcgtgctgcagccccttgatggcttcggggaactctgccacaggtacaagtgcctgctcctggtggattcggtggcatccctgggcgggacccccctttacatggaccggcaaggcatcgacatcctgtactcgggctcccagaaggccctgaacgcccctccagggacctcgctcatctccttcagtgacaaggccaaaaagaagatgtactcccgcaagacgaagcccttctccttctacctggacatcaagtggctggccaacttctggggctgtgacgaccagcccaggatgtaccatcacacaatccccgtcatcagcctgtacagcctgagagagagcctggccctcattgcggaacagggcctggagaacagctggcgccagcaccgcgaggccgcggcgtatctgcatgggcgcctgcaggcactggggctgcagctcttcgtgaaggacccggcgctccggcttcccacagtcaccactgtggctgtacccgctggctatgactggagagacatcgtcagctacgtcatagaccacttcgacattgagatcatgggtggccttgggccctccacggggaaggtgctgcggatcggcctgctgggctgcaatgccacccgcgagaatgtggaccgcgtgacggaggccctgagggcggccctgcagcactgccccaagaagaagctgtgacctgcccactggcacacagctggcactggcacacacctgtcccatgcccaccctgagggatcaggagcaaacagaccctgcaaggtcctccaggcctggggacaggaaagccactgacccagcccgggaggcagaaccaggcagcctccctggccccaggcagcccttttccctccagtggcacctcctggaaacagtccacttgggcgcaaaacccagtgccttccaaatgagctgcagtccccaggccatgagcctcccgggaatgtttaataaagggcctggccacctctcctcac

SEQ ID NO: 55696 - DNA, 1538 bp, Homo sapiens
cctccaaccacctgcacgcctgcctgccagggcctctctggggcagccatgaagtccctcgtcctgctcctttgtcttgctcagctctggggctgccactcagccccacatggcccagggctgatttatagacaaccgaactgcgatgatccagaaactgaggaagcagctctggtggctatagactacatcaatcaaaaccttccttggggatacaaacacaccttgaaccagattgatgaagtaaaggtgtggcctcagcagccctccggagagctgtttgagattgaaatagacaccctggaaaccacctgccatgtgctggaccccacccctgtggcaagatgcagcgtgaggcagctgaaggagcatgctgtcgaaggagactgtgatttccagctgttgaaactagatggcaagttttccgtggtatacgcaaaatgtgattccagtccagactcagccgaggacgtgcgcaaggtgtgccaagactgccccctgctggccccgctgaacgacaccagggtggtgcacgccgcgaaagctgccctggccgccttcaacgctcagaacaacggctccaattttcagctggaggaaatttcccgggctcagcttgtgcccctcccaccttctacctatgtggagtttacagtgtctggcactgactgtgttgctaaagaggccacagaggcagccaagtgtaacctgctggcagaaaagcaatatggcttttgtaaggcaacactcagtgagaagcttggtggggcagaggttgcagtgacctgcacggtgttccaaacacagcccgtgacctcacagccccaaccagaaggtgccaatgaagcagtccccacccccgtggtggacccagatgcacctccgtcccctccacttggcgcacctggactccctccagctggctcacccccagactcccatgtgttactggcagctcctccaggacaccagttgcaccgggcgcactacgacctgcgccacaccttcatgggtgtggtctcattggggtcaccctcaggagaagtgtcgcacccccggaaaacacgcacagtggtgcagcctagtgttggtgctgctgctgggccagtggttcctccatgtccggggaggatcagacacttcaaggtctaggctagacatggcagagatgaggaggtttggcacagaaaacatagccaccattttgtccaagcctgggcatgggtggggggccttgtctgctggccacgcaagtgtcacatgcgatctacattaatatcaagtcttgactccctacttcccgtcattcctcacaggacagaagcagagtgggtggtggttatgtttgacagaaggcattaggttgacaacttgtcatgattttgacggtaagccaccatgattgtgttctctgcctctggttgaccttacaaaaaccattggaactgtgactttgaaaggtgctcttgctaagcttatatgtgcctgttaatgaaagtgcctgaaagaccttccttaataaagaaggttctaagctg

SEQ ID NO: 55697 - DNA, 1194 bp, Homo sapiens
acaggatctgcttagtgaaagaagtggcaagcaatggatcccaaatatcagcgtgtagagctaaatgatggtcacttcatgcccgtattgggatttggcacctatgcacctccagaggttccgaggaacagagctgtagaggtcaccaaattagcaatagaagctggcttccgccatattgattctgcttatttatacaataatgaggagcaggttggactggccatccgaagcaagattgcagatggcagtgtgaagagagaagacatattctacacttcaaagctttggtgcactttctttcaaccacagatggtccaaccagccttggaaagctcactgaaaaaacttcaactggactatgttgacctctatcttcttcatttcccaatggctctcaagccaggtgagacgccactaccaaaagatgaaaatggaaaagtaatattcgacacagtggatctctctgccacatgggaggtcatggagaagtgtaaggatgcaggattggccaagtccatcggggtgtcaaacttcaactgcaggcagctggagatgatcctcaacaagccaggactcaagtacaagcctgtctgcaaccaggtagaatgtcatccttacctcaaccagagcaaactgctggatttctgcaagtcaaaagacattgttctggttgcccacagtgctctgggaacccaacgacataaactatgggtggacccaaactccccagttcttttggaggacccagttctttgtgccttagcaaagaaacacaaacaaaccccagccctgattgccctgcgctaccagctgcagcgtggggttgtggtcctggccaagagctacaatgagcagcggatcagagagaacatccaggtttttgaattccagttgacatcagaggatatgaaagttctagatggtctaaacagaaattatcgatatgttgtcatggattttcttatggaccatcctgattatccattttcagatgaatattagcatagagggtgttgcacgacatctagcagaaggccctgtgtgtggatggtgatgcagaggatgtctctatgctggtgactggacacacagcctctggttaaatccctcccctcctgcttggcaacttcagctagctagatatatccatggtccagaaagcaaacataataaatttttatcttgaagtaa

SEQ ID NO: 55698 - DNA, 1413 bp, Homo sapiens
ccggcctcttggtactgctgaccccagccaggctacagggatcgattggagctgtccttggggctgtaattggccccagctgagcagggcaaacactgaggtcaactacaagccacaggccccttccccagcctcagttcacagctgccctgttgcagggaggcggtggcccttctgttgctagaccgagcctgtgggatataccaaggcagaggagcccatagccatgaggagcctcggggccctgctcttgctgctgagcgcctgcctggcggtgagcgctggccctgtgccaacgccgcccgacaacatccaagtgcaggaaaacttcaatatctctcggatctatgggaagtggtacaacctggccatcggttccacctgcccctggctgaagaagatcatggacaggatgacagtgagcacgctggtgctgggagagggcgctacagaggcggagatcagcatgaccagcactcgttggcggaaaggtgtctgtgaggagacgtctggagcttatgagaaaacagatactgatgggaagtttctctatcacaaatccaaatggaacataaccatggagtcctatgtggtccacaccaactatgatgagtatgccattttcctgaccaagaaattcagccgccatcatggacccaccattactgccaagctctacgggcgggcgccgcagctgagggaaactctcctgcaggacttcagagtggttgcccagggtgtgggcatccctgaggactccatcttcaccatggctgaccgaggtgaatgtgtccctggggagcaggaaccagagcccatcttaatcccgagagtccggagggctgtgctaccccaagaagaggaaggatcagggggtgggcaactggtaactgaagtcaccaagaaagaagattcctgccagctgggctactcggccggtccctgcatgggaatgaccagcaggtatttctataatggtacatccatggcctgtgagactttccagtacggcggctgcatgggcaacggtaacaacttcgtcacagaaaaggagtgtctgcagacctgccgaactgtggcggcctgcaatctccccatagtccggggcccctgccgagccttcatccagctctgggcatttgatgctgtcaaggggaagtgcgtcctcttcccctacgggggctgccagggcaacgggaacaagttctactcagagaaggagtgcagagagtactgcggtgtccctggtgatggtgatgaggagctgctgcgcttctccaactgacaactggccggtctgcaagtcagaggatggccagtgtctgtcccggggtcctgtggcaggcagcgccaagcaacctgggtccaaataaaaactaaattgtaaactcctgaaaaaaaaaaaaaaaaaaa

SEQ ID NO: 55699 - DNA, 2135 bp, Homo sapiens
accctcccagccccggacagcgcatgctgcggcttttcgtcctccactgagtcctgccggtggcccgagctcggtggcctcccggcgaccctcagcgcgaggcgacatggcaggcggccacagcctcctgctggagaacgcgcagcaagtggtgttggtgtgcgcccgcggcgagcgcttcctggcgcgggatgcgctgcgcagcctggcggtgctggaaggcgccagcctggtggtgggcaaagatggatttataaaagctattggtcctgctgatgttattcaaagacagttttctggagaaacttttgaagaaataattgactgctctgggaaatgtatcctaccaggtttggtggatgcacacacacatccagtatgggctggtgaaagagttcacgaatttgcaatgaagttggcaggagccacctacatggaaattcaccaggccggaggagggatccactttaccgtggagcgcacgcgccaagccacagaggaggagctgttccgctccttgcagcaacggctccagtgcatgatgagggctggcaccacgctggtggagtgcaagagtggatatggcctcgacctggagaccgagctcaagatgctgcgcgtgattgagcgcgcccggcgggagctggacatcggcatctcggctacctactgcggggctcattcagtgcctaaaggaaaaactgctactgaagctgctgatgacatcatcaataaccacctcccaaagctgaaggaacttggcagaaatggggaaatacacgtggacaatatagacgtattttgtgagaaaggtgtctttgatctcgattccaccagaaggattcttcaacgtggaaaagatatagggttacagattaacttccatggggatgaactccacccgatgaaggctgctgagcttggggctgaactgggagcgcaggcaatcagccacctggaagaagtgagtgatgaaggcatcgttgccatggcaacggccaggtgctctgccatccttctgcccaccacagcctacatgctgagactgaaacaacctcgagccaggaagatgttagatgaaggagtaatagttgctctgggaagtgatttcaaccccaatgcatattgcttttcaatgccaatggtcatgcatctggcctgtgtaaacatgagaatgtccatgcctgaggccttggccgctgccaccatcaatgcagcttatgcactgggaaagtctcacacacacggatcgttggaagttggcaaacagggagatctcattatcatcaattcatcccgatgggagcatttgatttaccagttcggaggccatcatgaattaattgaatatgttatagctaaaggaaaactcatctataaaacatgatagatttgaaaagagaagactttttgactatatgaaataagtcaatatagttatattaaaagttaaaacaccttaatatttacaagaattatatcacttaaacctaaatgtacttcaatgtctttttaagtcactcaaaaaacccaagggatagatttattttcatttaacacatgcatttgacatataaacaggtaaacctattgtgattaaaatcacaaaacatccaattagttcacaaatattggttacaaatattctgtagattaatatggtggggtatcacaaaaatgcctttgtggggaaaagtaggcttggcttaaaatttccattttgtgtctgtatttcacatctcagtttttaaactatatttagtgaacattgagggatcgaaagaaatctaagtgatacgccccaatggagctaaaatatagccttctgttaagcaaatagtatttcctttccccaagtagttcattttctagatgcttgtcaaatgaattaatgtcctctgatgaagagtgtccttccgtttctaaggtcttctcaatctcagcaatagagcttcccagcagcgttcaagacacatcatttatacacaggcacaggggccttcctgaaatgggtgcatttttaccaactacaatcatgtaatttttttggaaattttttaaaatttttgattctttacattacaattgggtgaaacacattttacagctctcaataaatgtttgctgtcgctctt

SEQ ID NO: 55700 - DNA, 805 bp, Homo sapiens
ccccacctagatgcaaagcaggattcaaaagaacatctttgcgttttctaccggctccccatcatcgtactagggaggaagaagcgggtgagaaacaaaacttctttccattgtcctgcccgtttctgcggacttgttctgaggccgaggagcctgtgttggaagagatggtgatgggcctgggcgttttgttgttggtcttcgtgctgggtctgggtctgaccccaccgaccctggctcaggataactccaggtacacacacttcctgacccagcactatgatgccaaaccacagggccgggatgacagatactgtgaaagcatcatgaggagacggggcctgacctcaccctgcaaagacatcaacacatttattcatggcaacaagcgcagcatcaaggccatctgtgaaaacaagaatggaaaccctcacagagaaaacctaagaataagcaagtcttctttccaggtcaccacttgcaagctacatggaggttccccctggcctccatgccagtaccgagccacagcggggttcagaaacgttgttgttgcttgtgaaaatggcttacctgtccacttggatcagtcaattttccgtcgtccgtaaccagcgggcccctggtcaagtgctggctctgctgtccttgccttccatttcccctctgcacccagaacagtggtggcaacattcattgccaagggcccaaagaaagagctacctggaccttttgttttctgtttgacaacatgtttaataaataaaaatgtcttgatatcagtaagaaaaaaaaaaaaaaaaaa

SEQ ID NO: 55701 - DNA, 897 bp, Homo sapiens
agagactgcgagaaggaggtcccccacggcccttcaggatgaaagctgcggtgctgaccttggccgtgctcttcctgacggggagccaggctcggcatttctggcagcaagatgaacccccccagagcccctgggatcgagtgaaggacctggccactgtgtacgtggatgtgctcaaagacagcggcagagactatgtgtcccagtttgaaggctccgccttgggaaaacagctaaacctaaagctccttgacaactgggacagcgtgacctccaccttcagcaagctgcgcgaacagctcggccctgtgacccaggagttctgggataacctggaaaaggagacagagggcctgaggcaggagatgagcaaggatctggaggaggtgaaggccaaggtgcagccctacctggacgacttccagaagaagtggcaggaggagatggagctctaccgccagaaggtggagccgctgcgcgcagagctccaagagggcgcgcgccagaagctgcacgagctgcaagagaagctgagcccactgggcgaggagatgcgcgaccgcgcgcgcgcccatgtggacgcgctgcgcacgcatctggccccctacagcgacgagctgcgccagcgcttggccgcgcgccttgaggctctcaaggagaacggcggcgccagactggccgagtaccacgccaaggccaccgagcatctgagcacgctcagcgagaaggccaagcccgcgctcgaggacctccgccaaggcctgctgcccgtgctggagagcttcaaggtcagcttcctgagcgctctcgaggagtacactaagaagctcaacacccagtgaggcgcccgccgccgccccccttcccggtgctcagaataaacgtttccaaagtggg

SEQ ID NO: 55702 - DNA, 473 bp, Homo sapiens
aggcacagacaccaaggacagagacgctggctaggccgccctccccactgttaccaacatgaagctgctcgcagcaactgtgctactcctcaccatctgcagccttgaaggagctttggttcggagacaggcaaaggagccatgtgtggagagcctggtttctcagtacttccagaccgtgactgactatggcaaggacctgatggagaaggtcaagagcccagagcttcaggccgaggccaagtcttactttgaaaagtcaaaggagcagctgacacccctgatcaagaaggctggaacggaactggttaacttcttgagctatttcgtggaacttggaacacagcctgccacccagtgaagtgtccagaccattgtcttccaaccccagctggcctctagaacacccactggccagtcctagagctcctgtccctacccactctttgctacaataaatgctgaatgaatcc

SEQ ID NO: 55703 - DNA, 1889 bp, Homo sapiens
agcagataatggcaagcatggctgccgtgctcacctgggctctggctcttctttcagcgttttcggccacccaggcacggaaaggcttctgggactacttcagccagaccagcggggacaaaggcagggtggagcagatccatcagcagaagatggctcgcgagcccgcgaccctgaaagacagccttgagcaagacctcaacaatatgaacaagttcctggaaaagctgaggcctctgagtgggagcgaggctcctcggctcccacaggacccggtgggcatgcggcggcagctgcaggaggagttggaggaggtgaaggctcgcctccagccctacatggcagaggcgcacgagctggtgggctggaatttggagggcttgcggcagcaactgaagccctacacgatggatctgatggagcaggtggccctgcgcgtgcaggagctgcaggagcagttgcgcgtggtgggggaagacaccaaggcccagttgctggggggcgtggacgaggcttgggctttgctgcagggactgcagagccgcgtggtgcaccacaccggccgcttcaaagagctcttccacccatacgccgagagcctggtgagcggcatcgggcgccacgtgcaggagctgcaccgcagtgtggctccgcacgcccccgccagccccgcgcgcctcagtcgctgcgtgcaggtgctctcccggaagctcacgctcaaggccaaggccctgcacgcacgcatccagcagaacctggaccagctgcgcgaagagctcagcagagcctttgcaggcactgggactgaggaaggggccggcccggacccccagatgctctccgaggaggtgcgccagcgacttcaggctttccgccaggacacctacctgcagatagctgccttcactcgcgccatcgaccaggagactgaggaggtccagcagcagctggcgccacctccaccaggccacagtgccttcgccccagagtttcaacaaacagacagtggcaaggttctgagcaagctgcaggcccgtctggatgacctgtgggaagacatcactcacagccttcatgaccagggccacagccatctgggggacccctgaggatctacctgcccaggcccattcccagctccttgtctggggagccttggctctgagcctctagcatggttcagtccttgaaagtggcctgttgggtggagggtggaaggtcctgtgcaggacagggaggccaccaaaggggctgctgtctcctgcatatccagcctcctgcgactccccaatctggatgcattacattcaccaggctttgcaaacccagcctcccagtgctcatttgggaatgctcatgagttactccattcaagggtgagggagtagggagggagaggcaccatgcatgtgggtgattatctgcaagcctgtttgccgtgatgctggaagcctgtgccactacatcctggagtttggctctagtcacttctggctgcctggtggccactgctacagctggtccacagagaggagcacttgtctccccagggctgccatggcagctatcaggggaatagaagggagaaagagaatatcatggggagaacatgtgatggtgtgtgaatatccctgctggctctgatgctggtgggtacgaaaggtgtgggctgtgataggagagggcagagcccatgtttcctgacatagctctacacctaaataagggactgaaccctcccaactgtgggagctccttaaaccctctggggagcatactgtgtgctctccccatctccagcccctccctctgggttcccaagttgaagcctagacttctggctcaaatgaaatagatgtttatgataaaaaaaaaaaaaaaaaaaaaaa

SEQ ID NO: 55704 - DNA, 753 bp, Homo sapiens
gttgtggctgtggagcggaagtgggtctcaaccactataaatcctctctgtgcccgtccggagctggtgaggacagcctgccagagtctggtctctggacactatgggcacacgactcctcccagctctgtttcttgtcctcctggtattgggatttgaggtccaggggacccaacagccccagcaagatgagatgcctagcccgaccttcctcacccaggtgaaggaatctctctccagttactgggagtcagcaaagacagccgcccagaacctgtacgagaagacatacctgcccgctgtagatgagaaactcagggacttgtacagcaaaagcacagcagccatgagcacttacacaggcatttttactgaccaagttctttctgtgctgaagggagaggagtaacagccagaccccccatcagtggacaaggggagagtcccctactcccctgatcccccaggttcagactgagctcccccttcccagtagctcttgcatcctcctcccaactctagcctgaattcttttcaataaaaaatacaattcaagttgcttctcatggatggcactgcttttctgaggactcaagggccaagatggaggggctgactcagtccagccaacatttaatgagcacctactttatgtatggagctctaacccatgggtccatgggaataaagcagtgaatagtaacaataaataatcgtaacaaaaaaaaaaaaaaaaaaaaaaaaaaaaaaaaa

SEQ ID NO: 55705 - DNA, 1720 bp, Homo sapiens
aggcagaacaggatcaggaagcgatcaaacctaccaaggcagtctcacttctcaatgactggactgtgtgggtactctgctccagacatgcgtggcctcagactcatcatgataccagttgagctgctactttgctacctcctgctgcaccctgtggatgccacttcatatggaaagcagacaaatgtcttgatgcactttcccttgtccttggaatcccagacaccctcctcagaccccttgtcctgccaatttctgcacccaaagtcactgcctggtttcagccacatggcccctctacccaagttcttggtaagcctggctctaaggaatgccctggaggaagctggttgtcaggctgatgtttgggctctacagctacagctctaccgccagggtggtgtgaatgctacacaggtcctcatccagcatcttcgagggctccagaaaggcagaagcacagagaggaacgtgtcagtggaagccctggcctctgctctgcagctgttagccagggagcagcaaagcacaggaagggtcgggcgctccctcccgacagaggactgtgagaatgagaaggagcaagctgtgcacaatgtagtccagctgctgccaggagtgggaaccttctacaacctgggcacagctttgtattatgctactcaaaactgcctgggcaaggccagggaacgaggccgagatggggccatagatctgggatatgaccttctgatgaccatggctgggatgtcaggggggcctatgggtctagcgatcagtgctgcacttaaacctgcattaaggtctggggttcagcagttgatccagtattaccaagatcagaaagacgcaaacatctctcagccggagaccaccaaggagggtttgagggccatctcagatgtgagtgacttggaagaaacaactactctggcttctttcatatcagaagtagtaagttcagctccctactgggggtgggccataatcaagagctatgacttagatcctggggctgggagtcttgagatataaaagaatgtggtaaccacagaattaataactgtactaccctgacaagctatatacatgtcttcaaaattttaatctgatttatccaggaggaaggctgtacagtaaaacgtaagaacgtaaatgtttgggtgttgaagtcacagggtttggtttcgaatctaggctccacttgttagagcctcggtgatcactgaatagtaacttctttcttgaactaagatcagttttgaagtttctaaaggagatagaatgattttaacctcaatgagttgccctgtaaatttaaaatgatacaatgaatctaaaatgcttatcacagtactttcaataaatagctattagccaggtgcggtggctcacgcctgtaatcccagcactgtgagaggctgaggcgggatgatcacctgaggtcaggagttcaagatcagcctgggcaacatggcgaaaccccgtctctacaataaatacaaaaaattatcctggcggagttatgcacgcttgtagtcccaactacctgggaggctgaggcgggagaatcacctgagcctgggaggtcgaggctgcagcgagccgagatcgcgccgctgcattccagcctgggtgacagagcgagaccatgtctcaaaaaataaaaataaaaaaaaattgttttcacaaaaaaaaaaaaaaaaaaaaaaaaaaaaaa

SEQ ID NO: 55706 - DNA, 1182 bp, Homo sapiens
ccactttggtagtgccagtgtgactcatccacaatgatttctccagtgctcatcttgttctcgagttttctctgccatgttgctattgcaggacggacctgtcccaagccagatgatttaccattttccacagtggtcccgttaaaaacattctatgagccaggagaagagattacgtattcctgcaagccgggctatgtgtcccgaggagggatgagaaagtttatctgccctctcacaggactgtggcccatcaacactctgaaatgtacacccagagtatgtccttttgctggaatcttagaaaatggagccgtacgctatacgacttttgaatatcccaacacgatcagtttttcttgtaacactgggttttatctgaatggcgctgattctgccaagtgcactgaggaaggaaaatggagcccggagcttcctgtctgtgctcccatcatctgccctccaccatccatacctacgtttgcaacacttcgtgtttataagccatcagctggaaacaattccctctatcgggacacagcagtttttgaatgtttgccacaacatgcgatgtttggaaatgatacaattacctgcacgacacatggaaattggactaaattaccagaatgcagggaagtaaaatgcccattcccatcaagaccagacaatggatttgtgaactatcctgcaaaaccaacactttattacaaggataaagccacatttggctgccatgatggatattctctggatggcccggaagaaatagaatgtaccaaactgggaaactggtctgccatgccaagttgtaaagcatcttgtaaattacctgtgaaaaaagccactgtggtgtaccaaggagagagagtaaagattcaggaaaaatttaagaatggaatgctacatggtgataaagtttctttcttctgcaaaaataaggaaaagaagtgtagctatacagaggatgctcagtgtatagatggcactatcgaagtccccaaatgcttcaaggaacacagttctctggctttttggaaaactgatgcatccgatgtaaagccatgctaaggtggttttcagattccacataaaatgtcacacttgtttcttgttcatccaaggaacctaattgaaatttaaaaataaagctactgaatttattgccgcaaaaaaaaaaaa

SEQ ID NO: 55707 - DNA, 790 bp, Homo sapiens
agagtggactgagcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtggatgggaaggagttcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgaaagatgggctctgtgtgccccggaaatggatctaccacctgactgaagggagcacagatctcagaactgaaggccgccctgacatgaagactgagctcttttccagctcatgcccaggtggaatcatgctgaatgagacaggccagggttaccagcgctttctcctctacaatcgctcaccacatcctcccgaaaagtgtgtggaggaattcaagtccctgacttcctgcctggactccaaagccttcttattgactcctaggaatcaagaggcctgtgagctgtccaataactgacctgtaacttcatctaagtccccagatgggtacaatgggagctgagttgttggagggagaagctggagacttccagctccagctcccactcaagataataaagataatttttcaatcctcaaaaaaaaaaaaaaaaaaaaaaaaaaaaaa

SEQ ID NO: 55708 - DNA, 1285 bp, Homo sapiens
ggggcccagggccctcctatggaccctgcccgctcccctcccattgtccacggctgtccgcccacccccattctccaagcttcagccccctccttagttcggcatctgcacagcactgaagaacctgggaatcagaccctgagaccctgagcaatcccaggtccagcgccagccctatcatgaccaaggagtatcaagaccttcagcatctggacaatgaggagagtgaccaccatcagctcagaaaagggccacctcctccccagcccctcctgcagcgtctctgctccggacctcgcctcctcctgctctccctgggcctcagcctcctgctgcttgtggttgtctgtgtgatcggatcccaaaactcccagctgcaggaggagctgcggggcctgagagagacgttcagcaacttcacagcgagcacggaggcccaggtcaagggcttgagcacccagggaggcaatgtgggaagaaagatgaagtcgctagagtcccagctggagaaacagcagaaggacctgagtgaagatcactccagcctgctgctccacgtgaagcagttcgtgtctgacctgcggagcctgagctgtcagatggcggcgctccagggcaatggctcagaaaggacctgctgcccggtcaactgggtggagcacgagcgcagctgctactggttctctcgctccgggaaggcctgggctgacgccgacaactactgccggctggaggacgcgcacctggtggtggtcacgtcctgggaggagcagaaatttgtccagcaccacataggccctgtgaacacctggatgggcctccacgaccaaaacgggccctggaagtgggtggacgggacggactacgagacgggcttcaagaactggaggccggagcagccggacgactggtacggccacgggctcggaggaggcgaggactgtgcccacttcaccgacgacggccgctggaacgacgacgtctgccagaggccctaccgctgggtctgcgagacagagctggacaaggccagccaggagccacctctcctttaatttatttcttcaatgcctcgacctgccgcaggggtccgggattgggaatccgcccatctgggggcctcttctgctttctcgggaattttcatctaggattttaagggaaggggaaggatagggtgatgttccgaaggtgaggagcttgaaacccgtggcgctttctgcagtttgcaggttatcattgtgaactttttttttttttaagagtaaaaagaaatatacctaaa

SEQ ID NO: 55709 - DNA, 1405 bp, Homo sapiens
gcaggccttgcccggaccagcccctcctccactctcctctcccctgtgagctccacctgccccagttctcctggctttaacccctccttggccaaggccagggttgcctgcgggagccaggcgtccgctctccacacctttcacagccccagccctcagagcaacctcagcccagcccagcccagctccagctccagctccagcccgggccccatcatggccaaggactttcaagatatccagcagctgagctcggaggaaaatgaccatcctttccatcaaggtgaggggccaggcactcgcaggctgaatcccaggagaggaaatccatttttgaaagggccacctcctgcccagcccctggcacagcgtctctgctccatggtctgcttcagtctgcttgccctgagcttcaacatcctgctgctggtggtcatctgtgtgactgggtcccaaagtgagggtcacagaggtgcacagctgcaagccgagctgcggagcctgaaggaagctttcagcaacttctcctcgagcaccctgacggaggtccaggcaatcagcacccacggaggcagcgtgggtgacaagatcacatccctaggagccaagctggagaaacagcagcaggacctgaaagcagatcacgatgccctgctcttccatctgaagcacttccccgtggacctgcgcttcgtggcctgccagatggagctcctccacagcaacggctcccaaaggacctgctgccccgtcaactgggtggagcaccaaggcagctgctactggttctctcactccgggaaggcctgggctgaggcggagaagtactgccagctggagaacgcacacctggtggtcatcaactcctgggaggagcagaaattcattgtacaacacacgaaccccttcaatacctggataggtctcacggacagtgatggctcttggaaatgggtggatggcacagactataggcacaactacaagaactgggctgtcactcagccagataattggcacgggcacgagctgggtggaagtgaagactgtgttgaagtccagccggatggccgctggaacgatgacttctgcctgcaggtgtaccgctgggtgtgtgagaaaaggcggaatgccaccggcgaggtggcctgaccccagcacacctctggctaacccataccccacacctgcccagctctggcttctctgttgaggattttgaggaaaggaagaaacactgagacaggggtatggggaagagctgagcaaagagagaaaggaggtagtttaagagtccctgaccctggaggactgagatcccacctccttctgtaattcattgtaattattataatcgtcagcctcttcaatggcgtaggaaagaagaaacaaatgcttgaatctc

SEQ ID NO: 55710 - DNA, 1493 bp, Homo sapiens
gcaggccttgcccggaccagcccctcctccactctcctctcccctgtgagctccacctgccccagttctcctggctttaacccctccttggccaaggccagggttgcctgcgggagccaggcgtccgctctccacacctttcacagatcctacccaggccaccaccccgaacccctccgaccctgcgttccatcccaccatcaacctccacgtgaatctgcacctctgccccagccccagccctcagagcaacctcagcccagcccagcccagctccagctccagctccagcccgggccccatcatggccaaggactttcaagatatccagcagctgagctcggaggaaaatgaccatcctttccatcaaggtgaggggccaggcactcgcaggctgaatcccaggagaggaaatccatttttgaaagggccacctcctgcccagcccctggcacagcgtctctgctccatggtctgcttcagtctgcttgccctgagcttcaacatcctgctgctggtggtcatctgtgtgactgggtcccaaagtgagggtcacagaggtgcacagctgcaagccgagctgcggagcctgaaggaagctttcagcaacttctcctcgagcaccctgacggaggtccaggcaatcagcacccacggaggcagcgtgggtgacaagatcacatccctaggagccaagctggagaaacagcagcaggacctgaaagcagatcacgatgccctgctcttccatctgaagcacttccccgtggacctgcgcttcgtggcctgccagatggagctcctccacagcaacggctcccaaaggacctgctgccccgtcaactgggtggagcaccaaggcagctgctactggttctctcactccgggaaggcctgggctgaggcggagaagtactgccagctggagaacgcacacctggtggtcatcaactcctgggaggagcagaaattcattgtacaacacacgaaccccttcaatacctggataggtctcacggacagtgatggctcttggaaatgggtggatggcacagactataggcacaactacaagaactgggctgtcactcagccagataattggcacgggcacgagctgggtggaagtgaagactgtgttgaagtccagccggatggccgctggaacgatgacttctgcctgcaggtgtaccgctgggtgtgtgagaaaaggcggaatgccaccggcgaggtggcctgaccccagcacacctctggctaacccataccccacacctgcccagctctggcttctctgttgaggattttgaggaaaggaagaaacactgagacaggggtatggggaagagctgagcaaagagagaaaggaggtagtttaagagtccctgaccctggaggactgagatcccacctccttctgtaattcattgtaattattataatcgtcagcctcttcaatggcgtaggaaagaagaaacaaatgcttgaatctc

SEQ ID NO: 55711 - DNA, 1333 bp, Homo sapiens
gcaggccttgcccggaccagcccctcctccactctcctctcccctgtgagctccacctgccccagttctcctggctttaacccctccttggccaaggccagggttgcctgcgggagccaggcgtccgctctccacacctttcacagccccagccctcagagcaacctcagcccagcccagcccagctccagctccagctccagcccgggccccatcatggccaaggactttcaagatatccagcagctgagctcggaggaaaatgaccatcctttccatcaagggccacctcctgcccagcccctggcacagcgtctctgctccatggtctgcttcagtctgcttgccctgagcttcaacatcctgctgctggtggtcatctgtgtgactgggtcccaaagtgcacagctgcaagccgagctgcggagcctgaaggaagctttcagcaacttctcctcgagcaccctgacggaggtccaggcaatcagcacccacggaggcagcgtgggtgacaagatcacatccctaggagccaagctggagaaacagcagcaggacctgaaagcagatcacgatgccctgctcttccatctgaagcacttccccgtggacctgcgcttcgtggcctgccagatggagctcctccacagcaacggctcccaaaggacctgctgccccgtcaactgggtggagcaccaaggcagctgctactggttctctcactccgggaaggcctgggctgaggcggagaagtactgccagctggagaacgcacacctggtggtcatcaactcctgggaggagcagaaattcattgtacaacacacgaaccccttcaatacctggataggtctcacggacagtgatggctcttggaaatgggtggatggcacagactataggcacaactacaagaactgggctgtcactcagccagataattggcacgggcacgagctgggtggaagtgaagactgtgttgaagtccagccggatggccgctggaacgatgacttctgcctgcaggtgtaccgctgggtgtgtgagaaaaggcggaatgccaccggcgaggtggcctgaccccagcacacctctggctaacccataccccacacctgcccagctctggcttctctgttgaggattttgaggaaaggaagaaacactgagacaggggtatggggaagagctgagcaaagagagaaaggaggtagtttaagagtccctgaccctggaggactgagatcccacctccttctgtaattcattgtaattattataatcgtcagcctcttcaatggcgtaggaaagaagaaacaaatgcttgaatctc

SEQ ID NO: 55712 - DNA, 1202 bp, Homo sapiens
ccccagccctcagagcaacctcagcccagcccagcccagctccagctccagctccagcccgggccccatcatggccaaggactttcaagatatccagcagctgagctcggaggaaaatgaccatcctttccatcaagggccacctcctgcccagcccctggcacagcgtctctgctccatggtctgcttcagtctgcttgccctgagcttcaacatcctgctgctggtggtcatctgtgtgactgggtcccaaagtgagggtcacagaggtgcacagctgcaagccgagctgcggagcctgaaggaagctttcagcaacttctcctcgagcaccctgacggaggtccaggcaatcagcacccacggaggcagcgtgggtgacaagatcacatccctaggagccaagctggagaaacagcagcaggacctgaaagcagatcacgatgccctgctcttccatctgaagcacttccccgtggacctgcgcttcgtggcctgccagatggagctcctccacagcaacggctcccaaaggacctgctgccccgtcaactgggtggagcaccaaggcagctgctactggttctctcactccgggaaggcctgggctgaggcggagaagtactgccagctggagaacgcacacctggtggtcatcaactcctgggaggagcagaaattcattgtacaacacacgaaccccttcaatacctggataggtctcacggacagtgatggctcttggaaatgggtggatggcacagactataggcacaactacaagaactgggctgtcactcagccagataattggcacgggcacgagctgggtggaagtgaagactgtgttgaagtccagccggatggccgctggaacgatgacttctgcctgcaggtgtaccgctgggtgtgtgagaaaaggcggaatgccaccggcgaggtggcctgaccccagcacacctctggctaacccataccccacacctgcccagctctggcttctctgttgaggattttgaggaaaggaagaaacactgagacaggggtatggggaagagctgagcaaagagagaaaggaggtagtttaagagtccctgaccctggaggactgagatcccacctccttctgtaattcattgtaattattataatcgtcagcctcttcaatggcgtaggaaagaagaaacaaatgcttgaatctc

SEQ ID NO: 55713 - DNA, 3108 bp, Homo sapiens
gcctcacggtcctgctgatatgtgacatcacccccggaggcccagctgtaaattcctctctttgtactctttctctttatttctcagaccagccgacacttagggaaaatagaacctacgctgaaattttgggggcaggttctcttgctaggttttgaggttttgctgaagatattcctgaagaatcatcccaggtgccacactaaaaaaatgatccagttgacagctacccctgtgagtgcacttgttgatgagccagtgcatatccgagctacaggcctgattccctttcagatggtgagttttcaggcatcactggaagatgaaaacggagacatgttttattctcaagcccactatagggccaatgaattcggtgaggtggacctgaatcatgcttcttcacttggaggggattatatgggagtccaccccatgggtctcttctggtctctgaaacctgaaaagctattaacaagactgttgaaaagagatgtgatgaataggcctttccaggtccaagtaaaactttatgacttagagttaatagtgaacaataaagttgccagtgctccaaaggccagcctgactttggagaggtggtatgtggcacctggtgtcacacgaattaaggttcgagaaggccgccttcgaggagctctctttctccctccaggagagggtctcttcccaggggtaattgatttgtttggtggtttgggtgggctgcttgaatttcgggccagcctcctagccagtcgtggcttcgcctccttggccttggcttaccataactatgaagacctgccccgcaaaccagaagtaacagatttggaatattttgaggaggctgccaactttctcctgagacatccaaaggtctttggctcaggcgttggggtagtctctgtatgtcaaggagtacagattggactatctatggctatttacctaaagcaagtcacagccacggtacttattaatgggaccaactttccttttggcattccacaggtatatcatggtcagatccatcagccccttccccattctgcacaattaatatccaccaatgccttggggttactagagctctatcgcacttttgagacaactcaagttggggccagtcaatatttgtttcctattgaagaggcccaggggcaattcctcttcattgtaggagaaggtgataagactatcaacagcaaagcacacgctgaacaagccataggacagctgaagagacatgggaagaacaactggaccctgctatcttaccctggggcaggccacctgatagaacctccctattctcctctgtgctgtgcctcaacgacccacgatttgaggttacactggggaggagaggtgatcccacacgcagctgcacaggaacatgcttggaaggagatccagagatttctcaggaagcacctcattccagatgtgaccagtcaactctaagaagactagatattcctagaaaataaagaagcaaatctctttaccgggaccttctctcaattttcatggcggaatgtctcccccagctgccacacacacattttgtattaattttaatgattaaaaagagcatagggtaaaaacctgatatttcacttatactgcataacaagctaaccaaactggacatggtgaataaatcataaaacaaatcattttacttattatttacatgacttttctttccatcaggtcttctaaataggactgaggtatagtacactggcaaaaataagaaaaggcaaacaagaatagcaccaaagtaacagatataaaaccaaataccatgtcagaaaacactatatagtaagaatttatcagattagagcagcaggagaaaattaatactaaattataatcattttagtgatatttttcaacttcaccacagtaactttgcaacatcatttttcatttgtggggtagtaaaattcatgtcaaaaaggaaagaaggaatggaggaggtcagttagttcattgcaataaattacctcttcagttcttaaaaacatgcccattggcacataactgagacataataactaagactggaagagccttggtttaagttatgaagcaaattaaaatggaaaatacaagaaaatagaaccaattaggttgaaaatgccccttactgaaaatctgtattaaaaataaaattaataaaagtaaaaaataaaaatagaaacacaactctactagtacaggctagcctggggagtttgataaactgagtgattgggtcaactatcactgtacttccataatgaatttcttcagtcatgttagagtagcacatgaatgtgagctctataaggacaggtactatatttccgtaagacccaatagttactgtacatcccataaataaaaaatactttagtttgctaaccaactgaatatatgaggactgcatgtaattcaaccacatggttgtttgctgtacagtcctttgcaaatattaaaaaattttttttgctataaggctttgatcatatagtcctcatagcaacataactaccatctagcatgtaccacattttgcaagactttaagttcaacattccaaactgccaatttgtattatgtccaaatgcagtatccttgaggaatatagtgggtcagttaaatatctagagacatacaaacatctgctaattcatctcattgagatggatcattctgatctccatcatccacccacttttcatcagcttctcctacttcattctcctcatagtctttatcatgagggattctgtatcctgtctctcatctacacttgctggccttcctggttgtgatttattggaacagtctacacaaaaaccatagggtcaagatccatgtcttactccaacactggctgctaacatgatcttacataccatacatttgcatttttatccttcttgtgcaccaagaaatgttttcttacatgttttctccaagtgtaaaaagtcacagctaaatgatctcactcctgtatgaataagcaagtgcttttttagtgtttgtttgcatttggctgcatagctacaatgatggcattttaacttattcatgattagagatgatgat

SEQ ID NO: 55714 - DNA, 2444 bp, Homo sapiens
agtaacagttgattgttacattcagtaacactgaatgtcagtgcagtccaatttacaggctggagcagcagctgcatcctgcatttccccgaagtattacatgattttcactccttgcaaactttaccatctttgttgcagagaatcggaaatcaatatgcatagcaaagtcacaatcatatgcatcagatttctcttttggtttcttttgctctgcatgcttattgggaagtcacatactgaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagtgcaggagcagcttcagttagcctgcatttgctttctcctggaagccattcattgttcaccagagccattctgcaaagtggatcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgtcagtaaactttggtccgaccgtggatggtgattttctcactgacatgccagacatattacttgaacttggacaatttaaaaaaacccagattttggtgggtgttaataaagatgaagggacagcttttttagtctatggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacatgtttaattaaatttcacaatataaagttctacagttaattatgtgcatattaaaacaatggcctggttcaatttctttctttccttaataaatttaagttttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatc

SEQ ID NO: 55715 - DNA, 3394 bp, Homo sapiens
cccagcgcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaacagatctcatttgatccttaagccagtctcatgaatgaaaaggacaggtttttttcttttgtaaatgaagcatttgcagcttaaagaggatgcatgaaataacccttttatcgcttataaatagtgccagttatgtgttcctgccacggctgtggaaatacttcacatttgcattccaggactgttttggatccatttgcccgagaatcttctgactaactctgtgtcctcatctgggcagcacacaccaagtgcccactggtacctctgcatgtccatggtgctgtgtgactggccagccagcagccagtgactcagagctggctgtatggagggggtgggaatgtttctggagatttttgtttttccagacacagtcttgctcagtcccctaggctggagtgcaatggcaccatctccgctcactgcaacctccgcctccctggttcaagcggttctcctgcctcagccttccaagtagctggggttataggcacccaccaccatgccgggctaatttttgtatttttagtagagatggggtttcaccatgttggctaggctggtcccgaactcccgacttcaagtgatccgcctgccttggcctcccaaagtgctgggattacaggcatgagatttttacttgagatttttccatcctcttttaggactcaggatagacttgtgtggaggtgctctctggctaaggggataagttgttactggtttgggtctgcttggttttgccttgggtggggccggtgtcgatggggcaggcttggcacgagcagtggtgccatggcagggcactgtggcatctcccctagcagtggatttggggtccctgcttgcctcacgtggtgcttacacacatgtacacacacacacacacacacacacacacacacaccttacacacatgtacacacacacacacacacacacacacacacacacacacacacacacacacacacacacacacacacacacacccctgttctgcagggcttcagcgtggccttcattcccgcctcgcctcggcctcttttcaattaagaagtgatgccacttgaggcagggtctgcatgatcacttcttgggtttcagtttgaaagctgccatccctgcgactgcccagggcctgtatgttgggaccgaagccaaacaccactgtcctccagggggctttcggcccggggcagggtccccagtgcccgccttcgaatcagactccgcgtttccgcctctccctgggcggacctgccgctagagggcgctcctcctccgcagccggcgccggcctccagcgccccagactcccgcgctgccgcccgagcctgaggtttctcacggcgttcgggattcgcgcttcggaaaccgggaacaaagaagcaagcagcacccttcagaaacagtgttctcgctctcctagcagctggcccgggcccggaggctggtgccaggagaaggcagaagagcccgggcagccggagtgggctacggggttcaggcagtgccaaggaagaagggcctcacaatgggcaattcagctgcctcccgggccgttgtccccgctgtcttcaaacaggggtcccctgtcccagctgccccaggaggagggggggaggcaggcagggccgaaaccctccagagcccagagggggacgcttggtggccgctgcagttacataaccataggatgcttttgtaccgtggaccttgttctagcaggatcctttcggaattgcacttttacatgttgggcgaatttgtgtccgtgctgaagtttattaaaggaaaatagatgga

SEQ ID NO: 55716 - DNA, 3546 bp, Homo sapiens
cccagcgcgcgcttcgcgtgtagaagcgtccgggtggcggaggccgcaggccgcaggagtgctggtggaggggcttccagaaagaccctgcggcagcgccccccctcggctctccccgcaggagagcgggcacctgcgcggcgccgggtgaaggcgagagcctcggcgagccctctgcagcggagccccctgcccatttggttttggccagtcagcctggaaatctgcctgtagtcagctgatgcagagtcaccctgcagttcctactttgaggggttgcagaagcacatatttcactatggagggccgcctgcaggcctcgcgctgacaggatcttttgtgacgctgcaaatgtcctgaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaacagatctcatttgatccttaagccagtctcatgaatgaaaaggacaggtttttttcttttgtaaatgaagcatttgcagcttaaagaggatgcatgaaataacccttttatcgcttataaatagtgccagttatgtgttcctgccacggctgtggaaatacttcacatttgcattccaggactgttttggatccatttgcccgagaatcttctgactaactctgtgtcctcatctgggcagcacacaccaagtgcccactggtacctctgcatgtccatggtgctgtgtgactggccagccagcagccagtgactcagagctggctgtatggagggggtgggaatgtttctggagatttttgtttttccagacacagtcttgctcagtcccctaggctggagtgcaatggcaccatctccgctcactgcaacctccgcctccctggttcaagcggttctcctgcctcagccttccaagtagctggggttataggcacccaccaccatgccgggctaatttttgtatttttagtagagatggggtttcaccatgttggctaggctggtcccgaactcccgacttcaagtgatccgcctgccttggcctcccaaagtgctgggattacaggcatgagatttttacttgagatttttccatcctcttttaggactcaggatagacttgtgtggaggtgctctctggctaaggggataagttgttactggtttgggtctgcttggttttgccttgggtggggccggtgtcgatggggcaggcttggcacgagcagtggtgccatggcagggcactgtggcatctcccctagcagtggatttggggtccctgcttgcctcacgtggtgcttacacacatgtacacacacacacacacacacacacacacacacaccttacacacatgtacacacacacacacacacacacacacacacacacacacacacacacacacacacacacacacacacacacacccctgttctgcagggcttcagcgtggccttcattcccgcctcgcctcggcctcttttcaattaagaagtgatgccacttgaggcagggtctgcatgatcacttcttgggtttcagtttgaaagctgccatccctgcgactgcccagggcctgtatgttgggaccgaagccaaacaccactgtcctccagggggctttcggcccggggcagggtccccagtgcccgccttcgaatcagactccgcgtttccgcctctccctgggcggacctgccgctagagggcgctcctcctccgcagccggcgccggcctccagcgccccagactcccgcgctgccgcccgagcctgaggtttctcacggcgttcgggattcgcgcttcggaaaccgggaacaaagaagcaagcagcacccttcagaaacagtgttctcgctctcctagcagctggcccgggcccggaggctggtgccaggagaaggcagaagagcccgggcagccggagtgggctacggggttcaggcagtgccaaggaagaagggcctcacaatgggcaattcagctgcctcccgggccgttgtccccgctgtcttcaaacaggggtcccctgtcccagctgccccaggaggagggggggaggcaggcagggccgaaaccctccagagcccagagggggacgcttggtggccgctgcagttacataaccataggatgcttttgtaccgtggaccttgttctagcaggatcctttcggaattgcacttttacatgttgggcgaatttgtgtccgtgctgaagtttattaaaggaaaatagatgga

SEQ ID NO: 55717 - DNA, 3330 bp, Homo sapiens
attgaaagaatacacagaaagcctggaaaaggtttccaggggtgtcaatacgccctgtcaactgagaattaagaggatccggctggtcacttgcctggagaggatcctgcatgctgatagtgctgaggcacctgccagctaagaaccaccgggaggaactgggccattctaacacccgttgctaccatgctggccacccgcctctccagacccctgtcacggctcccaggaaaaaccctaagtgcctgtgatagagaaaatggagcaagacgcccactattgcttggttctacttcctttatcccgattggccgtcggacttatgccagtgcggcggagccggttggcagcaaagctgtcctggtcacaggctgtgactctggatttgggttctcattggccaagcatctgcattcaaaaggcttccttgtgtttgctggctgcttgatgaaggacaaaggccatgatggggtcaaggagctggacagcctaaacagtgaccgattgagaaccgtccagctcaatgtctgcagcagcgaagaggtggagaaagtggtggagattgtccgctcgagcctgaaggaccctgagaaaggcatgtggggcctcgttaacaatgccggcatctcaacgttcggggaggtggagttcaccagcctggagacctacaagcaggtggcagaagtgaacctttggggcacagtgcggatgacgaaatcctttctccccctcatccgaagggccaaaggccgcgtcgtcaatatcagcagcatgctgggccgcatggccaacccggcccgctccccgtactgcatcaccaagttcggggtagaggctttctcggactgcctgcgctatgagatgtaccccctgggcgtgaaggtcagcgtggtggagcccggcaacttcatcgctgccaccagcctttacagccctgagagcattcaggccatcgccaagaagatgtgggaggagctgcctgaggtcgtgcgcaaggactacggcaagaagtactttgatgaaaagatcgccaagatggagacctactgcagcagtggctccacagacacgtcccctgtcatcgatgctgtcacacacgccctgaccgccaccaccccctacacccgctaccaccccatggactactactggtggctgcgaatgcagatcatgacccacttgcctggagccatctccgacatgatctacatccgctgaagagtctcgctgtggcctctgtcagggatccctggtggaaggggaggggagggaggaacccatatagtcaactcttgattatccacgtgtggattatccaccatgccaggaagacccataactggttttaacactaactagagggaatgacttctttgcatagtgagtgacttgggccttcacaaacagggtgtggagtggcaggcagaggcctctaaatctcagggcaaacatggtgaatctatctctccggagataatttcatacagagattttaagaaaacatctttatattaaaaacagatctcatttgatccttaagccagtctcatgaatgaaaaggacaggtttttttcttttgtaaatgaagcatttgcagcttaaagaggatgcatgaaataacccttttatcgcttataaatagtgccagttatgtgttcctgccacggctgtggaaatacttcacatttgcattccaggactgttttggatccatttgcccgagaatcttctgactaactctgtgtcctcatctgggcagcacacaccaagtgcccactggtacctctgcatgtccatggtgctgtgtgactggccagccagcagccagtgactcagagctggctgtatggagggggtgggaatgtttctggagatttttgtttttccagacacagtcttgctcagtcccctaggctggagtgcaatggcaccatctccgctcactgcaacctccgcctccctggttcaagcggttctcctgcctcagccttccaagtagctggggttataggcacccaccaccatgccgggctaatttttgtatttttagtagagatggggtttcaccatgttggctaggctggtcccgaactcccgacttcaagtgatccgcctgccttggcctcccaaagtgctgggattacaggcatgagatttttacttgagatttttccatcctcttttaggactcaggatagacttgtgtggaggtgctctctggctaaggggataagttgttactggtttgggtctgcttggttttgccttgggtggggccggtgtcgatggggcaggcttggcacgagcagtggtgccatggcagggcactgtggcatctcccctagcagtggatttggggtccctgcttgcctcacgtggtgcttacacacatgtacacacacacacacacacacacacacacacacaccttacacacatgtacacacacacacacacacacacacacacacacacacacacacacacacacacacacacacacacacacacacccctgttctgcagggcttcagcgtggccttcattcccgcctcgcctcggcctcttttcaattaagaagtgatgccacttgaggcagggtctgcatgatcacttcttgggtttcagtttgaaagctgccatccctgcgactgcccagggcctgtatgttgggaccgaagccaaacaccactgtcctccagggggctttcggcccggggcagggtccccagtgcccgccttcgaatcagactccgcgtttccgcctctccctgggcggacctgccgctagagggcgctcctcctccgcagccggcgccggcctccagcgccccagactcccgcgctgccgcccgagcctgaggtttctcacggcgttcgggattcgcgcttcggaaaccgggaacaaagaagcaagcagcacccttcagaaacagtgttctcgctctcctagcagctggcccgggcccggaggctggtgccaggagaaggcagaagagcccgggcagccggagtgggctacggggttcaggcagtgccaaggaagaagggcctcacaatgggcaattcagctgcctcccgggccgttgtccccgctgtcttcaaacaggggtcccctgtcccagctgccccaggaggagggggggaggcaggcagggccgaaaccctccagagcccagagggggacgcttggtggccgctgcagttacataaccataggatgcttttgtaccgtggaccttgttctagcaggatcctttcggaattgcacttttacatgttgggcgaatttgtgtccgtgctgaagtttattaaaggaaaatagatgga

SEQ ID NO: 55718 - DNA, 2436 bp, Homo sapiens
cgaccacctgtctggacaccacaaagatgccacccgttgggggcaaaaaggccaagaagggcatcctagaacgtttaaatgctggagagattgtgattggagatggagggtttgtctttgcactggagaagaggggctacgtaaaggcaggaccctggactcctgaagctgctgtggagcacccagaagcagttcgccagcttcatcgagagttcctcagagctggctcaaacgtcatgcagaccttcaccttctatgcgagtgaagacaagctggagaacaggggcaactatgtcttagagaagatatctgggcaggaagtcaatgaagctgcttgcgacatcgcccgacaagtggctgatgaaggagatgctttggtagcaggaggagtgagtcagacaccttcataccttagctgcaagagtgaaactgaagtcaaaaaagtatttctgcaacagttagaggtctttatgaagaagaacgtggacttcttgattgcagagtattttgaacacgttgaagaagctgtgtgggcagttgaaaccttgatagcatccggtaaacctgtggcagcaaccatgtgcattggcccagaaggagatttgcatggcgtgccccccggcgagtgtgcagtgcgcctggtgaaagcaggagcatccatcattggtgtgaactgccactttgaccccaccattagtttaaaaacagtgaagctcatgaaggagggcttggaggctgcccaactgaaagctcacctgatgagccagcccttggcttaccacactcctgactgcaacaagcagggattcatcgatctcccagaattcccatttggactggaacccagagttgccaccagatgggatattcaaaaatacgccagagaggcctacaacctgggggtcaggtacattggcgggtgctgtggatttgagccctaccacatcagggcaattgcagaggagctggccccagaaaggggctttttgccaccagcttcagaaaaacatggcagctggggaagtggtttggacatgcacaccaaaccctgggttagagcaagggccaggaaggaatactgggagaatcttcggatagcctcaggccggccatacaacccttcaatgtcaaagccagatggctggggagtgaccaaaggaacagccgagctgatgcagcagaaagaagccacaactgagcagcagctgaaagagctctttgaaaaacaaaaattcaaatcacagtagcctcgatagaagctatttttgatgaatttctaggtgtttgggtcacagttcctacaaatacggaaaagggggttaaaaagcagtgctttcatgaatgccatcctacacatattattgctattacctgaacaaaatagaattacaaatagcacttgataattttaaagtatgttttagaaattttcttaggagcaaaataagtacaaagtaaatcttgaacaggttcactaagcacccaccctgtgaaaagtattatggaaatcactgcagcacaggaaaagtaattcagatgttaatgccacttgaagaagttggtaggctagcaaagaggatgagacatgaactgtcataaaggactcagcaaccagccagggacagataaagcgctatggaaaggggcttccaagttcttttgaacatgacccttagtaacaaacacaatttatataatgacccagcaaaacacatcacatcttactgtcgaaattaaatgtgtgatccatcctagtattttctgttccattccttttcattctatttcatttataaaacatgctagttgagacttttcaaatggatttttatgacccactactgggtttggatccacagtttgaaaaatattgctacaagacacttaaggagaccatcctgtttaagtttattcttataagtaggtcagtcatatgagacctgatcaataaatatccaatacccagagtcctgctctcagagttcttctgtttcgtgacccacttttctaccagtaaaagacatagaccaatggggaggaggggaggagagatggatatttcagccctctccatcctagtcaacactggatccacctagtgcctctgggccataaggctgagcagagtgagcttgtattagttggtagcttttaaaaaatataataaaaaaaaagtagagattctccaaactctagcctggtttcctagattgagaactatgatatttttctctgataatttaatatctactctcctacaaaagctcaagcctgaagatacaagactattagaagaaacatgactaccctcagtgtattagaaaagaggtcatgcagctttctaaacattattgaattgtttgagctgttttgaaattgtaattcttttcagctattaaaaagaagagcaatgagaaaaaaaaaaaaaaaaaaaaa

SEQ ID NO: 55719 - DNA, 1733 bp, Homo sapiens
gttgaggccaccctggtggcaccaaagccctctcaggcaggcagacccagggcctccccgccacaccttgttcatggattttgtcgctggagccatcggaggcgtctgcggtgttgctgtgggctaccccctggacacggtgaaggtcaggatccagacggagccaaagtacacaggcatctggcactgcgtccgggatacgtatcaccgagagcgcgtgtggggcttctaccggggcctctcgctgcccgtgtgcacggtgtccctggtatcttccgtgtcttttggcacctaccgccactgcctggcgcacatctgccggctccggtacggcaaccctgacgccaagcccaccaaggccgacatcacgctctcgggatgcgcctccggcctcgtccgcgtgttcctgacgtcgcccactgaggtggccaaagtccgcttgcagacgcagacacaggcgcagaagcagcagcggcggctttcggcctcggggccgttggctgtgccccccatgtgtcctgtgcccccagcctgcccagagcccaagtaccgcgggccactgcactgcctggccacggtagcccgtgaggaggggctgtgcggcctctacaagggcagctcggccctggtcttacgggacggccactcctttgccacctacttcctttcctacgcggtcctctgcgagtggctcagccccgctggccacagccggccagatgtcccgggcgtgctggtggccgggggctgtgcaggagtcctggcctgggctgtggccacccccatggacgtgatcaagtcgagactgcaggcagacgggcagggccagaggcgctaccggggtctcctgcactgtatggtgaccagcgttcgagaggagggaccccgggtccttttcaaggggctggtactcaattgctgccgcgccttccctgtcaacatggtggtcttcgtcgcctatgaggcagtgctgaggctcgcccggggtctgctcacatagccggtccccacgcccagcggcccacccaccagcagctgctggaggtcgtagtggctggaggaggcaaggggtagtgtggctgggttcgggaccccacagggccattgcccaggagaatgaggagcctccctgcagtgttgtcggccgaggcctgagctcgccctgcccagctactgacctcaggtcgaggggcccgccagccatcagccagggttggcctagggtggcaggagccagggaggagtgggcctctttgatgagagcgttgagttgcatggagtcggttgttcatcccagcctccccatggccctcgcctcccatgtctttgaagcacccctccagggagtcaggtgtgtgctcagccaccctctgccccattcctagaccctcacccccaccactgttcctgtgtcttcacgagctgtcccttacaggcaggggcttcccacaggctgggggcctcggggcggggagcatgagctgggctggcaccacgactgagggctcccggctcggcttcttccccacagcaggctgctcagagggggtgctgccgggactgccatgcccacctgagaggggcctggggtggccgtcctcggccggttagggaatttggggtgaggttcctcaggagccctcactctgcctgtggacgctgcacctgccacttaaagaccccaaagactctgttgggaactgttgtcaataaaatgtttctgaggatgttca

SEQ ID NO: 55720 - DNA, 2256 bp, Homo sapiens
tgaaattcagggactctttggtggagcaattaccagtcaacttcagggtattatgataaactctgatctggggaggaaccaggactacatagatcaaggcagttttcttctttgagaaactatcccagatatcatcatagagtcttctgctcttcctcaactaccaaagaaaaacatcagcgaagcagcaggccatgcaccccccaaaaactccatctggggctcttcatagaaaaaggaaaatggcagcctggcccttctccaggctgtggaaagtctctgatccaattctcttccaaatgaccttgatcgctgctctgttgcctgctgttcttggcaattgtggtcctccacccactttatcatttgctgccccgatggatattacgttgactgagacacgcttcaaaactggaactactctgaaatacacctgcctccctggctacgtcagatcccattcaactcagacgcttacctgtaattctgatggcgaatgggtgtataacaccttctgtatctacaaacgatgcagacacccaggagagttacgtaatgggcaagtagagattaagacagatttatcttttggatcacaaatagaattcagctgttcagaaggatttttcttaattggctcaaccactagtcgttgtgaagtccaagatagaggagttggctggagtcatcctctcccacaatgtgaaattgtcaagtgtaagcctcctccagacatcaggaatggaaggcacagcggtgaagaaaatttctacgcatacggcttttctgtcacctacagctgtgacccccgcttctcactcttgggccatgcctccatttcttgcactgtggagaatgaaacaataggtgtttggagaccaagccctcctacctgtgaaaaaatcacctgtcgcaagccagatgtttcacatggggaaatggtctctggatttggacccatctataattacaaagacactattgtgtttaagtgccaaaaaggttttgttctcagaggcagcagtgtaattcattgtgatgctgatagcaaatggaatccttctcctcctgcttgtgagcccaatagttgtattaatttaccagacattccacatgcttcctgggaaacatatcctaggccgacaaaagaggatgtgtatgttgttgggactgtgttaaggtaccgctgtcatcctggctacaaacccactacagatgagcctacgactgtgatttgtcagaaaaatttgagatggaccccataccaaggatgtgaggcgttatgttgccctgaaccaaagctaaataatggtgaaatcactcaacacaggaaaagtcgtcctgccaatcactgtgtttatttctatggagatgagatttcattttcatgtcatgagaccagtaggttttcagctatatgccaaggagatggcacgtggagtccccgaacaccatcatgtggagacatttgcaattttcctcctaaaattgcccatgggcattataaacaatctagttcatacagctttttcaaagaagagattatatatgaatgtgataaaggctacattctggtcggacaggcgaaactctcctgcagttattcacactggtcagctccagcccctcaatgtaaagctctgtgtcggaaaccagaattagtgaatggaaggttgtctgtggataaggatcagtatgttgagcctgaaaatgtcaccatccaatgtgattctggctatggtgtggttggtccccaaagtatcacttgctctgggaacagaacctggtacccagaggtgcccaagtgtgagtgggagacccccgaaggctgtgaacaagtgctcacaggcaaaagactcatgcagtgtctcccaaacccagaggatgtgaaaatggccctggaggtatataagctgtctctggaaattgaacaactggaactacagagagacagcgcaagacaatccactttggataaagaactataatttttctcaaaagaaggaggaaaaggtgtcttgctggcttgcctcttgcaattcaatacagatcagtttagcaaatctactgtcaatttggcagtgatattcatcataataaatatctagaaatgataatttgctaaagtttagtgctttgagattgtgaaattattaatcatcctctgtgtggctcatgtttttgcttttcaacacacaaagcacaaattttttttcgattaaaaatgtatgtataaaaaactaaaaaaaaaaaaaa

SEQ ID NO: 55721 - DNA, 1131 bp, Homo sapiens
attcccagaaaccaggaaatttctgaaactgagttttaaacctggcaactcttttaccatccctttgtatttttgcagttcctccctataccagcttccttacagctgttctgatttcctgtcgtaagattttttcttttcattttctccagggagggtaaatcaatataacctcttctctagagaggaggtggttaggttggtcttaagcagtgttagaagatctattttttttcaaaccaggtgtctgagctgggtgaattccagcctggggagaggactttgatcaccagatgtttttttggtgtgcgtgctgtcttatggttgcgtggcgagtttctgcttcagatgcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttggttctgaaaaaaaaaaaaaaaaaa

SEQ ID NO: 55722 - DNA, 1128 bp, Homo sapiens
attcccagaaaccaggaaatttctgaaactgagttttaaacctggcaactcttttaccatccctttgtatttttgcagttcctccctataccagcttccttacagctgttctgatttcctgtcgtaagattttttcttttcattttctccagggagggtaaatcaatataacctcttctctagagaggaggtggttaggttggtcttaagcagtgttagaagatctattttttttcaaaccaggtgtctgagctgggtgaattccagcctggggagaggactttgatcaccagatgtttttttggtgtgcgtgctgtcttatggttgcgtggcgagtttctgcttcagatgagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttggttctgaaaaaaaaaaaaaaaaaa

SEQ ID NO: 55723 - DNA, 968 bp, Homo sapiens
gactttggagctctcagctttggagtcagttaagaccagttccttgctgggaagccctaactctggagggacagagacaggtgtctgagctgggtgaattccagcctggggagaggactttgatcaccagatgtttttttggtgtgcgtgctgtcttatggttgcgtggcgagtttctgcttcagatgcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttggttctgaaaaaaaaaaaaaaaaaa

SEQ ID NO: 55724 - DNA, 965 bp, Homo sapiens
gactttggagctctcagctttggagtcagttaagaccagttccttgctgggaagccctaactctggagggacagagacaggtgtctgagctgggtgaattccagcctggggagaggactttgatcaccagatgtttttttggtgtgcgtgctgtcttatggttgcgtggcgagtttctgcttcagatgagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttggttctgaaaaaaaaaaaaaaaaaa

SEQ ID NO: 55725 - DNA, 967 bp, Homo sapiens
gcaactcttttaccatccctttgtatttttgcagttcctccctataccagcttccttacagctgttctgatttcctgtcgtgtctgagctgggtgaattccagcctggggagaggactttgatcaccagatgtttttttggtgtgcgtgctgtcttatggttgcgtggcgagtttctgcttcagatgcagagcactgtccagagcttcctccagtggacaatagcatatttgtcgcaaaggaggtggaaggacagattctggggacttacgtttgtatcaagggctaccacctggtaggaaagaagacccttttttgcaatgcctctaaggagtgggataacaccactactgagtgccgcttgggccactgtcctgatcctgtgctggtgaatggagagttcagttcttcagggcctgtgaatgtaagtgacaaaatcacgtttatgtgcaatgaccactacatcctcaagggcagcaatcggagccagtgtctagaggaccacacctgggcacctccctttcccatctgcaaaagtagggactgtgaccctcctgggaatccagttcatggctattttgaaggaaataacttcaccttaggatccaccattagttattactgtgaagacaggtactacttagtgggcgtgcaggagcagcaatgcgttgatggggagtggagcagtgcacttccagtctgcaagttgatccaggaagctcccaaaccagagtgtgagaaggcacttcttgcctttcaggagagtaagaacctctgcgaagccatggagaactttatgcaacaattaaaggaaagtggcatgacaatggaggagctaaaatattctctggagctgaagaaagctgagttgaaggcaaaattgttgtaacactacagctgagcagatgtaatagaaataaacctatgaataaattttcttcttggttctgaaaaaaaaaaaaaaaaaa

SEQ ID NO: 55726 - DNA, 5480 bp, Homo sapiens
tatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaactttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaacactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattacatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcgttggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtttgctttcaaaaaaaaaaaaaaaaaa

SEQ ID NO: 55727 - DNA, 3551 bp, Homo sapiens
ttgccttgtgttagctagcaataagaaaagaagctttgtttggattaacatatataccctcttcattctgcatacctattttttccccaataatttgcagcttaggtccgaggacaccacaaactctgcttaaagggcctggaggctctcaaggcatggccagacgctctgtcttgtacttcatcctgctgaatgctctgatcaacaagggccaagcctgcttctgtgatcactatgcatggactcagtggaccagctgctcaaaaacttgcaattctggaacccagagcagacacagacaaatagtagtagataagtactaccaggaaaacttttgtgaacagatttgcagcaagcaggagactagagaatgtaactggcaaagatgccccatcaactgcctcctgggagattttggaccatggtcagactgtgacccttgtattgaaaaacagtctaaagttagatctgtcttgcgtcccagtcagtttgggggacagccatgcactgagcctctggtagcctttcaaccatgcattccatctaagctctgcaaaattgaagaggctgactgcaagaataaatttcgctgtgacagtggccgctgcattgccagaaagttagaatgcaatggagaaaatgactgtggagacaattcagatgaaagggactgtgggaggacaaaggcagtatgcacacggaagtataatcccatccctagtgtacagttgatgggcaatgggtttcattttctggcaggagagcccagaggagaagtccttgataactctttcactggaggaatatgtaaaactgtcaaaagcagtaggacaagtaatccataccgtgttccggccaatctggaaaatgtcggctttgaggtacaaactgcagaagatgacttgaaaacagatttctacaaggatttaacttctcttggacacaatgaaaatcaacaaggctcattctcaagtcagggggggagctctttcagtgtaccaattttttattcctcaaagagaagtgaaaatatcaaccataattctgccttcaaacaagccattcaagcctctcacaaaaaggattctagttttattaggatccataaagtgatgaaagtcttaaacttcacaacgaaagctaaagatctgcacctttctgatgtctttttgaaagcacttaaccatctgcctctagaatacaactctgctttgtacagccgaatattcgatgactttgggactcattacttcacctctggctccctgggaggcgtgtatgaccttctctatcagtttagcagtgaggaactaaagaactcaggtttaaccgaggaagaagccaaacactgtgtcaggattgaaacaaagaaacgcgttttatttgctaagaaaacaaaagtggaacataggtgcaccaccaacaagctgtcagagaaacatgaaggttcatttatacagggagcagagaaatccatatccctgattcgaggtggaaggagtgaatatggagcagctttggcatgggagaaagggagctctggtctggaggagaagacattttctgagtggttagaatcagtgaaggaaaatcctgctgtgattgactttgagcttgcccccatcgtggacttggtaagaaacatcccctgtgcagtgacaaaacggaacaacctcaggaaagctttgcaagagtatgcagccaagttcgatccttgccagtgtgctccatgccctaataatggccgacccaccctctcagggactgaatgtctgtgtgtgtgtcagagtggcacctatggtgagaactgtgagaaacagtctccagattataaatccaatgcagtagacggacagtggggttgttggtcttcctggagtacctgtgatgctacttataagagatcgagaacccgagaatgcaataatcctgccccccaacgaggagggaaacgctgtgagggggagaagcgacaagaggaagactgcacattttcaatcatggaaaacaatggacaaccatgtatcaatgatgatgaagaaatgaaagaggtcgatcttcctgagatagaagcagattccgggtgtcctcagccagttcctccagaaaatggatttatccggaatgaaaagcaactatacttggttggagaagatgttgaaatttcatgccttactggctttgaaactgttggataccagtacttcagatgcttaccagacgggacctggagacaaggggatgtggaatgccaacggacggagtgcatcaagccagttgtgcaggaagtcctgacaattacaccatttcagagattgtatagaattggtgaatccattgagctaacttgccccaaaggctttgttgttgctgggccatcaaggtacacatgccaggggaattcctggacaccacccatttcaaactctctcacctgtgaaaaagatactctaacaaaattaaaaggccattgtcagctgggacagaaacaatcaggatctgaatgcatttgtatgtctccagaagaagactgtagccatcattcagaagatctctgtgtgtttgacacagactccaacgattactttacttcacccgcttgtaagtttttggctgagaaatgtttaaataatcagcaactccattttctacatattggttcctgccaagacggccgccagttagaatggggtcttgaaaggacaagactttcatccaacagcacaaagaaagaatcctgtggctatgacacctgctatgactgggaaaaatgttcagcctccacttccaaatgtgtctgcctattgcccccacagtgcttcaagggtggaaaccaactctactgtgtcaaaatgggatcatcaacaagtgagaaaacattgaacatctgtgaagtgggaactataagatgtgcaaacaggaagatggaaatactgcatcctggaaagtgtttggcctagcacaattactgctaggcccagcacaatgaacagatttaccatcccgaagaaccaactcctacaaatgagaattcttgcacaaacagcagactggcatgctcaaagttactgacaaaaattattttctgttagtttgagatcattattctcccctgactctcctgtttgggcatgtcttattcagttccagctcatgacgccctgtagcatacccctaggtaccaacttccacagcagtctcgtaaattctcctgttcacattgtacaaaaataatgtgacttctgaggcccttatgtagcctgtgacattaagcattctcacaattagaaataagaataaaacccataattttcttcaatgagttaataaacagaaatctccagaacctctgaaacacattcttgaagcccagctttcatatcttcattcaacaaataatttctgagtgtgtatacaggatgtcaagtactgaccaaagtcctgagaactcggcagataataaaacagacaaaagcctttgccttcatgaagcatacattcattcaggggtagacacacaaaaaatgaaataaacaggtaaaatatgtagc

SEQ ID NO: 55728 - DNA, 2397 bp, Homo sapiens
ttttttttttcatcctactttgttttattgggcgttgattgttacaggtcccagcctgtagacatcttttactccaatttcctgaatagatagctttattccttcaaggtaatatagtgcggtggcttctggctgagatgtttgctgttgttttcttcatcttgtctttgatgacttgtcagcctggggtaactgcacaggagaaggtgaaccagagagtaagacgggcagctacacccgcagcagttacctgccagctgagcaactggtcagagtggacagattgctttccgtgccaggacaaaaagtaccgacaccggagcctcttgcagccaaacaagtttgggggaaccatctgcagtggtgacatctgggatcaagccagctgctccagttctacaacttgtgtaaggcaagcacagtgtggacaggatttccagtgtaaggagacaggtcgctgcctgaaacgccaccttgtgtgtaatggagaccaggactgccttgatggctctgatgaggacgactgtgaagatgtcagggccattgacgaagactgcagccagtatgaaccaattccaggatcacagaaggcagccttggggtacaatatcctgacccaggaagatgctcagagtgtgtacgatgccagttattatgggggccagtgtgagacggtatacaatggggaatggagggagcttcgatatgactccacctgtgaacgtctctactatggagatgatgagaaatactttcggaaaccctacaactttctgaagtaccactttgaagccctggcagatactggaatctcctcagagttttatgataatgcaaatgaccttctttccaaagttaaaaaagacaagtctgactcatttggagtgaccatcggcataggcccagccggcagccctttattggtgggtgtaggtgtatcccactcacaagacacttcattcttgaacgaattaaacaagtataatgagaagaaattcattttcacaagaatcttcacaaaggtgcagactgcacattttaagatgaggaaggatgacattatgctggatgaaggaatgctgcagtcattaatggagcttccagatcagtacaattatggcatgtatgccaagttcatcaatgactatggcacccattacatcacatctggatccatgggtggcatttatgaatatatcctggtgattgacaaagcaaaaatggaatcccttggtattaccagcagagatatcacgacatgttttggaggctccttgggcattcaatatgaagacaaaataaatgttggtggaggtttatcaggagaccattgtaaaaaatttggaggtggcaaaactgaaagggccaggaaggccatggctgtggaagacattatttctcgggtgcgaggtggcagttctggctggagcggtggcttggcacagaacaggagcaccattacataccgttcctgggggaggtcattaaagtataatcctgttgttatcgattttgagatgcagcctatccacgaggtgctgcggcacacaagcctggggcctctggaggccaagcgccagaacctgcgccgcgccttggaccagtatctgatggaattcaatgcctgccgatgtgggccttgcttcaacaatggggtgcccatcctcgagggcaccagctgcaggtgccagtgccgcctgggtagcttgggtgctgcctgtgagcaaacacagacagaaggagccaaagcagatgggagctggagttgctggagctcctggtctgtatgcagagcaggcatccaggaaaggagaagagagtgtgacaatccagcacctcagaatggaggggcctcgtgtccagggcggaaagtacagacgcaggcttgctgagggcctctggacacaggctggaccagatgctgtggatgtcgacccctgcactgactattggataaagacttctttcaactaagagaagatgcaaatcagcacacttttttctttgttctgccagcttccaggcctaagactaggttttgctgtctacagccaactattctattagttacaaaactcaatcattttattcagcaactggatgttgactgttaactagaagctctgtcctacttacagcactttggatcatcaaaaaaataaagtaaaatagaaaactgagaaaactcaatccatgaccagggagaacttacaggatgttagagacaaaacaagcagacacctgaaacaatcaacgcccaataaaacaaagtaggatgaaaattctcttagttctttgataacaatttgttcactcatagaaacattattaattggtagggtaagcagacactctgaaacaatgagaaaaatactaaaaattgacttgagttatttc

SEQ ID NO: 55729 - DNA, 2053 bp, Homo sapiens
ggcactcacagcacaggcttgttatgggtctagcagcctctgtggcatctcctgtcacattgggaaaatgaagaattccaggacatgggcttggagggcgccggtggagctatttcttctctgtgctgccctgggctgtctcagtttgcctggctccagaggtgaaaggccacattcctttgggtcaaatgcagtcaacaagagctttgctaagagcagacagatgcggagtgtggatgttaccctgatgcccattgattgtgagctgtctagttggtcctcttggaccacatgtgacccctgtcagaagaaaaggtacaggtatgcctacttgctccagccctctcagttccatggggaaccgtgcaacttctctgacaaggaagtcgaagactgtgttaccaacagaccatgcggaagtcaagtgcgatgtgaaggctttgtgtgtgcacagacaggaaggtgtgtaaaccgcagacttctttgcaatggggacaatgactgtggagaccagtcagatgaagcaaactgtagaaggatttataaaaaatgtcagcatgaaatggaccaatactggggaattggcagtctggccagtgggataaatttgttcacaaacagttttgagggcccagttcttgatcacaggtattatgcaggtggatgctccccgcattacatcctgaacacgaggtttaggaagccctacaatgtggaaagctacacgccacagacccaaggcaaatacgaattcatattaaaagagtatgaatcatactcagattttgaacgcaatgtcacagagaaaatggcaagcaagtctggtttcagttttggttttaaaatacctggaatatttgaacttggcatcagtagtcaaagtgatcgaggcaaacactatattaggagaaccaaacgattctctcatactaaaagcgtatttctgcatgcacgctctgaccttgaagtagcacattacaagctgaaacccagaagcctcatgctccattacgagttccttcagagagttaagcggctgcccctggagtacagctacggggaatacagagatctcttccgtgattttgggacccactacatcacagaggctgtgcttgggggcatttatgaatacaccctcgttatgaacaaagaggccatggagagaggagattatactcttaacaacgtccatgcctgtgccaaaaatgattttaaaattggtggtgccattgaagaggtctacgtcagtctgggtgtgtctgtaggcaaatgcagaggtattctgaatgaaataaaagacagaaacaagagggacaccatggtggaggacttggtggtcctggtacgaggaggggcaagtgagcacatcaccaccctggcataccaggagctgccgacggcggacctgatgcaggagtggggagacgctgtgcagtacaacccagccatcatcaaagttaaggtggagcctctgtatgaactagtgacagccacagattttgcctattccagcacagtgaggcagaacatgaagcaggcactggaggagttccagaaggaagttagttcctgccactgtgctccctgccaaggaaatggagtccctgtcctgaaaggatcacgctgtgactgcatctgtcctgttggatcccaaggcctagcctgtgaggtctcctatcggaagaatacccccattgatgggaagtggaattgctggtcaaattggtcttcatgctctggaagacgtaagacaagacaaaggcagtgtaacaatccacctcctcaaaatgggggtagcccctgttcaggccctgcttcagaaacacttgactgctcctagcagatgatacagcagtgggctacatacaatgagagccctgagccctcaagaactcatgccagctcagccctacaccagtttccacctggagttcatgcaagggcaaaaggcagtgccatgcaagctgtttaaaataaagatgttaccttgtaaaatgcaagttgatttaaataaatactgagttaaaggcttaaaaaaaaaaaaaaaaaa

SEQ ID NO: 55730 - DNA, 857 bp, Homo sapiens
ctgggactttggtggtgctacccttggcctcccagagtcctgccaccctgctgccgccaccatgctgccccctgggactgcgaccctcttgactctgctcctggcagctggctcgctgggccagaagcctcagaggccacgccggcccgcatcccccatcagcaccatccagcccaaggccaattttgatgctcagcagtttgcagggacctggctccttgtggctgtgggctccgcttgccgtttcctgcaggagcagggccaccgggccgaggccaccacactgcatgtggctccccagggcacagccatggctgtcagtaccttccgaaagctggatgggatctgctggcaggtgcgccagctctatggagacacaggggtcctcggccgcttcctgcttcaagcccgaggcgcccgaggggctgtgcacgtggttgtcgctgagaccgactaccagagtttcgctgtcctgtacctggagcgggcggggcagctgtcagtgaagctctacgcccgctcgctccctgtgagcgactcggtcctgagtgggtttgagcagcgggtccaggaggcccacctgactgaggaccagatcttctacttccccaagtacggcttctgcgaggctgcagaccagttccacgtcctggacgaagtgaggaggtgaggccggcacacagctccagtgctgagaagtcagtgccccgagagacgaccccaccagtggggtgcccgctgcctgtcctccgtgaaaccagcctcagatcagggccctgccacccagggcaggggatcttctgccggctgccccagaggacagtgggtggagtggtacctacttattaaatgtctcc

SEQ ID NO: 55731 - DNA, 2094 bp, Homo sapiens
gcttgttccctgtcctctggccctttgcaaataaatgccttaccagacctgccctgccaccccactcgcagccacccagcaagagcagcatgtcagcctgccggagctttgcagttgcaatctgcattttagaaataagcatcctcacagcacagtacacgaccagttatgacccagagctaacagaaagcagtggctctgcatcacacatagactgcagaatgagcccctggagtgaatggtcacaatgcgatccttgtctcagacaaatgtttcgttcaagaagcattgaggtctttggacaatttaatgggaaaagatgcaccgacgctgtgggagacagacgacagtgtgtgcccacagagccctgtgaggatgctgaggatgactgcggaaatgactttcaatgcagtacaggcagatgcataaagatgcgacttcggtgtaatggtgacaatgactgcggagacttttcagatgaggatgattgtgaaagtgagccccgtcccccctgcagagacagagtggtagaagagtctgagctggcacgaacagcaggctatgggatcaacattttagggatggatcccctaagcacaccttttgacaatgagttctacaatggactctgtaaccgggatcgggatggaaacactctgacatactaccgaagaccttggaacgtggcttctttgatctatgaaaccaaaggcgagaaaaatttcagaaccgaacattacgaagaacaaattgaagcatttaaaagtatcatccaagagaagacatcaaattttaatgcagctatatctctaaaatttacacccactgaaacaaataaagctgaacaatgttgtgaggaaacagcctcctcaatttctttacatggcaagggtagttttcggttttcatattccaaaaatgaaacttaccaactatttttgtcatattcttcaaagaaggaaaaaatgtttctgcatgtgaaaggagaaattcatctgggaagatttgtaatgagaaatcgcgatgttgtgctcacaacaacttttgtggatgatataaaagctttgccaactacctatgaaaagggagaatattttgcctttttggaaacctatggaactcactacagtagctctgggtctctaggaggactctatgaactaatatatgttttggataaagcttccatgaagcggaaaggtgttgaactaaaagacataaagagatgccttgggtatcatctggatgtatctctggctttctctgaaatctctgttggagctgaatttaataaagatgattgtgtaaagaggggagagggtagagctgtaaacatcaccagtgaaaacctcatagatgatgttgtttcactcataagaggtggaaccagaaaatatgcatttgaactgaaagaaaagcttctccgaggaaccgtgattgatgtgactgactttgtcaactgggcctcttccataaatgatgctcctgttctcattagtcaaaaactgtctcctatatataatctggttccagtgaaaatgaaaaatgcacacctaaagaaacaaaacttggaaagagccattgaagactatatcaatgaatttagtgtaagaaaatgccacacatgccaaaatggaggtacagtgattctaatggatggaaagtgtttgtgtgcctgcccattcaaatttgagggaattgcctgtgaaatcagtaaacaaaaaatttctgaaggattgccagccctagagttccccaatgaaaaatagagctgttggcttctctgagctccagtggaagaagaaaacactagtaccttcagatcctacccctgaagataatcttagctgccaagtaaatagcaacatgcttcatgaaaatcctaccaacctctgaagtctcttctctcttaggtctataattttttttttaatttttcttccttaaactcctgtgatgtttccattttttgttccctaatgagaagtcaacagtgaaatacgccagaactgctttatcccacggaaaatgccaatctcttctaaaaaaaaacaaaattaaactaaaaaaaaaaaaaaaaaaaaaaaaaaaaaa

SEQ ID NO: 55732 - DNA, 1084 bp, Homo sapiens
cagacagcagggaacatcaccctcttcagactggagtcagtgggaacagacccaagatgttggggaggaacacttggaagacctcagctttctccttcttggttgagcagatgtgggcccctctctggagtcgttcgatgaggccagggcgatggtgttctcagcgttcctgtgcatggcaaaccagcaataacactttgcacccactctggacggtcccggtctccgtgccagggggcacccggcagtctcctattaacatccagtggagggacagcgtctatgacccccagctgaagccactcagggtctcctatgaagcggcatcctgcctgtacatctggaacactggctacctcttccaggtggaatttgacgatgccaccgaggcatcaggaattagtggtgggcccttggaaaaccactacagactgaagcaatttcacttccactggggagcagtgaacgaggggggctcagagcacacagtggacggccacgcgtaccccgcagagctgcatttagttcactggaattctgtgaaataccaaaattacaaggaagctgtcgtgggagagaatggtttggctgtgataggcgtgtttttaaagctcggggcccatcatcagacgctgcagaggctggtggacatcttgccggaaataaaacataaggacgcgcgggcggccatgcgccccttcgacccctccactctgctgcccacctgctgggattactggacctacgcgggctcgctcaccaccccgccgctgaccgagtcggtcacctggatcatccagaaggagcccgttgaagtggccccaagccagctctctgcatttcgtactctcctgttttctgcacttggtgaagaggagaagatgatggtgaacaactatcgcccacttcaacccttgatgaaccggaaggtctgggcgtccttccaggccactaatgagggcacaaggtcctagagacattaggtccacatgaatagcagaactgactttgaaggaaggaagcgttgtttcccaagtttcacaatgtgattgtacatgacttctgaaattaaaaagagagcatg

SEQ ID NO: 55733 - DNA, 1497 bp, Homo sapiens
cggaccaccagcaacagacaacatcttcattcggctctccctgaagctgtactgcctcgctgagaggatgaaggtctccgaggctgccctgtctctccttgtcctcatccttatcattacttcggcttctcgcagccagccaaaagttcctgagtgggtgaacaccccatccacctgctgcctgaagtattatgagaaagtgttgccaaggagactagtggtgggatacagaaaggccctcaactgtcacctgccagcaatcatcttcgtcaccaagaggaaccgagaagtctgcaccaaccccaatgacgactgggtccaagagtacatcaaggatcccaacctacctttgctgcctaccaggaacttgtccacggttaaaattattacagcaaagaatggtcaaccccagctcctcaactcccagtgatgaccaggctttagtggaagcccttgtttacagaagagaggggtaaacctatgaaaacaggggaagccttattaggctgaaactagccagtcacattgagagaagcagaacaatgatcaaaataaaggagaagtatttcgaatattttctcaatcttaggaggaaataccaaagttaagggacgtgggcagaggtacgctcttttatttttatatttatatttttatttttttgagatagggtcttactctgtcacccaggctggagtgcagtggtgtgatcttggctcacttgatcttggctcactgtaacctccacctcccaggctcaagtgatcctcccaccccagcctcctgagtagctgggactacaggcttgcgccaccacacctggctaatttttgtatttttggtagagacgggattctaccatgttgcccaggctggtctcaaactcgtgtgcccaagcaatccacctgcctcagccttccaaaagtgctgggattacaggcgtgagccaccacatccggccagtgcactcttaatacacagaaaaatatatttcacatccttctcctgctctctttcaattcctcacttcacaccagtacacaagccattctaaatacttagccagtttccagccttccagatgatctttgccctctgggtcttgacccattaagagccccatagaactcttgatttttcctgtccatctttatggatttttctggatctatattttcttcaattattctttcattttataatgcaactttttcataggaagtccggatgggaatattcacattaatcatttttgcagagactttgctagatcctctcatattttgtcttcctcagggtggcaggggtacagagagtgcctgattggaaaaaaaaaaaaaagagagagagagagaagaagaagaagaagagacacaaatctctacctcccatgttaagctttgcaggacagggaaagaaagggtatgagacacggctaggggtaaactcttagtccaaaacccaagcatgcaataaataaaactcccttatttgaca

SEQ ID NO: 55734 - DNA, 2024 bp, Homo sapiens
agcgcagggcggtaactctgggcggggctgggctccagggctggacagcacagtccctctgaactgcacagagacctcgcaggccccgagaactgtcgcccttccacgatgtggctccgtgcctttatcctggccactctctctgcttccgcggcttgggggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggccaaaaaaaaaaaaaaaaa

SEQ ID NO: 55735 - DNA, 2027 bp, Homo sapiens
agcgcagggcggtaactctgggcggggctgggctccagggctggacagcacagtccctctgaactgcacagagacctcgcaggccccgagaactgtcgcccttccacgatgtggctccgtgcctttatcctggccactctctctgcttccgcggcttgggcagggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgcagttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggccaaaaaaaaaaaaaaaaa

SEQ ID NO: 55736 - DNA, 2021 bp, Homo sapiens
agcgcagggcggtaactctgggcggggctgggctccagggctggacagcacagtccctctgaactgcacagagacctcgcaggccccgagaactgtcgcccttccacgatgtggctccgtgcctttatcctggccactctctctgcttccgcggcttgggggcatccgtcctcgccacctgtggtggacaccgtgcatggcaaagtgctggggaagttcgtcagcttagaaggatttgcacagcctgtggccattttcctgggaatcccttttgccaagccgcctcttggacccctgaggtttactccaccgcagcctgcagaaccatggagctttgtgaagaatgccacctcgtaccctcctatgtgcacccaagatcccaaggcggggcagttactctcagagctatttacaaaccgaaaggagaacattcctctcaagctttctgaagactgtctttacctcaatatttacactcctgctgacttgaccaagaaaaacaggctgccggtgatggtgtggatccacggaggggggctgatggtgggtgcggcatcaacctatgatgggctggcccttgctgcccatgaaaacgtggtggtggtgaccattcaatatcgcctgggcatctggggattcttcagcacaggggatgaacacagccgggggaactggggtcacctggaccaggtggctgccctgcgctgggtccaggacaacattgccagctttggagggaacccaggctctgtgaccatctttggagagtcagcgggaggagaaagtgtctctgttcttgttttgtctccattggccaagaacctcttccaccgggccatttctgagagtggcgtggccctcacttctgttctggtgaagaaaggtgatgtcaagcccttggctgagcaaattgctatcactgctgggtgcaaaaccaccacctctgctgtcatggttcactgcctgcgacagaagacggaagaggagctcttggagacgacattgaaaatgaaattcttatctctggacttacagggagaccccagagagagtcaaccccttctgggcactgtgattgatgggatgctgctgctgaaaacacctgaagagcttcaagctgaaaggaatttccacactgtcccctacatggtcggaattaacaagcaggagtttggctggttgattccaatgttgatgagctatccactctccgaagggcaactggaccagaagacagccatgtcactcctgtggaagtcctatccccttgtttgcattgctaaggaactgattccagaagccactgagaaatacttaggaggaacagacgacactgtcaaaaagaaagacctgttcctggacttgatagcagatgtgatgtttggtgtcccatctgtgattgtggcccggaaccacagagatgctggagcacccacctacatgtatgagtttcagtaccgtccaagcttctcatcagacatgaaacccaagacggtgataggagaccacggggatgagctcttctccgtctttggggccccatttttaaaagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaaggccaaaaaaaaaaaaaaaaa

SEQ ID NO: 55737 - DNA, 1962 bp, Homo sapiens
gttctgatgctgatcttcagtaactctgctgcctctgcctgcctattcagcatttgcctgttaacaggaagctctttctggctcccaactgaagctctctgaggccagcagccgccgtcaatgttcacagagtgcaggcaggcagccaaatgagtgggaattgggtgcacccaggccagatcctaatttgggctatctgggtccttgcagcccccaccaaagggccttctgctgaagggccacagaggaacaccaggctgggatggattcagggcaagcaagtcactgtgctgggaagccctgtgcctgtgaacgtgttcctcggagtcccctttgctgctcccccgctgggatccctgcgatttacgaacccgcagcctgcatcgccctgggataacttgcgagaagccacctcctaccctaatttgtgcctccagaactcagagtggctgctcttagatcaacacatgctcaaggtgcattacccgaaattcggagtgtcagaagactgcctctacctgaacatctatgcgcctgcccacgccgatacaggctccaagctccccgtcttggtgtggttcccaggaggtgccttcaagactggctcagcctccatctttgatgggtccgccctggctgcctatgaggacgtgctggttgtggtcgtccagtaccggctaggaatatttggtttcttcaccacatgggatcagcatgctccggggaactgggccttcaaggaccaggtggctgctctgtcctgggtccagaagaacatcgagttcttcggtggggaccccagctctgtgaccatctttggcgagtccgcgggagccataagtgtttctagtcttatactgtctcccatggccaaaggcttattccacaaagccatcatggagagtggggtggccatcatcccttacctggaggcccatgattatgagaagagtgaggacctgcaggtggttgcacatttctgtggtaacaatgcgtcagactctgaggccctgctgaggtgcctgaggacaaaaccctccaaggagctgctgaccctcagccagaaaacaaagtctttcactcgagtggttgatggtgctttctttcctaatgagcctctagatctattgtctcagaaagcatttaaagcaattccttccattatcggagtcaataaccacgagtgtggcttcctgctgcctatgaaggaggctcctgagatcctcagtggctccaacaagtcccttgccctccatctgatacaaaacatcctgcacatcccgcctcagtatttgcaccttgtggctaatgaatacttccatgacaagcactccctgactgaaatccgagacagtcttctggacttgcttggagatgtgttctttgtggtccctgcactgatcacagctcgatatcacagagaaggagccacggaggaggagaagttactgagccggaagatgatgaaatactgggctacctttgctcgaaccgggaatcctaatgggaacgacctgtctctgtggccagcttataatctgactgagcagtacctccagctggacttgaacatgagcctcggacagagactcaaagaaccgcgggtggatttttggaccagcaccatccccctgatcctgtctgcctccgacatgctccacagtcctctttcttccttaactttcctctctctcctccagcctttctttttcttttgtgctccttgagaagttatctttctgtgattttggtttcccttctcctcccataatttctcccgcaatcattagcttctttctgagctcagctgctttctatggggatccttgcaaaacaagctgctttcgctgatattttatggacttaggaatgatccttacagaattcttttcaacatcaaaaagtgcaatttgtcttggaaggcaacaagatttcttcaataaatttggaagagggctggcc

SEQ ID NO: 55738 - DNA, 1043 bp, Homo sapiens
tgttaatgaaagcagattcaaagcaacaccaccaccactgaagtatttttagttatataagattggaactaccaagcatgtggctcctggtcagtgtaattctaatctcacggatatcctctgttgggggagaagcaatgttctgtgattttccaaaaataaaccatggaattctatatgatgaagaaaaatataagccattttcccaagttcctacaggggaagttttctattactcctgtgaatataattttgtgtctccttcaaaatccttttggactcgcataacgtgcgcagaagaaggatggtcaccaacaccaaagtgtctcagactgtgtttctttccttttgtggaaaatggtcattctgaatcttcaggacaaacacatctggaaggtgatactgtacaaattatttgcaacacaggatacagacttcaaaacaatgagaacaacatttcatgtgtagaacggggctggtccactcctcccaaatgcaggtccactatttctgcagaaaaatgtgggccccctccacctattgacaatggagacattacttcattcctgttgtcagtatatgctccaggttcatcagttgagtaccagtgccagaacttgtatcaacttgagggtaacaatcaaataacatgtagaaacggacaatggtcagaaccaccaaaatgcttagatccatgtgtaatatcacaagaaattatggaaaaatataacataaaattaaagtggacaaaccaacaaaagctttattcaagaacaggtgacatagttgaatttgtttgtaaatctggatatcatccaacaaaatctcattcatttcgagcaatgtgtcagaatgggaaactggtatatcccagttgtgaagaaaaatagaatcaatggcattactattagtaaaatgcacacctttttctgaatttactattatatttgttttcaatttcatttttcaagtactgttttactcatttttattcataaataaagttttgtgttgatttgtgaaaatgcaattacaagagccaa

SEQ ID NO: 55739 - DNA, 2823 bp, Homo sapiens
ggcaggtgcttgttactgttaatgaaagcagatttaaagcaacaccaccatcactggagtatttttagttatatacgattgagactaccaagcatgttgctcttattcagtgtaatcctaatctcatgggtatccactgttgggggagaaggaacactttgtgattttccaaaaatacaccatggatttctgtatgatgaagaagattataaccctttttcccaagttcctacaggggaagttttctattactcctgtgaatataattttgtgtctccttcaaaatccttttggactcgcataacatgcacagaagaaggatggtcaccaacaccgaagtgtctcagaatgtgttcctttccttttgtgaaaaatggtcattctgaatcttcaggactaatacatctggaaggtgatactgtacaaattatttgcaacacaggatacagccttcaaaacaatgagaaaaacatttcgtgtgtagaacggggctggtccactcctcccatatgcagcttcactaaaggagaatgtcatgttccaattttagaagccaatgtagatgctcagccaaaaaaagaaagctacaaagttggagacgtgttgaaattctcctgcagaaaaaatcttataagagttggatcagactcagttcaatgttaccaatttgggtggtcacctaactttccaacatgcaaaggacaagtacgatcatgtggtccacctcctcaactctccaatggtgaagttaaggagataagaaaagaggaatatggacacaatgaagtagtggaatatgattgcaatcctaattttataataaacgggcctaagaaaatacaatgtgtggatggagaatggacaactttacccacttgtgttgaacaagtgaaaacatgtggatacatacctgaactcgagtacggttatgttcagccgtctgtccctccctatcaacatggagtttcagtcgaggtgaattgcagaaatgaatatgcaatgattggaaataacatgattacctgtattaatggaatatggacagagcttcctatgtgtgttgcaacacaccaacttaagaggtgcaaaatagcaggagttaatataaaaacattactcaagctatctgggaaagaatttaatcataattctagaatacgttacagatgttcagacatcttcagatacaggcactcagtctgtataaacgggaaatggaatcctgaagtagactgcacagaaaaaagggaacaattctgcccaccgccacctcagatacctaatgctcagaatatgacaaccacagtgaattatcaggatggagaaaaagtagctgttctctgtaaagaaaactatctacttccagaagcaaaagaaattgtatgtaaagatggacgatggcaatcattaccacgctgtgttgagtctactgcatattgtgggccccctccatctattaacaatggagataccacctcattcccattatcagtatatcctccagggtcaacagtgacgtaccgttgccagtccttctataaactccagggctctgtaactgtaacatgcagaaataaacagtggtcagaaccaccaagatgcctagatccatgtgtggtatctgaagaaaacatgaacaaaaataacatacagttaaaatggagaaacgatggaaaactctatgcaaaaacaggggatgctgttgaattccagtgtaaattcccacataaagcgatgatatcatcaccaccatttcgagcaatctgtcaggaagggaaatttgaatatcctatatgtgaatgaagcaagcataattttcctgaatatattcttcaaacatccatctacgctaaaagtagccattatgtagccaattctgtagttacttcttttattctttcaggtgttgtttaactcagttttatttagaactctggatttttagagctttagaaatttgtaagctgagagaacaatgtttcacttaataggagggtgtcttagtccatattacattgttataacagagtatcacagactggataacttctaaccaatagtttatttgtttcataaatctaaaagctgagaagtccaagatggtggggctgcctctggtgagggtcttctcgaagcatcataatatgctggaaggcatcacaacatggtggaagggatcacgtggcaaaagagcatgtacatgggagtgagagaaaaagagagagagagacagagtggcgggggccggggaggagcgcaaactcatcctttataaagacaccactcctgagataacaatccaatcccatgataatgacattaatccattcaagaagatagagctctcgtgacttaatcaccttctaaagatctcacctgacaacactgttgcattggcagttaagtttccacgtaaactttcggggacacattcaaaccacaggagaaactcaaattgttcctgggcaaatcacaacatggggaattttattcataaatgtccacagaaacagtaaatgttctcgcttcagaacttaattcatctaatccctcctgtttgtctcaaattataggataactttgaaactttctgaattaacgttatttaaaaggaaatgtagatgttattttagtctctatcttcaggttattatcacttaaaaacctgcgaaagctgtcaacttttgtggttgtagcaagtattaataaatatttataaatcctctaatgtaagtctagctacctatccaatactaaataccccttaaagtattaaatgcactatctgctgtaaacggaaaaaaaaaaaaaaaaaaaaaaaaa

SEQ ID NO: 55740 - DNA, 1963 bp, Homo sapiens
cgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacacagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcaggctttgcatctgtggctcaagaagaaacagaaattttgactgctgacatggatgcagaaagaagacggataaaatcattattacctaaactatcttgtggagttaaaaacagaatgcacattcgaaggaaacgaattgtgggaggaaagcgagcacaactgggagacctcccatggcaggtggcaattaaggatgccagtggaatcacctgtgggggaatttatattggtggctgttggattctgactgctgcacattgtctcagagccagtaaaactcatcgttaccaaatatggacaacagtagtagactggatacaccccgaccttaaacgtatagtaattgaatacgtggatagaattattttccatgaaaactacaatgcaggcacttaccaaaatgacatcgctttgattgaaatgaaaaaagacggaaacaaaaaagattgtgagctgcctcgttccatccctgcctgtgtcccctggtctccttacctattccaacctaatgatacatgcatcgtttctggctggggacgagaaaaagataacgaaagagtcttttcacttcagtggggtgaagttaaactaataagcaactgctctaagttttacggaaatcgtttctatgaaaaagaaatggaatgtgcaggtacatatgatggttccatcgatgcctgtaaaggggactctggaggccccttagtctgtatggatgccaacaatgtgacttatgtctggggtgttgtgagttggggggaaaactgtggaaaaccagagttcccaggtttttacaccaaagtggccaattattttgactggattagctaccatgtaggaaggccttttatttctcagtacaatgtataaaattgtgatctctctcttcattctattctttttctctcaagagttccatttaatggaaataaaacggtataattaataattctctaggggggaaaaatgaagcaaatctcattggatatttttaaaggtctccacagagtttatgccatattggaattttgttgtataattctcaaataaatattttggtgaagcat

SEQ ID NO: 55741 - DNA, 5540 bp, Homo sapiens
tcccagccggctgaggcgggcagggccgggcggggccgcgccacggagcccacagcccggcgctccctgccgcgccgccgccgcaccgcgccccacaggagaagacgaaccgggcccggcggccgaagcggcccgcgaggcgcgggaggcatgaagttgggcgcgcacgggcctcgaagcggcggggagccgggagccgcccgcatctagagcccgcgaggtgcgtgcgccatggagctagggggccccggagcgccgcggctgctgccgccgctgctgctgcttctggggaccggcctcctgcgcgccagcagccatgtggagacccgggcccacgccgaggagcggctcctgaagaaactcttctccggttacaacaagtggtcccgacccgtggccaacatctcggacgtggtcctcgtccgcttcggcctgtccatcgctcagctcattgacgtggatgagaagaaccagatgatgaccacgaacgtatgggtgaagcaggagtggcacgactacaagctgcgctgggacccagctgactatgagaatgtcacctccatccgcatcccctccgagctcatctggcggccggacatcgtcctctacaacaatgctgacggggacttcgcggtcacccacctgaccaaggcccacctgttccatgacgggcgggtgcagtggactcccccggccatttacaagagctcctgcagcatcgacgtcaccttcttccccttcgaccagcagaactgcaccatgaaattcggctcctggacctacgacaaggccaagatcgacctggtgaacatgcacagccgcgtggaccagctggacttctgggagagtggcgagtgggtcatcgtggatgccgtgggcacctacaacaccaggaagtacgagtgctgtgccgagatctacccggacatcacctatgccttcgtcatccggcggctgccgctcttctacaccatcaacctcatcatcccctgcctgctcatctcctgcctcaccgtgctggtcttctacctgccctccgagtgtggcgagaagatcacgctgtgcatctccgtgctgctgtcgctcaccgtcttcctgctgctcatcaccgagatcatcccgtccacctcactggtcatcccactcatcggcgagtacctgctgttcaccatgatcttcgtcaccctgtccatcgtcatcacggtcttcgtgctcaacgtgcaccaccgctcgccacgcacgcacaccatgcccacctgggtacgcagggtcttcctggacatcgtgccacgcctgctcctcatgaagcggccgtccgtggtcaaggacaattgccggcggctcatcgagtccatgcataagatggccagtgccccgcgcttctggcccgagccagaaggggagccccctgccacgagcggcacccagagcctgcacccgccctcaccgtccttctgtgtccccctggatgtgccggctgagcctgggccttcctgcaagtcaccctccgaccagctccctcctcagcagcccctggaagctgagaaagccagcccccacccctcgcctggaccctgccgcccgccccacggcacccaggcaccagggctggccaaagccaggtccctcagcgtccagcacatgtccagccctggcgaagcggtggaaggcggcgtccggtgccggtctcggagcatccagtactgtgttccccgagacgatgccgcccccgaggcagatggccaggctgccggcgccctggcctctcgcaacacccactcggctgagctcccacccccagaccagccctctccgtgcaaatgcacatgcaagaaggagccctcttcggtgtccccgagcgccacggtcaagacccgcagcaccaaagcgccgcccccgcacctgcccctgtcgccggccctgacccgggcggtggagggcgtccagtacattgcagaccacctgaaggccgaagacacagacttctcggtgaaggaggactggaagtacgtggccatggtcatcgaccgcatcttcctctggatgttcatcatcgtctgcctgctggggacggtgggcctcttcctgccgccctggctggctggcatgatctaggaagggaccgggagcctgcgtggcctggggctgccgtgcacggggccagcatccatgcggccggcctggggccgggctggcttctccctggactctgtggggccacacgtttgccaaattttccttcctgttctgtgtctgctgtaagacggccttggacggggacacggcctctggggagaccgagtgtggagctgcttccagttggactgtggcctcaggaggcagtggcttggagcagaggtgggggtcggcgccttctacctgcaggactcgggctaagtccagttcaagagtctcctgagctcccctgcagatggaactcactcctcccagtctctcagcagatctggtgatggtcccgaccgccccaaggggcccttgaagggagttcacgccccttcagccccaagcgccccgtcttctggaggcccggccgcctctcccacccaccgtgtcctgcgcctgtgtgggcttcaacttctcccccagggtccttgagcctctcgggccccatgagggtgagccagcagggctccaatctgcttcgctaggagagggtccaggcagggattgtgtttggttgtgttttgggtaagttagtgagaactcaagtcttgtgcctaaggagccttggagaacagagttttgtggagctggttccgcgtggggagaatcgggaggcccacgcgggaccagctctcccctgcgcaggccctccgcgggggacaggaacacccagccccagcgagtctggagaccaggactctgccttccaggcgtagggccagggctctggcaggtggccagggctccacgggggcctagtggcttcagcccctggggtacttctgtgttgtgattccccggagctgggaaggtcccgaatggagtccagacctgggccctggttcccccaggaccctgagggtttccaccttggcgcgcagcccgggagatccgccctgggctctgggttcgggaagaaggacttcctgctacagtagctgtggggagctggtgggggcatccttgaggacctccacctgggagatgctgggaccctcggggcaggaagtccctgagaagcctcatgggagtcagggagccctggggtttccacacaggcccatgccctccgtcctggcagggcaggcagagctcagcacagcctcacccctgcaggcggtatccagaggtgagggaggcctgaaatgtttccaggcatgaccctggagcccggcagtgcaccccctaaagatggcgcacccggcagccccccagtgtccccaggggcacacttccccttgggatgggcacaggctgccccacccctccatgattccaagggcccagaggggcggggccaggatggcgtgtcccctgcctgtgagtgacatcggttcaggaggagacagtcaggaagcctcctgctgagtggtccacattctgctgcccccagaccccatccagccaggggtggggatggggttgggctctgcgtcccactgagtctcattcctctgtccccgagccgagctctcctgggccagggtctcgtcaggaggtgcctgagagcagaatgaataattgaggttaggaacccggcatgccgagtgccccagaaatgccgctgtgtccccgcgggcagtgacgtgagtggggaggagactcaggcccacattgcccacacctgcctctgaactgctgctggtcacccccacccccgggtgcctgtgaccggggtcctgaggctggggcttttgtgccaggagtgggtgggacacagagacccccgtgccaaatcctgggcatccccagccccctggcccctcccacatcccccgtgtattcaggaccccatctgctgagctctgacctgcccccgctctgccatcagcccctgctgctcctcggccagagctcccaggacgcagggagaccctgggagagtgaggtcatcccggggccatggaagctggcaggagacactggtctcagaggagggatagagacgcagatttcagatgtaagaagcccgatccacattgcataagtggacccagctgccagatgtgtgggcagctgcagggagtggcccggggtgctgggcccagctgtggttgttcttttctgggtcaggagtgactgcggagtggctgggacgctcctgccgggggaccctcctgccgggggtggccgcttgcctgggggaagacccctttccctttctttttttttttgaggctcaaaaaaaaaatccaaataaagcaccatattcccaccacgccaaattaaccttgacaacaatgttggcgtatttgcgtccagtgctgtttttattaattaaggtaaaatttacatatggtgagatgcatgctcttcagtggagacccagcccctagaaggtccctccagcccttcctgtcggcgtccctccccatctgtggctctgacttaagcaccgtggattgacctctccggctcacgaccttcgaggagtcagaatcctgcagttggagcctttgatgtctggcttcttcatcctatgacttagagcttcatccgtgctgttgtgtgtgtccgtagctccttgctgtctgttccttcgtttttaattgtgagcagtgttcttctgtctgaataaactaagacgcagtttgtccatcacctgttagtggactttgcttgcagctgtcggtgattaggaatggaggtgccggtgtgtgcatggcactctatccgttatgcatgtttattttctgcatctgttaatgttttaacatctttcagacccaggactgctcctcctagggccagttagttcccgggggtggacagcttgcctagaacccaccttgccagggctgtgacccccgaccccctatcaaagtctcacactaagccaacgtttccccgccctgtgccaggcaccaggcagcgggagacactgctgcagctcgaagcctgccggggcgccggcccctctgcggctgcttgcgccatcctgccccctccttcccaggggaggccccagtgaaggccctggccagggcttcccagccccttctgcctccggaccggcctgggtgcttcccgtgtggcccggcctggggcgacgtggccctcctctcaggaagcgtggtaatctctcaatggctggcctccggagttgtcactcaggctcccttgtaagttaaggccgggcccaggacactctagggcacgcagctgctgtgggactgctgggttaggtgtcccctggagcagaggcggcttcggatttctaaagtggctgagtcctttcaccttgcaccagaaatgctggatcaggcgcagcacacacagcacctggggatgcaagcccggccagccccatggaccaagccccgccgaccgtgtggcccgccgagcccaggtgcggc

SEQ ID NO: 55742 - DNA, 1233 bp, Homo sapiens
gtttgcttcaccttctgccaggattgtaagtttcctgaggcctccccagtcctgcggaactggctccggctggcacctgaggagcggcgtgaccccgagggcccagggagctgcccggctggcctaggcaggcagccgcaccatggccagcacggccgtgcagcttctgggcttcctgctcagcttcctgggcatggtgggcacgttgatcaccaccatcctgccgcactggcggaggacagcgcacgtgggcaccaacatcctcacggccgtgtcctacctgaaagggctctggatggagtgtgtgtggcacagcacaggcatctaccagtgccagatctaccgatccctgctggcgctgccccaagacctccaggctgcccgcgccctcatggtcatctcctgcctgctctcgggcatagcctgcgcctgcgccgtcatcgggatgaagtgcacgcgctgcgccaagggcacacccgccaagaccacctttgccatcctcggcggcaccctcttcatcctggccggcctcctgtgcatggtggccgtctcctggaccaccaacgacgtggtgcagaacttctacaacccgctgctgcccagcggcatgaagtttgagattggccaggccctgtacctgggcttcatctcctcgtccctctcgctcattggtggcaccctgctttgcctgtcctgccaggacgaggcaccctacaggccctaccaggccccgcccagggccaccacgaccactgcaaacaccgcacctgcctaccagccaccagctgcctacaaagacaatcgggccccctcagtgacctcggccacgcacagcgggtacaggctgaacgactacgtgtgagtccccacagcctgcttctcccctgggctgctgtgggctgggtccccggcgggactgtcaatggaggcaggggttccagcacaaagtttacttctgggcaatttttgtatccaaggaaataatgtgaatgcgaggaaatgtctttagagcacagggacagagggggaaataagaggaggagaaagctctctataccaaagactgaaaaaaaaaatcctgtctgtttttgtatttattatatatatttatgtgggtgatttgataacaagtttaatataaagtgacttgggagtttggtcagtggggttggtttgtgatccaggaataaaccttgcggatgtggctgtttatgaaaaaaaaaaaaaaaaaaa

SEQ ID NO: 55743 - DNA, 1942 bp, Homo sapiens
cgccaggtggtggctcagaggaggacacagtcgctgtgggcaggtggtcagggcgcaggagggaatgagctgtggatttttagtaatctacaacaatcaggcagttccaggacacagggaagtgagtgtgaacagccaatggacccggagccgagagcctgggcaggcgtaggctggactatggacgccctgcaaccctgccaggctgggaaggggaggcttgatcctgagcgcgtgttaggaaggagatgcccaggttcaggtgtatcgtgcattttttttccacagtgcagaaatgacatttctggttggtcttgaatgtctgctctggccaagccacctcctctcatgctagctaaccaagtggcacgtgtgcccacgcaggccgttctaaggaacactgtaattgtctacacaattttctctcaaatactccgtcctggaagcgtctggttggcagaagagggaaggcaggagggtggcagcgtcccggctgagtcctcttgcacatgggagctggagtccagccaggctccagagcggctccggctggcaagggacctgaacaggaagatgagactcgaggttttctgcatgcctggaagtgcacatgctcatctacagctttcttggaagaagaaagaaacaaaaactgagatttagaacaccaggtctgtttccactggcggccactcttgggcactggagaccagcaagagctttgtttttaaaaggctcttccatggcagatattcgcagaggcatcagggctacacttaaatgaagggctccggctggcacctgaggagcggcgtgaccccgagggcccagggagctgcccggctggcctaggcaggcagccgcaccatggccagcacggccgtgcagcttctgggcttcctgctcagcttcctgggcatggtgggcacgttgatcaccaccatcctgccgcactggcggaggacagcgcacgtgggcaccaacatcctcacggccgtgtcctacctgaaagggctctggatggagtgtgtgtggcacagcacaggcatctaccagtgccagatctaccgatccctgctggcgctgccccaagacctccaggctgcccgcgccctcatggtcatctcctgcctgctctcgggcatagcctgcgcctgcgccgtcatcgggatgaagtgcacgcgctgcgccaagggcacacccgccaagaccacctttgccatcctcggcggcaccctcttcatcctggccggcctcctgtgcatggtggccgtctcctggaccaccaacgacgtggtgcagaacttctacaacccgctgctgcccagcggcatgaagtttgagattggccaggccctgtacctgggcttcatctcctcgtccctctcgctcattggtggcaccctgctttgcctgtcctgccaggacgaggcaccctacaggccctaccaggccccgcccagggccaccacgaccactgcaaacaccgcacctgcctaccagccaccagctgcctacaaagacaatcgggccccctcagtgacctcggccacgcacagcgggtacaggctgaacgactacgtgtgagtccccacagcctgcttctcccctgggctgctgtgggctgggtccccggcgggactgtcaatggaggcaggggttccagcacaaagtttacttctgggcaatttttgtatccaaggaaataatgtgaatgcgaggaaatgtctttagagcacagggacagagggggaaataagaggaggagaaagctctctataccaaagactgaaaaaaaaaatcctgtctgtttttgtatttattatatatatttatgtgggtgatttgataacaagtttaatataaagtgacttgggagtttggtcagtggggttggtttgtgatccaggaataaaccttgcggatgtggctgtttatgaaa

SEQ ID NO: 55744 - DNA, 1686 bp, Homo sapiens
aagcaggaggttttatttaaaataaagctgtttatttggcatttctgggagacccttttctgaggaaccacagcaatgaatggctttgcatccttgcttcgaagaaaccaatttatcctcctggtactatttcttttgcaaattcagagtctgggtctggatattgatagccgtcctaccgctgaagtctgtgccacacacacaatttcaccaggacccaaaggagatgatggtgaaaaaggagatccaggagaagagggaaagcatggcaaagtgggacgcatggggccgaaaggaattaaaggagaactgggtgatatgggagatcggggcaatattggcaagactgggcccattgggaagaagggtgacaaaggggaaaaaggtttgcttggaatacctggagaaaaaggcaaagcaggtactgtctgtgattgtggaagataccggaaatttgttggacaactggatattagtattgcccggctcaagacatctatgaagtttgtcaagaatgtgatagcagggattagggaaactgaagagaaattctactacatcgtgcaggaagagaagaactacagggaatccctaacccactgcaggattcggggtggaatgctagccatgcccaaggatgaagctgccaacacactcatcgctgactatgttgccaagagtggcttctttcgggtgttcattggcgtgaatgaccttgaaagggagggacagtacatgttcacagacaacactccactgcagaactatagcaactggaatgagggggaacccagcgacccctatggtcatgaggactgtgtggagatgctgagctctggcagatggaatgacacagagtgccatcttaccatgtactttgtctgtgagttcatcaagaagaaaaagtaacttccctcatcctacgtatttgctattttcctgtgaccgtcattacagttattgttatccatcctttttttcctgattgtactacatttgatctgagtcaacatagctagaaaatgctaaactgaggtatggagcctccatcatcatgctcttttgtgatgattttcatattttcacacatggtatgttattgacccaataactcgccaggttacatgggtcttgagagagaattttaattactaattgtgcacgagatagttggttgtctatatgtcaaatgagttgttctcttggtatttgctctaccatctctccctagagcactctgtgtctatcccagtggataatttcccagtttactggtgatgattaggaaggttgttgatggttaggctaacctgccctggcccaaagccagacatgtacaagggctttctgtgagcaatgataagatctttgaatccaagatgcccagatgttttaccagtcacaccctatggccatggctatacttggaagttctccttgttggcacagacatagaaatgctttaaccccaagcctttatatgggggacttctagctttgtgtcttgtttcagaccatgtggaatgataaatactctttttgtgcttctgatctatcgatttcactaacatataccaagtaggtgctttgaacccctttctgtaggctcacaccttaatctcaggcccctatatagtcacactttgatttaagaaaaatggagctcttgaaatcaaaagaaaaaaa

SEQ ID NO: 55745 - DNA, 3321 bp, Homo sapiens
atgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaagctggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagagactggagcat

SEQ ID NO: 55746 - DNA, 1723 bp, Homo sapiens
gttgtacagaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagtgtcttgctggcagacgtggaagatcttattcaacagcagatttccaacgacacagtcagcccccgagcctccgcatcgtactatgaacagtatcactcactaaatgaaatctattcttggatagaatttataactgagaggcatcctgatatgcttacaaaaatccacattggatcctcatttgagaagtacccactctatgttttaaaggtttctggaaaagaacaaacagccaaaaatgccatatggattgactgtggaatccatgccagagaatggatctctcctgctttctgcttgtggttcataggccatataactcaattctatgggataatagggcaatataccaatctcctgaggcttgtggatttctatgttatgccggtggttaatgtggacggttatgactactcatggaaaaagaatcgaatgtggagaaagaaccgttctttctatgcgaacaatcattgcatcggaacagacctgaataggaactttgcttccaaacactggtgtgaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactgtctctagtagccagtgaagcagttcgtgctattgagaaaactagtaaaaataccaggtatacacatggccatggctcagaaaccttatacctagctcctggaggtggggacgattggatctatgatttgggcatcaaatattcgtttacaattgaacttcgagatacgggcacatacggattcttgctgccggagcgttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcagattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaactttcgacgtttgactagccatctcaagcaagtttaatcaaagatcatctcacgctgatcattggatcctactcaacaaaaggaagggtggtcagaagtacattaaagatttctgctccaaattttcaataaatttctgcttgtgcctttagaaataca

SEQ ID NO: 55747 - DNA, 1560 bp, Homo sapiens
gttgtacagaaaattgctgttgggatgaagctttgcagccttgcagtccttgtacccattgttctcttctgtgagcagcatgtcttcgcgtttcagagtggccaagttctagctgctcttcctagaacctctaggcaagttcaagttctacagaatcttactacaacatatgagattgttctctggcagccggtaacagctgaccttattgtgaagaaaaaacaagtccatttttttgtaaatgcatctgatgtcgacaatgtgaaagcccatttaaatgtgagcggaattccatgcagtgtcttgctggcagatgtggaagatcttattcaacagcagatttccaacgacacagtcagcccccgagcctccgcatcgtactatgaacagtatcactcactaaatgaaatctattcttggatagaatttataactgagaggcatcctgatatgcttacaaaaatccacattggatcctcatttgagaagtacccactctatgttttaaaggtttctggaaaagaacaagcagccaaaaatgccatatggattgactgtggaatccatgccagagaatggatctctcctgctttctgcttgtggttcataggccataatcgaatgtggagaaagaaccgttctttctatgcgaacaatcattgcatcggaacagacctgaataggaactttgcttccaaacactggtgtgaggaaggtgcatccagttcctcatgctcggaaacctactgtggactttatcctgagtcagaaccagaagtgaaggcagtggctagtttcttgagaagaaatatcaaccagattaaagcatacatcagcatgcattcatactcccagcatatagtgtttccatattcctatacacgaagtaaaagcaaagaccatgaggaactgtctctagtagccagtgaagcagttcgtgctattgagaaaattagtaaaaataccaggtatacacatggccatggctcagaaaccttatacctagctcctggaggtggggacgattggatctatgatttgggcatcaaatattcgtttacatcaaacccacctgtagagaagcttttgccgctgtctctaaaatagcttggcatgtcattaggaatgtttaatgcccctgattttatcattctgcttccgtattttaatttactgattccagcaagaccaaatcattgtatcagattatttttaagttttatccgtagttttgataaaagattttcctattccttggttctgtcagagaacctaataagtgctactttgccattaaggcagactagggttcatgtctttttaccctttaaaaaaaattgtaaaagtctagttacctactttttctttgattttcgacgtttgactagccatctcaagcaactttcgacgtttgactagccatctcaagcaagtttaatcaaagatcatctcacgctgatcattggatcctactcaacaaaaggaagggtggtcagaagtacattaaagatttctgctccaaattttcaataaatttctgcttgtgcctttagaaataca

SEQ ID NO: 55748 - DNA, 1702 bp, Homo sapiens
tgaaagggagtgagggaggagagatgagtggctattccagaacgacataaagaatttccagccttggacggacagctgggaacgtcttccaatttggactggtgtttacaagcgggaagctaggtggaccttggattttggcgggtgaagaggctaggttgtttaaggaggtggggcgcgtttcagtggctctctttgaaaaagcccagcaagatgtcagacctgctctcagtcttcctccacctcctccttctcttcaagttggttgccccggtgacctttcgccaccaccgctatgatgatcttgtgcggacgctgtacaaggtgcaaaacgaatgccccggcatcacgcgggtctacagcattgggcgcagcgtggaggggagacacctctacgtgctggagttcagcgaccaccctggaatccacgagcccttggaaccagaggtcaagtatgtggggaacatgcacggcaacgaagcgttgggccgcgagctgatgctgcagctgtcggagtttctgtgcgaggagttccggaacaggaaccagcgcatcgtccagctcatccaggacacgcgcattcacatcctgccatccatgaaccccgacggctacgaggtggctgctgcccagggcccaaacaagcctgggtatctagttggcaggaacaatgcaaatggagtggacctgaaccgcaacttccctgatctcaatacctatatctactataacgagaagtacggaggccccaaccaccacctgccccttccagacaactggaaaagtcaggtggaacccgagacccgggcggtgatccggtggatgcactccttcaactttgttctttcagccaatctccacggaggggcggtggtggccaattacccgtatgacaagtcctttgagcaccgggtccgaggggtccgccgcaccgccagcacccccacgcctgacgacaagctcttccagaagctggccaaggtctactcctatgcacatggatggatgttccaaggttggaactgcggagattacttcccagatggcatcaccaatggggcttcctggtattctctcagcaagggaatgcaagactttaattatctccataccaactgctttgagatcacgctggaactgagttgcgacaagtttccccccgaagaggagttacagcgggagtggctgggtaatcgggaagccctaatccagttcctggaacaggttcaccagggcatcaagggaatggtgcttgatgagaattacaataatctcgccaatgctgtcatttctgtcagtgggattaaccatgatgtcacttcaggtgaccatggtgattacttccggctgctgcttccaggtatctacactgttagtgccacagcacctgggtatgacccagagacagtaactgtgaccgtgggtcctgcggaaccaacgttggttaacttccacctcaaaagaagcatccctcaagtaagccctgtgaggagagctcccagcagaaggcacggagtcagagccaaagtgcagccccaagccagaaagaaagaaatggagatgaggcagctgcagagaggccctgcctgaaacccacagtgccaggcaacccttcagaaaggctttgctcctgctctcagatcagatcaagcattctttctattttattatctgggacatatttaaatacaaacatattcag

SEQ ID NO: 55749 - DNA, 3016 bp, Homo sapiens
agctgaccacaggccacaccagactcctctctgctcctgaggaagacagggcagcccggcgccacccgctcggccctcacgaagatgctccctggagcctggctgctctggacctccctcctgctcctggccaggcctgcccagccctgtcccatgggttgtgactgcttcgtccaggaggtgttctgctcagatgaggagcttgccaccgtcccgctggacatcccgccatatacgaaaaacatcatctttgtggagacctcgttcaccacattggaaaccagagcttttggcagtaaccccaacttgaccaaggtggtcttcctcaacactcagctctgccagtttaggccggatgcctttggggggctgcccaggctggaggacctggaggtcacaggcagtagcttcttgaacctcagcaccaacatcttctccaacctgacctcgctgggcaagctcaccctcaacttcaacatgctggaggctctgcccgagggtcttttccagcacctggctgccctggagtccctccacctgcaggggaaccagctccaggccctgcccaggaggctcttccagcctctgacccatctgaagacactcaacctggcccagaacctcctggcccagctcccggaggagctgttccacccactcaccagcctgcagaccctgaagctgagcaacaacgcgctctctggtctcccccagggtgtgtttggcaaactgggcagcctgcaggagctcttcctggacagcaacaacatctcggagctgccccctcaggtgttctcccagctcttctgcctagagaggctgtggctgcaacgcaacgccatcacgcacctgccgctctccatctttgcctccctgggtaatctgacctttctgagcttgcagtggaacatgcttcgggtcctgcctgccggcctctttgcccacaccccatgcctggttggcctgtctctgacccataaccagctggagactgtcgctgagggcacctttgcccacctgtccaacctgcgttccctcatgctctcatacaatgccattacccacctcccagctggcatcttcagagacctggaggagttggtcaaactctacctgggcagcaacaaccttacggcgctgcacccagccctcttccagaacctgtccaagctggagctgctcagcctctccaagaaccagctgaccacacttccggagggcatcttcgacaccaactacaacctgttcaacctggccctgcacggtaacccctggcagtgcgactgccacctggcctacctcttcaactggctgcagcagtacaccgatcggctcctgaacatccagacctactgcgctggccctgcctacctcaaaggccaggtggtgcccgccttgaatgagaagcagctggtgtgtcccgtcacccgggaccacttgggcttccaggtcacgtggccggacgaaagcaaggcagggggcagctgggatctggctgtgcaggaaagggcagcccggagccagtgcacctacagcaaccccgagggcaccgtggtgctcgcctgtgaccaggcccagtgtcgctggctgaacgtccagctctctccttggcagggctccctgggactgcagtacaatgctagtcaggagtgggacctgaggtcgagctgcggttctctgcggctcaccgtgtctatcgaggctcgggcagcagggccctagtagcagcgcatacaggagctggggaagggggcctctggggcctgaccaggcgacaggtaggggcggaggggagctgagtctccgaagccttggcttttcacatgcaagggacagggttacatccccaaggtgagggggtggagtctggtctgctccactaaccagggtctcctcctcctcttccttcatcgcttctcctggagtgtgcggcctaacaaggccatccttatgctttgcaaagcaccctcaaaagctgcaccacagcctggagaataaaatatcctcagccctgatgcctccccattatgtaacacccaaccgctctcacctacaccctgaggtctattcactgcatcccagtgatacaaagtggaggccactgccttctgacatctggctcaaaagcccagtgtctgtttccatttatttccctggaatttcatttaaaattggtatagagaaaaaaaggatgtgacagaagcagagatgaccagaaagcacaggggcagggttctgactggcgtgtgggagaccctgtggccggcacccacctccacacgaggactaagctctgatttttttatcttgcccaaattcctacctaaggggtctagggagtcgcgccttacaaatcataaattctcatcagatgggttttatttgaccctgtatatcatgacttatttttaatctgactatggcataacattacaagacgaggcaaaaatatttaacccccaaatatatttctttgccctaccttgaacttgccctgcagagtctcttgtgaggagaatccacatcctataaagaagcccctttcccctttgttttccttcctttctttccagtccaggagatcatcaactaagagccaggcaccccttttaagtcgataagaaacagtttacaacctgctctctctctctctgaagtctgctgagagcttcccctgcacaataaaacttggcctccacaatcctttatcttaacctgaacattcctttccattgatcccaggtcttcagctaagctcaaccaattgtcaaccagaaaatgtttaaatttacctacagcctggaagcactcacccccgctgcttcgagttgtcctgcctttctgaactcaaccaatgtatttcttaaatgtatttgattgatgcctcattcctccctaaaatgtataaaaccaagctgtacctcgaccaccttgggcacatgttcccaggccctcctgaggtctgtgtcacgggccatggccactcatatttggctcagaataaatctcttcaaat

SEQ ID NO: 55750 - DNA, 3016 bp, Homo sapiens
agctgaccacaggccacaccagactcctctctgctcctgaggaagacagggcagcccggcgccacccgctcggccctcacgaagatgctccctggagcctggctgctctggacctccctcctgctcctggccaggcctgcccagccctgtcccatgggttgtgactgcttcgtccaggaggtgttctgctcagatgaggagcttgccaccgtcccgctggacatcccgccatatacgaaaaacatcatctttgtggagacctcgttcaccacattggaaaccagagcttttggcagtaaccccaacttgaccaaggtggtcttcctcaacactcagctctgccagtttaggccggatgcctttggggggctgcccaggctggaggacctggaggtcacaggcagtagcttcttgaacctcagcaccaacatcttctccaacctgacctcgctgggcaagctcaccctcaacttcaacatgctggaggctctgcccgagggtcttttccagcacctggctgccctggagtccctccacctgcaggggaaccagctccaggccctgcccaggaggctcttccagcctctgacccatctgaagacactcaacctggcccagaacctcctggcccagctcccggaggagctgttccacccactcaccagcctgcagaccctgaagctgagcaacaacgcgctctctggtctcccccagggtgtgtttggcaaactgggcagcctgcaggagctcttcctggacagcaacaacatctcggagctgccccctcaggtgttctcccagctcttctgcctagagaggctgtggctgcaacgcaacgccatcacgcacctgccgctctccatctttgcctccctgggtaatctgacctttctgagcttgcagtggaacatgcttcgggtcctgcctgccggcctctttgcccacaccccatgcctggttggcctgtctctgacccataaccagctggagactgtcgctgagggcacctttgcccacctgtccaacctgcgttccctcatgctctcatacaatgccattacccacctcccagctggcatcttcagagacctggaggagttggtcaaactctacctgggcagcaacaaccttacggcgctgcacccagccctcttccagaacctgtccaagctggagctgctcagcctctccaagaaccagctgaccacacttccggagggcatcttcgacaccaactacaacctgttcaacctggccctgcacggtaacccctggcagtgcgactgccacctggcctacctcttcaactggctgcagcagtacaccgatcggctcctgaacatccagacctactgcgctggccctgcctacctcaaaggccaggtggtgcccgccttgaatgagaagcagctggtgtgtcccgtcacccgggaccacttgggcttccaggtcacgtggccggacgaaagcaaggcagggggcagctgggatctggctgtgcaggaaagggcagcccggagccagtgcacctacagcaaccccgagggcaccgtggtgctcgcctgtgaccaggcccagtgtcgctggctgaacgtccagctctctcctcggcagggctccctgggactgcagtacaatgctagtcaggagtgggacctgaggtcgagctgcggttctctgcggctcaccgtgtctatcgaggctcgggcagcagggccctagtagcagcgcatacaggagctggggaagggggcctctggggcctgaccaggcgacaggtaggggcggaggggagctgagtctccgaagccttggcttttcacatgcaagggacagggttacatccccaaggtgagggggtggagtctggtctgctccactaaccagggtctcctcctcctcttccttcatcgcttctcctggagtgtgcggcctaacaaggccatccttatgccttgcaaagcaccctcaaaagctgcaccacagcctggagaataaaatatcctcagccctgatgcctccccattatgtaacacccaaccgctctcacctacaccctgaggtctattcactgcatcccagtgatacaaagtggaggccactgccttctgacatctggctcaaaagcccagtgtctgtttccatttatttccctggaatttcatttaaaattggtatagagaaaaaaaggatgtgacagaagcagagatgaccagaaagcacaggggcagggttctgactggcgtgtgggagaccctgtggccggcacccacctccacacgaggactaagctctgatttttttatcttgcccaaattcctacctaaggggtctagggagtcgcgccttacaaatcataaattctcatcagatgggttttatttgaccctgtatatcatgacttatttttaatctgactatggcataacattacaagacgaggcaaaaatatttaacccccaaatatatttccttgccctaccttgaacttgccctgcagagtctcttgtgaggagaatccacatcctataaagaagcccctttcccctttgttttccttcctttctttccagtccaggagatcatcaactaagagccaggcaccccttttaagtcgataagaaacagtttacaacctgctctctctctctctgaagtctgctgagagcttcccctgcacaataaaacttggcctccacaatcctttatcttaacctgaacattcctttccattgatcccaggtcttcagctaagctcaaccaattgtcaaccagaaaatgtttaaatttacctacagcctggaagcacccacccccgctgcttcgagttgtcctgcctttctgaactcaaccaatgtatttcttaaatgtatttgattgatgcctcattcctccctaaaatgtataaaaccaagctgtacctcgaccaccttgggcacatgttcccaggccctcctgaggtctgtgtcacgggccatggccactcatatttggctcagaataaatctcttcaaat

SEQ ID NO: 55751 - DNA, 6642 bp, Homo sapiens
gcgtgctgactgagctagtcttggggtcctggagaagggggctggaggcatgcccacagcctcccccccatgagcttggggctggcgggggcacaggaggtggagctgacactagagacggttatccagacactggagagcagcgtcctgtgccaggagaaaggcttgggcgcgcgggacctggcccaggacgctcagatcaccagcctgcctgcccttatcagggagattgtcacccgcaacctctcccagcctgagagcccagtcctgctgccggccacggagatggcatcgctgctgtcgctgcaggaggagaaccagctgctgcagcaggagctgtcccgcgtggaggacctgctggcccagagccgtgccgagcgcgatgagctcgccattaagtacaatgcggtcagcgagaggctggagcaggctctgcggctggagcctggggagctggagacgcaggagcccagggggctggtacggcagagcgtggagttgcggaggcagctgcaggaggagcaggcctcctaccggcgcaagctgcaggcctaccaggagggccagcagcggcaggcccagcttgtgcagcggctgcagggcaagattctccagtacaagaagaggtgctcggagctggagcagcagctgctggagagatccggagagctggagcagcagcggctgagggacacagagcacagccaagacctggaaagcgccctcatccggctggaggaggagcagcagaggagtgccagcctggcccaggtgaatgccatgctccgagaacagctggaccaggcaggctcggccaaccaggctctgagtgaggacatacgaaaggtgaccaatgactggacacgctgccgcaaggagctggagcaccgggaggcggcgtggaggcgcgaggaggagtccttcaacgcctacttcagcaacgagcacagtcgcctgctcctcctctggaggcaggtggtggggttccggcggctggtcagcgaggtgaagatgttcactgagagggacctgctgcagctgggaggggagctggcccggacatcacgagctgtccaggaggcgggcctgggactgagcacgggcctacggctggcagagagccgggccgaggcagccctggagaaacaggccctgctgcaggcccagctggaggagcagctgcgggacaaggtgctccgcgagaaggacctggcgcagcagcagatgcaaagcgacctggacaaggctgacctcagtgccagagtgacagagctgggcctggcagtgaagcgtcttgagaagcagaatctggagaaggatcaggtcaacaaggacctcactgagaagcttgaggccctggaatccctgcggctacaggagcaggcggccctggagacagaggatggagaggggctacagcagaccctaagggacctggcacaggccgtcttgtcagactctgagagcggcgtccagctgagcggctctgagcgcaccgcggatgcttccaacggcagcctgcgggggctctcgggccagcggaccccgtccccaccgcggcgctcctcgcccggccgaggccgttcaccccgccgaggcccctccccggcctgctcagactcctccacgctcgccctgatccactccgccctgcacaagcgccagctgcaggtccaggacatgcgtgggcgctatgaggcaagccaggacctactgggcaccctgcggaagcagcttagcgacagcgagagcgagcggcgggccctagaggaacagctgcagcgcctgcgggacaagaccgacggcgccatgcaggcccacgaggacgcccagcgcgaggtgcagcggctgcggagcgccaacgagctcctgagcagggagaagagcaacctggcccacagcctgcaggtggcccagcagcaggccgaggagctgcggcaggagcgggagaagctgcaggctgcccaggaggagctgcggcgccagcgggaccggctggaggaagagcaggaggacgcagtgcaggatggcgcgcgggtgcgccgggagcttgagcgcagccatagacaactagagcagctggaagggaagcgctcagtcctggccaaggagctggtggaggtgagggaggcgctgagccgcgccacactgcaacgggacatgctgcaggccgagaaggccgaggtggccgaggcgctgaccaaggctgaggctggccgcgtggagctcgagctctccatgaccaagctgagggcagaggaggcctccctgcaggactccctgtccaagctgagcgccctcaacgagagccttgctcaggacaagttggatctgaaccgccttgtcgcccagctggaggaagaaaagtccgccctgcagggccggcaacggcaggcagagcaggaggccacagtggcgcgggaagagcaggaacggctagaggagctgcggttggagcaggaggtggcgcggcagggcctggagggctccctacgagtggcggagcaggcccaggaggcattggagcagcagctccccacgctgcgccatgagcgcagccagctgcaggagcagctagcgcagctctcccggcagctgagcgggcgggagcaggagctggagcaggcccggcgggaggcccagcggcaagtggaggcgctggagcgagcggcccgtgagaaggaggcgctagccaaggagcacgctggcctggctgtgcagctggtggctgcggagcgtgaaggcaggaccctgtcagaggaggccacacgcctgcgcttggagaaggaagccctggagggcagcctgtttgaggtgcaacggcagctggcccagcttgaggcccgccgggagcagctggaagccgaggggcaggccctgctgctggccaaggagaccctgactggggagttggcgggcctgcggcagcaaataatagctacacaggagaaagccagtctagacaaggagctgatggcccagaagctggtgcaggctgagcgggaggcccaggcctctctgcgggagcagcgggcagctcacgaggaggacttacagcgactccagcgtgaaaaggaggcagcatggcgggagctggaggccgagcgggcccagctgcagagtcagctgcagcgtgagcaggaggagctgctggcccggctggaggctgagaaggaagagctgagtgaggagattgctgccctgcagcaggagcgcgacgagggcctcctcctagcagagagtgagaagcagcaggccttgtctctgaaggagtctgagaagacggcgctgtcagagaagttgatgggtacacggcacagcctggccaccatctccctggagatggagcggcagaaacgagatgcccagagccggcaggagcaggaccggagcaccgtgaacgctctgacgtctgagctgcgggacctacgggcccagcgggaggaggctgctgcggcccacgcccaggaggtgaggaggctgcaagagcaggcccgagacctgggcaagcagcgggactcctgtcttcgcgaggcagaagagcttcggacccagctgcgtctgctggaggatgcccgtgacgggctgcggcgggagctgctggaggcccagcgcaagctgcgtgagagccaggagggccgggaggtgcagcgccaggaggcaggcgagctgcgacgcagcctgggcgagggtgccaaggagcgcgaggccctgcggcgttccaatgaggagcttcggtctgctgtgaagaaggcagagagcgagcgcatcagcctgaagcttgccaatgaggacaaggagcagaagctggcactcctagaggaggcacggacagctgtgggcaaggaggccggggagctgcgaactgggctgcaggaggtggagcgctcacggctggaggctcggcgggagctgcaggagctccggcgtcagatgaagatgctggacagtgagaacaccagactgggccgggagctggcggagctgcagggccgcctggcgctgggcgagcgggcagagaaggagagcaggcgggagaccctgggcctccggcagaggctgctgaagggcgaggccagcctggaggtgatgcggcaggagctccaggtagcccagcggaagctgcaggaacaagaaggcgagttccggacccgcgagcgacgcctgctgggctccctggaggaggcgcgtggcactgaaaagcagcagctggaccacgcccgcggcctggagctgaagctggaggcggcgcgggccgaggccgcagagctgggcctgcggctgagcgcagccgagggccgggcacaaggcctggaggccgagctggcccgcgtggaggtgcagcggcgcgcggcggaggcccagctgggtggcctgcgctcggctctgcgccggggcctcggcctcggtcgcgcgcccagcccagccccgcggccagtgcccggttcccctgcccgggacgcacccgcagaaggaagcggggaagggctcaacagccccagcaccttagaatgcagccctgggtcccagccaccatctccaggacctgccacctccccagcctctccagacctggacccggaggcagtgcgcggggccctccgggaattcctgcaagagctgcggagtgcccagagagaacgggacgaacttcggacccagaccagtgccctgaatcgccagctggccgagatggaggctgagagggacagcgcaacctcgagggccaggcagctgcagaaggcggtggctgagagtgaggaagcccggcgcagtgtggatgggcggctgagcggggtccaggcggagctggcgctgcaggaggagagtgtgcggcgcagtgagcgggagcgccgggccacgctggaccaggtggccacactggagaggagcctgcaggccaccgagagcgagctccgggccagccaggagaagatcagcaagatgaaggccaatgagacaaagctggagggcgacaagcggcgcctgaaggaggttctggacgcctccgagagccgcactgtcaagctggagctgcagcggcgctcgcttgagggggagctgcagcgcagccgcctgggcctcagtgaccgcgaggcccaagcccaggccctccaggatcgggtggattccctgcagagacaggtggccgacagcgaggtgaaggcagggaccctgcagctgaccgtggagcggctgaatggggccctggccaaggtggaggaaagcgagggggccctgcgggacaaggtgcggggcctgacagaggccctggcccagagcagtgccagcctcaacagcacccgggacaagaacctgcatctgcagaaggctctgaccgcctgtgaacatgaccgccaagtactccaggaacggctggatgccgcccggcaggcattatctgaggcacggaagcagagcagctccctgggcgagcaggtgcagacgttgcgaggcgaggtggctgacctggaactgcagcgggtggaggccgagggccagctacaacagctacgggaggtgctgcggcagcggcaggagggtgaggctgcagccctgaacaccgtccagaagctgcaagacgagcggcggctgctgcaggagcgcctgggaagcctgcagcgcgccctggctcagctggaagctgagaagcgggaggtggagcgctcagccctgcggctggagaaggaccgtgtagccctcaggaggacgctggacaaggtggagcgggagaagcttcgtagccatgaggacacagtgcggctgagcgcagagaagggccgcctggaccgcaccctcacgggggctgagctggagctggcagaggcgcagaggcagatccagcagctggaggcgcaggtggtggtgctggagcagagccacagcccggcccagctggaggtggatgcgcagcagcagcagctggagctgcagcaggaggtggagcggctgcgcagcgcccaggcgcagactgagcgcaccctggaggctcgggagcgggcccaccgccagagggtgcgtgggctggaggagcaggtgtccacactgaagggccagctgcagcaggagcttcgaaggagctcagcacccttctccccaccctccggccccccagagaaatgagctcctgctggcatctggagaacacccctgtgcctgggacaggggaggacccttcttttggacagcccccccccccagagcccggtcccttgggggcctcaagctggggtgggatgaggaggcgctctgctggcagtgctgaggacgggtactccagctccaggcctggagaggcttcccagcaacacctgcagtccagcccccctcttctaggatgagccactgtagatcattaaagttcctccttgagaggctgagccgtagccaggattggggagagcccttgtctctggtcagccctggagcatgggatcgtgggaaagaggagggggaccaggcccagggcaggggtcagaggcccaggccctgacttcggcttcccagagatctctccgccttagttaagagcatgtgtcgggaaattcctcagagtgctcagagtccctgtatttttatacctttttacaatgttaactgttcagaactgttttttgtaacaaaaccttgtttttaaaaaag

SEQ ID NO: 55752 - DNA, 2024 bp, Homo sapiens
aaggcaagagatctaggacttctagcccctgaactttcagccgaatacatcttttccaaaggagtgaattcaggcccttgtatcactggcagcaggacgtgaccatggagaagctgttgtgtttcttggtcttgaccagcctctctcatgcttttggccagacagacatgtcgaggaaggcttttgtgtttcccaaagagtcggatacttcctatgtatccctcaaagcaccgttaacgaagcctctcaaagccttcactgtgtgcctccacttctacacggaactgtcctcgacccgtgggtacagtattttctcgtatgccaccaagagacaagacaatgagattctcatattttggtctaaggatataggatacagttttacagtgggtgggtctgaaatattattcgaggttcctgaagtcacagtagctccagtacacatttgtacaagctgggagtccgcctcagggatcgtggagttctgggtagatgggaagcccagggtgaggaagagtctgaagaagggatacactgtgggggcagaagcaagcatcatcttggggcaggagcaggattccttcggtgggaactttgaaggaagccagtccctggtgggagacattggaaatgtgaacatgtgggactttgtgctgtcaccagatgagattaacaccatctatcttggcgggcccttcagtcctaatgtcctgaactggcgggcactgaagtatgaagtgcaaggcgaagtgttcaccaaaccccagctgtggccctgaggcccagctgtgggtcctgaaggtacctcccggttttttacaccgcatgggccccacgtctctgtctctggtacctcccgcttttttacactgcatggttcccacgtctctgtctctgggcctttgttcccctatatgcattgcaggcctgctccaccctcctcagcgcctgagaatggaggtaaagtgtctggtctgggagctcgttaactatgctgggaaacggtccaaaagaatcagaatttgaggtgttttgttttcatttttatttcaagttggacagatcttggagataatttcttacctcacatagatgagaaaactaacacccagaaaggagaaatgatgttataaaaaactcataaggcaagagctgagaaggaagcgctgatcttctatttaattccccacccatgacccccagaaagcaggagggcattgcccacattcacagggctcttcagtctcagaatcaggacactggccaggtgtctggtttgggtccagagtgctcatcatcatgtcatagaactgctgggcccaggtctcctgaaatgggaagcccagcaataccacgcagtccctccactttctcaaagcacactggaaaggccattagaattgccccagcagagcagatctgctttttttccagagcaaaatgaagcactaggtataaatatgttgttactgccaagaacttaaatgactggtttttgtttgcttgcagtgctttcttaattttatggctcttctgggaaactcctccccttttccacacgaaccttgtggggctgtgaattctttcttcatccccgcattcccaatatacccaggccacaagagtggacgtgaaccacagggtgtcctgtcagaggagcccatctcccatctccccagctccctatctggaggatagttggatagttacgtgttcctagcaggaccaactacagtcttcccaaggattgagttatggactttgggagtgagacatcttcttgctgctggatttccaagctgagaggacgtgaacctgggaccaccagtagccatcttgtttgccacatggagagagactgtgaggacagaagccaaactggaagtggaggagccaagggattgacaaacaacagagccttgaccacgtggagtctctgaatcagccttgtctggaaccagatctacacctggactgcccaggtctataagccaataaagcccctgtttacttgaaaaaaaaaa

SEQ ID NO: 55753 - DNA, 3127 bp, Homo sapiens
gaagctccacaccagccattacaaccctgccaatctcaagcacctgcctctacagttggtacagatggcattgtcccagtctgttcccttctcggccacagagcttctcctggcctctgccatcttctgcctggtattctgggtgctcaagggtttgaggcctcgggtccccaaaggcctgaaaagtccaccagagccatggggctggcccttgctcgggcatgtgctgaccctggggaagaacccgcacctggcactgtcaaggatgagccagcgctacggggacgtcctgcagatccgcattggctccacgcccgtgctggtgctgagccgcctggacaccatccggcaggccctggtgcggcagggcgacgatttcaagggccggcctgacctctacacctccaccctcatcactgatggccagagcttgaccttcagcacagactctggaccggtgtgggctgcccgccggcgcctggcccagaatgccctcaacaccttctccatcgcctctgacccagcttcctcatcctcctgctacctggaggagcatgtgagcaaggaggctaaggccctgatcagcaggttgcaggagctgatggcagggcctgggcacttcgacccttacaatcaggtggtggtgtcagtggccaacgtcattggtgccatgtgcttcggacagcacttccctgagagtagcgatgagatgctcagcctcgtgaagaacactcatgagttcgtggagactgcctcctccgggaaccccctggacttcttccccatccttcgctacctgcctaaccctgccctgcagaggttcaaggccttcaaccagaggttcctgtggttcctgcagaaaacagtccaggagcactatcaggactttgacaagaacagtgtccgggacatcacgggtgccctgttcaagcacagcaagaaggggcctagagccagcggcaacctcatcccacaggagaagattgtcaaccttgtcaatgacatctttggagcaggatttgacacagtcaccacagccatctcctggagcctcatgtaccttgtgaccaagcctgagatacagaggaagatccagaaggagctggacactgtgattggcagggagcggcggccccggctctctgacagaccccagctgccctacttggaggccttcatcctggagaccttccgacactcctccttcttgcccttcaccatcccccacagcacaacaagggacacaacgctgaatggcttctacatccccaagaaatgctgtgtcttcgtaaaccagtggcaggtcaaccatgacccagagctgtgggaggacccctctgagttccggcctgagcggttcctcaccgccgatggcactgccattaacaagcccttgagtgagaagatgatgctgtttggcatgggcaagcgccggtgtatcggggaagtcctggccaagtgggagatcttcctcttcctggccatcctgctacagcaactggagttcagcgtgccgccgggcgtgaaagtcgacctgacccccatctacgggctgaccatgaagcacgcccgctgtgaacatgtccaggcgcggctgcgcttctccatcaactgaagaagacaccaccattctgaggccagggagcgagtgggggccagccacggggactcagcccttgtttctcttcctttctttttttaaaaaatagcagctttagccaagtgcagggcctgtaatcccagcattttaggaggccaaggttggaggatcatttgagcccaggaattggaaagcagcctggccaacatagtgggaccctgtctctacaaaaaaaaaatttgccaagagcctgagtgacagagcaagaccccatctcaaaaaaaaaaacaaacaaacaaaaaaaaaaccatatatatacatatatatatagcagctttatggagatataattcttatgccatataattcaccttctttttttttttttgtctgagacagaatctcagtctgtcacccaggttggagtgcagtggcgtgatctcagctcactgcaacctccacctcgcaggttcaagcaatcctcccacttcagcctcccaagcacctgggattacaagcatgagtcactacgcctggctgatttttgtagttttagtggagatggggtttcaccatgttggccaggcttgtctcgaactcctgaccccaagttatccacctgccttggcttcccaaagtcctgggattacaggtgtgagccaccacatccagcctaacttacattcttaaagtgtcgaatgacttctagtgtagaattgtgcaaccatcaccagaattaattttattattcttattatttttgagacagagtcttactctgttgccaggctggagtgcagtggcgcgatctcagctcactacaacctccgcctcccatgttcaagcgattctcctgcctcagcctcccgagtagctgggactataggcatgcgccaccatggccagctaatttttgtatttttagtagagacgaggtttcactgtgttggccaggatggtctccatctcttgacctcgtgatccacccgcctcagcctcccaaagtgctgggattaacaggtatgaaccaccgcgcccagcctttttgttttttttttttttgagacagagtcttcctctgtctcctaagctggagtgcagtggcatcatctcagctcactgcaacctctgcctcccaggttcaagtgcttctccagcctcagcctcccaagtagctgagactacaggcacacaccaccacgcctggctaatttttgtatttttagtagagacgggtttcaccatgttggctagactagtctcaaactcctgacctcaagtgatctgcccgcctcgacctctctcaaagtgctggcattacaggtgtgagccacggtgcccggcccacaattaattttagaacattttcatcacccctaaaagaaaccctgcacccattagcagtccctccacatttccccctagcctgcctcccctgcctcaccagccctggcaactgctaatctactttctgtgtctatggatttgccttctctaaacatttcatataaatggaattacacaatg

SEQ ID NO: 55754 - DNA, 2099 bp, Homo sapiens
gtggcgcgggaggtcgcggcgcgccatggggctcccggcgctgctggccagtgcgctctgcaccttcgtgctgccgctgctgctcttcctggctgcgatcaagctctgggacctgtactgcgtgagcggccgcgaccgcagttgtgccctcccattgccccccgggactatgggcttccccttctttggggaaaccttgcagatggtactgcagcggaggaagttcctgcagatgaagcgcaggaaatacggcttcatctacaagacgcatctgttcgggcggcccaccgtacgggtgatgggcgcggacaatgtgcggcgcatcttgctcggagagcaccggctggtgtcggtccactggccagcgtcggtgcgcaccattctgggatctggctgcctctctaacctgcacgactcctcgcacaagcagcgcaagaaggtgattatgcgggccttcagccgcgaggcactcgaatgctacgtgccggtgatcaccgaggaagtgggcagcagcctggagcagtggctgagctgcggcgagcgcggcctcctggtctaccccgaggtgaagcgcctcatgttccgaatcgccatgcgcatcctactgggctgcgaaccccaactggcgggcgacggggactccgagcagcagcttgtggaggccttcgaggaaatgacccgcaatctcttctcgctgcccatcgacgtgcccttcagcgggctgtaccggggcatgaaggcgcggaacctcattcacgcgcgcatcgagcagaacattcgcgccaagatctgcgggctgcgggcatccgaggcgggccagggctgcaaagacgcgctgcagctgttgatcgagcactcgtgggagaggggagagcggctggacatgcaggcactaaagcaatcttcaaccgaactcctctttggaggacacgaaaccacggccagtgcagccacatctctgatcacttacctggggctctacccacatgttctccagaaagtgcgagaagagctgaagagtaagggtttactttgcaagagcaatcaagacaacaagttggacatggaaattttggaacaacttaaatacatcgggtgtgttattaaggagacccttcgactgaatcccccagttccaggagggtttcgggttgctctgaagacttttgaattaaatggataccagattcccaagggctggaatgttatctacagtatctgtgatactcatgatgtggcagagatcttcaccaacaaggaagaatttaatcctgaccgattcatgctgcctcacccagaggatgcatccaggttcagcttcattccatttggaggaggccttaggagctgtgtaggcaaagaatttgcaaaaattcttctcaaaatatttacagtggagctggccaggcattgtgactggcagcttctaaatggacctcctacaatgaaaaccagtcccaccgtgtatcctgtggacaatctccctgcaagattcacccatttccatggggaaatctgatgagcttgaatgttcaaacctgagacttattggaagtgtacatatgagtttttaaggagtgttgtgttgactttatatttaatttctaaatgtatattataatatttatgtgttttgactatactaccacaatctttaaatattaaaataatgaatttgtatcatttccaaataaagtaaaatttgaaggtacttttctggtattttaagattcctgttgggtaaaactcaccagtttagtattttcttagtgtatttaaccagattttacaatgcctacctggacttatttgtcatctttgcatctgttttctgtgagaagaaatcttagctgttttttatgttaacagttattagaaaatatatgtctgtgtgtgttattccagacgtatctctgtaaattcttctatagtcacttagattccctatttggaaaattgatccaagttaatttaatttttttttggtttgctgtactttagggaaagatgaacctgaaaaggtaacactgagaactgtcactctaacctctccagcttatctaacatgtcataaacataataaatctgtgttgtccaat

SEQ ID NO: 55755 - DNA, 2246 bp, Homo sapiens
acggcacctggaaatggaaagccagtgaaggctgctttgggccggggcagcgggtgggaccgggcgggagggattccaaagagaccgccgggaaggctagagcttggaattccggctcctcggagtcctggccctcccccaccgccgcctcggagctcagcacaccttggatgggggaggcgggcagctcctagccccgcaccccaggaggcgcgctcggagggaagccgccaccgcgccgcctctgcctcggcgcggaacaaacggttaaagattttgggcagcgcctcgcggggggaggagccaggggcccaatccgcaattaaagatgaactttgggtgaactaattgtctgaccaagcggaggaagttcctgcagatgaagcgcaggaaatacggcttcatctacaagacgcatctgttcgggcggcccaccgtacgggtgatgggcgcggacaatgtgcggcgcatcttgctcggagagcaccggctggtgtcggtccactggccagcgtcggtgcgcaccattctgggatctggctgcctctctaacctgcacgactcctcgcacaagcagcgcaagaaggtgattatgcgggccttcagccgcgaggcactcgaatgctacgtgccggtgatcaccgaggaagtgggcagcagcctggagcagtggctgagctgcggcgagcgcggcctcctggtctaccccgaggtgaagcgcctcatgttccgaatcgccatgcgcatcctactgggctgcgaaccccaactggcgggcgacggggactccgagcagcagcttgtggaggccttcgaggaaatgacccgcaatctcttctcgctgcccatcgacgtgcccttcagcgggctgtaccggggcatgaaggcgcggaacctcattcacgcgcgcatcgagcagaacattcgcgccaagatctgcgggctgcgggcatccgaggcgggccagggctgcaaagacgcgctgcagctgttgatcgagcactcgtgggagaggggagagcggctggacatgcaggcactaaagcaatcttcaaccgaactcctctttggaggacacgaaaccacggccagtgcagccacatctctgatcacttacctggggctctacccacatgttctccagaaagtgcgagaagagctgaagagtaagggtttactttgcaagagcaatcaagacaacaagttggacatggaaattttggaacaacttaaatacatcgggtgtgttattaaggagacccttcgactgaatcccccagttccaggagggtttcgggttgctctgaagacttttgaattaaatggataccagattcccaagggctggaatgttatctacagtatctgtgatactcatgatgtggcagagatcttcaccaacaaggaagaatttaatcctgaccgattcatgctgcctcacccagaggatgcatccaggttcagcttcattccatttggaggaggccttaggagctgtgtaggcaaagaatttgcaaaaattcttctcaaaatatttacagtggagctggccaggcattgtgactggcagcttctaaatggacctcctacaatgaaaaccagtcccaccgtgtatcctgtggacaatctccctgcaagattcacccatttccatggggaaatctgatgagcttgaatgttcaaacctgagacttattggaagtgtacatatgagtttttaaggagtgttgtgttgactttatatttaatttctaaatgtatattataatatttatgtgttttgactatactaccacaatctttaaatattaaaataatgaatttgtatcatttccaaataaagtaaaatttgaaggtacttttctggtattttaagattcctgttgggtaaaactcaccagtttagtattttcttagtgtatttaaccagattttacaatgcctacctggacttatttgtcatctttgcatctgttttctgtgagaagaaatcttagctgttttttatgttaacagttattagaaaatatatgtctgtgtgtgttattccagacgtatctctgtaaattcttctatagtcacttagattccctatttggaaaattgatccaagttaatttaatttttttttggtttgctgtactttagggaaagatgaacctgaaaaggtaacactgagaactgtcactctaacctctccagcttatctaacatgtcataaacataataaatctgtgttgtccaat

SEQ ID NO: 55756 - DNA, 1747 bp, Homo sapiens
actgccaccatgctggcctcagggctgcttctggtgaccttgctggcctgcctgactgtgatggtcttgatgtcagtctggcggcagaggaagagcagggggaagctgcctccgggacccaccccattgcccttcattggaaactacctgcagctgaacacagagcagatgtacaactccctcatgaagatcagtgagcgctatggccctgtgttcaccattcacttggggccccggcgggtcgtggtgctgtgcggacatgatgccgtcaaggaggctctggtggaccaggctgaggagttcagcgggcgaggcgagcaggccaccttcgactggctcttcaaaggctatggcgtggcgttcagcaacggggagcgcgccaagcagctccggcgcttctccatcgccaccctaaggggttttggcgtgggcaagcgcggcatcgaggaacgcatccaggaggaggcgggcttcctcatcgacgccctccggggcacgcacggcgccaatatcgatcccaccttcttcctgagccgcacagtctccaatgtcatcagctccattgtctttggggaccgctttgactatgaggacaaagagttcctgtcactgttgcgcatgatgctgggaagcttccagttcacggcaacctccacggggcagctctatgagatgttctcttcggtgatgaaacacctgccaggaccacagcaacaggcctttaaggagctgcaagggctggaggacttcatcgccaagaaggtggagcacaaccagcgcacgctggatcccaattccccacgggacttcatcgactcctttctcatccgcatgcaggaggaggagaagaaccccaacacagagttctacttgaagaacctggtgatgaccaccctgaacctcttctttgcgggcactgagaccgtgagcaccaccctgcgctacggtttcctgctgctcatgaagcacccagaggtggaggccaaggtccatgaggagattgacagagtgatcggcaagaaccggcagcccaagtttgaggaccgggccaagatgccctacacagaggcagtgatccacgagatccaaagatttggagacatgctccccatgggtttggcccacagggtcaacaaggacaccaagtttcgggatttcttcctccctaagggcactgaagtgttccctatgctgggctccgtgctgagagaccccaggttcttctccaacccccgggacttcaatccccagcacttcctggataagaaggggcagtttaagaagagtgatgcttttgtgcccttttccatcggaaagcggtactgttttggagaaggcctggccagaatggagctctttctcttcttcaccaccatcatgcagaactttcgcttcaagtcccctcagtcgcctaaggatatcgacgtgtcccccaaacacgtgggctttgccacgatcccacgaaactacaccatgagcttcctgccccgctgagcgagggctgtgctggtgcagggctggtgggcggggccagggaaacggccggggcaggggcggggcttgtgggaggggcggggctaagaatgggggcagtgggggaaggaaggggagaggtggttagagggaacagaagaaacagaaggggctcagttcaccttgatgatgtccttcagagctgtgatgagaggaagggaaaccttacagtatgctacaaagagtagtaataatagcagctcttatttcctga

SEQ ID NO: 55757 - DNA, 1751 bp, Homo sapiens
actaccaccatgctggcctcagggatgcttctggtggccttgctggtctgcctgactgtaatggtcttgatgtctgtttggcagcagaggaagagcaaggggaagctgcctccgggacccaccccattgcccttcattggaaactacctgcagctgaacacagagcagatgtacaactccctcatgaagatcagtgagcgctatggccccgtgttcaccattcacttggggccccggcgggtcgtggtgctgtgtggacatgatgccgtcagggaggctctggtggaccaggctgaggagttcagcgggcgaggcgagcaagccaccttcgactgggtcttcaaaggctatggcgtggtattcagcaacggggagcgcgccaagcagctccggcgcttctccatcgccaccctgcgggacttcggggtgggcaagcgaggcatcgaggagcgcatccaggaggaggcgggcttcctcatcgacgccctccggggcactggcggcgccaatatcgatcccaccttcttcctgagccgcacagtctccaatgtcatcagctccattgtctttggggaccgctttgactataaggacaaagagttcctgtcactgttgcgcatgatgctaggaatcttccagttcacgtcaacctccacggggcagctctatgagatgttctcttcggtgatgaaacacctgccaggaccacagcaacaggcctttcagttgctgcaagggctggaggacttcatagccaagaaggtggagcacaaccagcgcacgctggatcccaattccccacgggacttcattgactcctttctcatccgcatgcaggaggaggagaagaaccccaacacggagttctacttgaaaaacctggtgatgaccacgttgaacctcttcattgggggcaccgagaccgtcagcaccaccctgcgctatggcttcttgctgctcatgaagcacccagaggtggaggccaaggtccatgaggagattgacagagtgatcggcaagaaccggcagcccaagtttgaggaccgggccaagatgccctacatggaggcagtgatccacgagatccaaagatttggagacgtgatccccatgagtttggcccgcagagtcaaaaaggacaccaagtttcgggatttcttcctccctaagggcaccgaagtgttccctatgctgggctctgtgctgagagaccccagtttcttctccaacccccaggacttcaatccccagcacttcctgaatgagaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtgggctttgccacgatcccacgaaactacaccatgagcttcctgccccgctgagcgagggctgtgccggtgcaggtctggtgggcggggccagggaaagggcagggccaagaccgggcttgggagaggggcgcagctaagactgggggcaggatggcggaaaggaaggggcgtggtggctagagggaagagaagaaacagaagcggctcagttcaccttgataaggtgcttccgagctgggatgagaggaaggaaacccttacattatgctatgaagagtagtaataatagcagctcttatttcctgagc

SEQ ID NO: 55758 - DNA, 2281 bp, Homo sapiens
ccctgggtcttcctagccccgagactttcaagtccatatgcctggagtcccccctcctgagacccttaaccctgcatcctccgcaacagaagacctccagatgcacagccacacttccatctcaccctaataaaacccagacctttggattcctctcccttggaatgcccaaatccacaactttggggtgcattctcactctcagaccccaaatccaaagcccaagtgctcccctatgcaaatattccaaactcttcagttctacagtttatcggttgccccctcctaaatccacagccctgcggcacccctcctgaagtaccacagatttagtctggaggccccctctctgttcagctgccctggggtccccttatcctcccttgctggctgtgtcccaagctaggtggcattcatggtggggcgtgtagttgggaggtgaaataaggtgattatgtaattagccaaagtccatccctctttttcaggcagtataaaggcaaaccaccccacccatcaccatctgtcatctcactaccaccatgctggcctcagggctgcttctggtggccttgctggcctgcctgactgtgatggtcttgatgtctgtctggcagcagaggaagagcagggggaagctgcctccgggacccaccccactgcccttcattggaaactacctccagctgaacacagagcacatatgtgactccatcatgaagttcagtgagtgctatggccccgtgttcaccattcacttggggccccggcgggtcgtggtgctgtgtggacatgatgccgtcagggaggctctggtggaccaggctgaggagttcagcgggcgaggcgagcaagccaccttcgactgggtcttcaaaggctatggcgtggcgttcagcaacggggagcgcgccaagcagctcctgcgctttgccatcgccaccctgagggacttcggggtgggcaagcgaggcatcgaggagcgcatccaggaggagtcgggcttcctcatcgaggccatccggagcacgcacggcgccaatatcgatcccaccttcttcctgagccgcacagtctccaatgtcatcagctccattgtctttggggaccgctttgactatgaggacaaagagttcctgtcactgctgagcatgatgctaggaatcttccagttcacgtcaacctccacggggcagctctatgagatgttctcttcggtgatgaaacacctgccaggaccacagcaacaggcctttaagttgctgcaagggctggaggacttcatagccaagaaggtggagcacaaccagcgcacgctggatcccaattccccacaggacttcatcgactcctttctcatccacatgcaggaggaggagaagaaccccaacacggagttctacttgaagaacctgatgatgagcacgttgaacctcttcattgcaggcaccgagacggtcagcaccaccctgcgctatggcttcttgctgctcatgaagcacccagaggtggaggccaaggtccatgaggagattgacagagtgatcggcaagaaccggcagcccaagtttgaggaccggaccaagatgccctacatggaggcagtgatccacgagatccaaagatttggagacgtgatccccatgagtttggcccgcagggttaaaaaggacaccaagtttcgggattttttcctccctaagggcaccgaagtgttccctatgctgggctccgtgctgagagaccccagcttcttctccaaccctcaggacttcaatccccagcatttcctggatgacaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtggtctttgccacgatcccacgaaactacaccatgagcttcctgccccgctgagcgagggctgtgccggtgcaggtctggtgggcggggccagggaaaggcggggtcagggcggggttcgcggaagaggcgggtataagaatggggggaagatgcgggaaaggaaggggcgtggtggctagagggaagagaagaaacagaagcggctcagttcaccttgataaggtgcttccgagctgggatgagaggaagggaaaccttacattatgctatgaagagtagtaataatagcagctcttatttcctga

SEQ ID NO: 55759 - DNA, 2128 bp, Homo sapiens
ccctgggtcttcctagccccgagactttcaagtccatatgcctggagtcccccctcctgagacccttaaccctgcatcctccgcaacagaagacctccagatgcacagccacacttccatctcaccctaataaaacccagacctttggattcctctcccttggaatgcccaaatccacaactttggggtgcattctcactctcagaccccaaatccaaagcccaagtgctcccctatgcaaatattccaaactcttcagttctacagtttatcggttgccccctcctaaatccacagccctgcggcacccctcctgaagtaccacagatttagtctggaggccccctctctgttcagctgccctggggtccccttatcctcccttgctggctgtgtcccaagctaggtggcattcatggtggggcgtgtagttgggaggtgaaataaggtgattatgtaattagccaaagtccatccctctttttcaggcagtataaaggcaaaccaccccacccatcaccatctgtcatctcactaccaccatgctggcctcagggctgcttctggtggccttgctggcctgcctgactgtgatggtcttgatgtctgtctggcagcagaggaagagcagggggaagctgcctccgggacccaccccactgcccttcattggaaactacctccagctgaacacagagcacatatgtgactccatcatgaaggtgtcccaaggcgtggcgttcagcaacggggagcgcgccaagcagctcctgcgctttgccatcgccaccctgagggacttcggggtgggcaagcgaggcatcgaggagcgcatccaggaggagtcgggcttcctcatcgaggccatccggagcacgcacggcgccaatatcgatcccaccttcttcctgagccgcacagtctccaatgtcatcagctccattgtctttggggaccgctttgactatgaggacaaagagttcctgtcactgctgagcatgatgctaggaatcttccagttcacgtcaacctccacggggcagctctatgagatgttctcttcggtgatgaaacacctgccaggaccacagcaacaggcctttaagttgctgcaagggctggaggacttcatagccaagaaggtggagcacaaccagcgcacgctggatcccaattccccacaggacttcatcgactcctttctcatccacatgcaggaggaggagaagaaccccaacacggagttctacttgaagaacctgatgatgagcacgttgaacctcttcattgcaggcaccgagacggtcagcaccaccctgcgctatggcttcttgctgctcatgaagcacccagaggtggaggccaaggtccatgaggagattgacagagtgatcggcaagaaccggcagcccaagtttgaggaccggaccaagatgccctacatggaggcagtgatccacgagatccaaagatttggagacgtgatccccatgagtttggcccgcagggttaaaaaggacaccaagtttcgggattttttcctccctaagggcaccgaagtgttccctatgctgggctccgtgctgagagaccccagcttcttctccaaccctcaggacttcaatccccagcatttcctggatgacaaggggcagtttaagaagagtgatgcttttgtgcccttttccatcggaaagcggaactgtttcggagaaggcctggccagaatggagctctttctcttcttcaccaccgtcatgcagaacttccgcctcaagtcctcccagtcacctaaggacattgacgtgtcccccaaacacgtggtctttgccacgatcccacgaaactacaccatgagcttcctgccccgctgagcgagggctgtgccggtgcaggtctggtgggcggggccagggaaaggcggggtcagggcggggttcgcggaagaggcgggtataagaatggggggaagatgcgggaaaggaaggggcgtggtggctagagggaagagaagaaacagaagcggctcagttcaccttgataaggtgcttccgagctgggatgagaggaagggaaaccttacattatgctatgaagagtagtaataatagcagctcttatttcctga

SEQ ID NO: 55760 - DNA, 3052 bp, Homo sapiens
caggaccatggaactcagcgtcctcctcttccttgcactcctcacaggactcttgctactcctggttcagcgccaccctaacacccatgaccgcctcccaccagggccccgccctctgccccttttgggaaaccttctgcagatggatagaagaggcctactcaaatcctttctgaggttccgagagaaatatggggacgtcttcacggtacacctgggaccgaggcccgtggtcatgctgtgtggagtagaggccatacgggaggcccttgtggacaaggctgaggccttctctggccggggaaaaatcgccatggtcgacccattcttccggggatatggtgtgatctttgccaatggaaaccgctggaaggtgcttcggcgattctctgtgaccactatgagggacttcgggatgggaaagcggagtgtggaggagcggattcaggaggaggctcagtgtctgatagaggagcttcggaaatccaagggggccctcatggaccccaccttcctcttccagtccattaccgccaacatcatctgctccatcgtctttggaaaacgattccactaccaagatcaagagttcctgaagatgctgaacttgttctaccagactttttcactcatcagctctgtattcggccagctgtttgagctcttctctggcttcttgaaatactttcctggggcacacaggcaagtttacaaaaacctgcaggaaatcaatgcttacattggccacagtgtggagaagcaccgtgaaaccctggaccccagcgcccccaaggacctcatcgacacctacctgctccacatggaaaaagagaaatccaacgcacacagtgaattcagccaccagaacctcaacctcaacacgctctcgctcttctttgctggcactgagaccaccagcaccactctccgctacggcttcctgctcatgctcaaataccctcatgttgcagagagagtctacagggagattgaacaggtgattggcccacatcgccctccagagcttcatgaccgagccaaaatgccatacacagaggcagtcatctatgagattcagagattttccgaccttctccccatgggtgtgccccacattgtcacccaacacaccagcttccgagggtacatcatccccaaggacacagaagtatttctcatcctgagcactgctctccatgacccacactactttgaaaaaccagacgccttcaatcctgaccactttctggatgccaatggggcactgaaaaagactgaagcttttatccccttctccttagggaagcggatttgtcttggtgaaggcatcgcccgtgcggaattgttcctcttcttcaccaccatcctccagaacttctccatggccagccccgtggccccagaagacatcgatctgacaccccaggagtgtggtgtgggcaaaatacccccaacataccagatccgcttcctgccccgctgaaggggctgagggaagggggtcaaaggattccagggtcattcagtgtccccgcctctgtagacaatggctctgactccccgcaacttcctgcctctgagagacctgctacaagccagcttccttcccctccatggcaccagttgtctgaggtcacattgcaagtgagtgcaggagtgagattatcgaaaattataatatacaaaatcatatatatatatatgttcttgttttttgagacagagtctcacactgttgcccaggctggagtgcagtggcgtgatctcggctcactgcaacctccacccccggggatcaagcaactctcctgcctcagcctccctagtagctgggattacaggcatgcactaccacgcttggctaatttttgtatttttagtagagatggggtttcactgtgtaggccaggctggtctcgaactcctgaactcaagtgattcacccaccttagcctcccaaagtgctgggattacaggcgtgagtcaccgtgcccagccatgtatatatataattttaaaaattaagctgaaattcacataacataaaattagctgttttaaagtgtaaaatttagtggcgtgtggttcattcacaaagctgtacaaccaccaccatctagttccaaacattttctttttttctgagatggagtctcactctgtcacccaggttcgagttcagtggtgccatctctgtccactgcaacctccacatcctgggttcaagtgattctcctgcctcagcctctggaggagctggtatcacaggcgtcccccaccacgcctggctaaattttgtatttttaggtggtcttgaactcctgatgtcaggtgattctcctagctccaaatgttttcattatctctcccccaacaaaacccatacctatcaagctgtcactccccataccccattctctttttcatctcggcccctgtcaatctggtttttgtcactatggacttaccaattctgaatatttcccataaacagaatcatacaatatttgattttttttttttttttgaaactaagccttgctctgtctcccaggctggagtgctatggtgcaatttttgttcactgcaacctctgccttccaagatcaagagattctccagtctcagctcccaagtagctgggattacaggcatgtactaccatgcctggctaattttcttgtagttttagtagggacatgttggccaggctggtggtgagctcctggcctcaggtgatccacccacctcagtgttccaaagtgctgatattacaggcataatatgtgatcttttgtgtctggttgctttcatgttgaatgctatttttgaggttcatgcctgttgtagaccacagtcacacactgctgtagtcttccccagtcctcattcccagctgcctcttcctactgcttccgtctatcaaaaagcccccttggcccaggttccctgagctgtgggattctgcactggtgctttggattccctgatatgttccttcaaatctgctgagaattaaataaacatctctaaagcctgacctccccacgtc

SEQ ID NO: 55761 - DNA, 1995 bp, Homo sapiens
ggcaccggaaagaacaagaaaaaagaacaccttatttttatcttcttcagtgagccaatgttcattcaaaagagagattaaagtgctttttgctgactagtcacagtcagagtcagaatcacaggtggattagtagggagtgttataaaagccttgaagtgaaagcccgcagttgtcttactaagaagagaagccttcaatggatccagctgtggctctggtgctctgtctctcctgtttgtttctcctttcactctggaggcagagctctggaagagggaggctcccgtctggccccactcctctcccgattattggaaatatcctgcagttagatgttaaggacatgagcaaatccttaaccaatttctcaaaagtctatggccctgtgttcactgtgtattttggcctgaagcccattgtggtgttgcatggatatgaagcagtgaaggaggccctgattgatcatggagaggagttttctggaagaggaagttttccagtggctgaaaaagttaacaaaggacttggaatccttttcagcaatggaaagagatggaaggagatccggcgtttctgcctcatgactctgcggaattttgggatggggaagaggagcatcgaggaccgtgttcaagaggaagcccgctgccttgtggaggagttgagaaaaaccaatgcctcaccctgtgatcccactttcatcctgggctgtgctccctgcaatgtgatctgctctgttattttccatgatcgatttgattataaagatcagaggtttcttaacttgatggaaaaattcaatgaaaacctcaggattctgagctctccatggatccaggtctgcaataatttccctgctctcatcgattatctcccaggaagtcataataaaatagctgaaaattttgcttacattaaaagttatgtattggagagaataaaagaacatcaagaatccctggacatgaacagtgctcgggactttattgattgtttcctgatcaaaatggaacaggaaaagcacaatcaacagtctgaatttactgttgaaagcttgatagccactgtaactgatatgtttggggctggaacagagacaacgagcaccactctgagatatggactcctgctcctgctgaagtacccagaggtcacagctaaagtccaggaagagattgaatgtgtagttggcagaaaccggagcccctgtatgcaggacaggagtcacatgccctacacagatgctgtggtgcacgagatccagagatacattgacctcctccccaccaacctgccccatgcagtgacctgtgatgttaaattcaaaaactacctcatccccaagggcacgaccataataacatccctgacttctgtgctgcacaatgacaaagaattccccaacccagagatgtttgaccctggccactttctggataagagtggcaactttaagaaaagtgactacttcatgcctttctcagcaggaaaacggatgtgtatgggagagggcctggcccgcatggagctgtttttattcctgaccaccattttgcagaactttaacctgaaatctcaggttgacccaaaggatattgacatcacccccattgccaatgcatttggtcgtgtgccacccttgtaccagctctgcttcattcctgtctgaagaagggcagatagtttggctgctcctgtgctgtcacctgcaattctcccttatcagggccattagcctctcccttctctctgtgagggatattttctctgacttgtcaatccacatcttcccattccctcaagatccaatgaacatccaacctccattaaagagagtttcttgggtcacttcctaaatatatctgctattctccatactctgtatcacttgtattgaccaccacatatgctaatacctatctactgctgagttgtcagtatgttatcactagaaaacaaagaaaaatgattaataaatgacaattcagagcc

SEQ ID NO: 55762 - DNA, 1473 bp, Homo sapiens
atggatccttttgtggtccttgtgctctgtctctcatgtttgcttctcctttcaatctggagacagagctctgggagaggaaaactccctcctggccccactcctctcccagtgattggaaatatcctacagatagatattaaggatgtcagcaaatccttaaccaatctctcaaaaatctatggccctgtgttcactctgtattttggcctggaacgcatggtggtgctgcatggatatgaagtggtgaaggaagccctgattgatcttggagaggagttttctggaagaggccatttcccactggctgaaagagctaacagaggatttggaatcgttttcagcaatggaaagagatggaaggagatccggcgtttctccctcatgacgctgcggaattttgggatggggaagaggagcattgaggaccgtgttcaagaggaagcccgctgccttgtggaggagttgagaaaaaccaaggcttcaccctgtgatcccactttcatcctgggctgtgctccctgcaatgtgatctgctccattattttccagaaacgtttcgattataaagatcagcaatttcttaacttgatggaaaaattgaatgaaaacatcaggattgtaagcaccccctggatccagatatgcaataattttcccactatcattgattatttcccgggaacccataacaaattacttaaaaaccttgcttttatggaaagtgatattttggagaaagtaaaagaacaccaagaatcgatggacatcaacaaccctcgggactttattgattgcttcctgatcaaaatggagaaggaaaagcaaaaccaacagtctgaattcactattgaaaacttggtaatcactgcagctgacttacttggagctgggacagagacaacaagcacaaccctgagatatgctctccttctcctgctgaagcacccagaggtcacagctaaagtccaggaagagattgaacgtgtcattggcagaaaccggagcccctgcatgcaggacaggggccacatgccctacacagatgctgtggtgcacgaggtccagagatacatcgacctcatccccaccagcctgccccatgcagtgacctgtgacgttaaattcagaaactacctcattcccaagggcacaaccatattaacttccctcacttctgtgctacatgacaacaaagaatttcccaacccagagatgtttgaccctcgtcactttctggatgaaggtggaaattttaagaaaagtaactacttcatgcctttctcagcaggaaaacggatttgtgtgggagagggcctggcccgcatggagctgtttttattcctgaccttcattttacagaactttaacctgaaatctctgattgacccaaaggaccttgacacaactcctgttgtcaatggatttgcttctgtcccgcccttctatcagctgtgcttcattcctgtctga

SEQ ID NO: 55763 - DNA, 1851 bp, Homo sapiens
cttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaacttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatggattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgctgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagtccatttcttttgtgaatgtgctaaataaaaagtgttattaattgctggttca

SEQ ID NO: 55764 - DNA, 1890 bp, Homo sapiens
cttaataagaagagaaggcttcaatggaaccttttgtggtcctggtgctgtgtctctcttttatgcttctcttttcactctggagacagagctgtaggagaaggaagctccctcctggccccactcctcttcctattattggaaatatgctacagatagatgttaaggacatctgcaaatctttcaccaatttctcaaaagtctatggtcctgtgttcaccgtgtattttggcatgaatcccatagtggtgtttcatggatatgaggcagtgaaggaagccctgattgataatggagaggagttttctggaagaggcaattccccaatatctcaaagaattactaaaggacttggaatcatttccagcaatggaaagagatggaaggagatccggcgtttctccctcacaaacttgcggaattttgggatggggaagaggagcattgaggaccgtgttcaagaggaagctcactgccttgtggaggagttgagaaaaaccaaggcttcaccctgtgatcccactttcatcctgggctgtgctccctgcaatgtgatctgctccgttgttttccagaaacgatttgattataaagatcagaattttctcaccctgatgaaaagattcaatgaaaacttcaggattctgaactccccatggatccaggtctgcaataatttccctctactcattgattgtttcccaggaactcacaacaaagtgcttaaaaatgttgctcttacacgaagttacattagggagaaagtaaaagaacaccaagcatcactggatgttaacaatcctcgggactttatggattgcttcctgatcaaaatggagcaggaaaaggacaaccaaaagtcagaattcaatattgaaaacttggttggcactgtagctgatctatttgttgctggaacagagacaacaagcaccactctgagatatggactcctgctcctgctgaagcacccagaggtcacagctaaagtccaggaagagattgatcatgtaattggcagacacaggagcccctgcatgcaggataggagccacatgccttacactgatgctgtagtgcacgagatccagagatacagtgaccttgtccccaccggtgtgccccatgcagtgaccactgatactaagttcagaaactacctcatccccaagagctttgataacaagataatgctggctgcataaaactagggcacaaccataatggcattactgacttccgtgctacatgatgacaaagaatttcctaatccaaatatctttgaccctggccactttctagataagaatggcaactttaagaaaagtgactacttcatgcctttctcagcaggaaaacgaatttgtgcaggagaaggacttgcccgcatggagctatttttatttctaaccacaattttacagaactttaacctgaaatctgttgatgatttaaagaacctcaatactactgcagttaccaaagggattgtttctctgccaccctcataccagatctgcttcatccctgtctgaagaatgctagcccatctggctgctgatctgctatcacctgcaactctttttttatcaaggacattcccactattatgtcttctctgacctctcatcaaatcttcccattcactcaatatcccataagcatccaaactccattaaggagagttgttcaggtcactgcacaaatatatctgcaattattcatactctgtaacacttgtattaattgctgcatatgctaatacttttctaatgctgactttttaatatgttatcactgtaaaacacagaaaagtgattaatgaatgataatttagtccatttcttttgtgaatgtgctaaataaaaagtgttattaattgctggttca

SEQ ID NO: 55765 - DNA, 1673 bp, Homo sapiens
gtgctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggggtgttcctggcgcgctatgggcccgcgtggcgcgagcagaggcgcttctccgtctccaccttgcgcaacttgggcctgggcaagaagtcgctggagcagtgggtgaccgaggaggccgcctgcctttgtgccgccttcgccaaccactccggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgtgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttccaaaaaaaaaaaaaaaa

SEQ ID NO: 55766 - DNA, 1520 bp, Homo sapiens
gtgctgagagtgtcctgcctggtcctctgtgcctggtggggtgggggtgccaggtgtgtccagaggagcccatttggtagtgaggcaggtatggggctagaagcactggtgcccctggccgtgatagtggccatcttcctgctcctggtggacctgatgcaccggcgccaacgctgggctgcacgctacccaccaggccccctgccactgcccgggctgggcaacctgctgcatgtggacttccagaacacaccatactgcttcgaccagttgcggcgccgcttcggggacgtgttcagcctgcagctggcctggacgccggtggtcgtgctcaatgggctggcggccgtgcgcgaggcgctggtgacccacggcgaggacaccgccgaccgcccgcctgtgcccatcacccagatcctgggtttcgggccgcgttcccaaggacgcccctttcgccccaacggtctcttggacaaagccgtgagcaacgtgatcgcctccctcacctgcgggcgccgcttcgagtacgacgaccctcgcttcctcaggctgctggacctagctcaggagggactgaaggaggagtcgggctttctgcgcgaggtgctgaatgctgtccccgtcctcctgcatatcccagcgctggctggcaaggtcctacgcttccaaaaggctttcctgacccagctggatgagctgctaactgagcacaggatgacctgggacccagcccagcccccccgagacctgactgaggccttcctggcagagatggagaaggccaaggggaaccctgagagcagcttcaatgatgagaacctgtgcatagtggtggctgacctgttctctgccgggatggtgaccacctcgaccacgctggcctggggcctcctgctcatgatcctacatccggatgtgcagcgccgtgtccaacaggagatcgacgacgtgatagggcaggtgcggcgaccagagatgggtgaccaggctcacatgccctacaccactgccgtgattcatgaggtgcagcgctttggggacatcgtccccctgggtgtgacccatatgacatcccgtgacatcgaagtacagggcttccgcatccctaagggaacgacactcatcaccaacctgtcatcggtgctgaaggatgaggccgtctgggagaagcccttccgcttccaccccgaacacttcctggatgcccagggccactttgtgaagccggaggccttcctgcctttctcagcaggccgccgtgcatgcctcggggagcccctggcccgcatggagctcttcctcttcttcacctccctgctgcagcacttcagcttctcggtgcccactggacagccccggcccagccaccatggtgtctttgctttcctggtgaccccatccccctatgagctttgtgctgtgccccgctagaatggggtacctagtccccagcctgctccctagccagaggctctaatgtacaataaagcaatgtggtagttccaaaaaaaaaaaaaaaa

SEQ ID NO: 55767 - DNA, 2768 bp, Homo sapiens
cactgctgtgcagggcaggaaagctccatgcacatagcccagcaaagagcaacacagagctgaaaggaagactcagaggagagagataagtaaggaaagtagtgatggctctcatcccagacttggccatggaaacctggcttctcctggctgtcagcctggtgctcctctatctatatggaacccattcacatggactttttaagaagcttggaattccagggcccacacctctgccttttttgggaaatattttgtcctaccataagggcttttgtatgtttgacatggaatgtcataaaaagtatggaaaagtgtggggcttttatgatggtcaacagcctgtgctggctatcacagatcctgacatgatcaaaacagtgctagtgaaagaatgttattctgtcttcacaaaccggaggccttttggtccagtgggatttatgaaaagtgccatctctatagctgaggatgaagaatggaagagattacgatcattgctgtctccaaccttcaccagtggaaaactcaaggagatggtccctatcattgcccagtatggagatgtgttggtgagaaatctgaggcgggaagcagagacaggcaagcctgtcaccttgaaagacgtctttggggcctacagcatggatgtgatcactagcacatcatttggagtgaacatcgactctctcaacaatccacaagacccctttgtggaaaacaccaagaagcttttaagatttgattttttggatccattctttctctcaataacagtctttccattcctcatcccaattcttgaagtattaaatatctgtgtgtttccaagagaagttacaaattttttaagaaaatctgtaaaaaggatgaaagaaagtcgcctcgaagatacacaaaagcaccgagtggatttccttcagctgatgattgactctcagaattcaaaagaaactgagtcccacaaagctctgtccgatctggagctcgtggcccaatcaattatctttatttttgctggctatgaaaccacgagcagtgttctctccttcattatgtatgaactggccactcaccctgatgtccagcagaaactgcaggaggaaattgatgcagttttacccaataaggcaccacccacctatgatactgtgctacagatggagtatcttgacatggtggtgaatgaaacgctcagattattcccaattgctatgagacttgagagggtctgcaaaaaagatgttgagatcaatgggatgttcattcccaaaggggtggtggtgatgattccaagctatgctcttcaccgtgacccaaagtactggacagagcctgagaagttcctccctgaaagattcagcaagaagaacaaggacaacatagatccttacatatacacaccctttggaagtggacccagaaactgcattggcatgaggtttgctctcatgaacatgaaacttgctctaatcagagtccttcagaacttctccttcaaaccttgtaaagaaacacagatccccctgaaattaagcttaggaggacttcttcaaccagaaaaacccgttgttctaaaggttgagtcaagggatggcaccgtaagtggagcctgaattttcctaaggacttctgctttgctcttcaagaaatctgtgcctgagaacaccagagacctcaaattactttgtgaatagaactctgaaatgaagatgggcttcatccaatggactgcataaataaccggggattctgtacatgcattgagctctctcattgtctgtgtagagtgttatacttgggaatataaaggaggtgaccaaatcagtgtgaggaggtagatttggctcctctgcttctcacgggactatttccaccacccccagttagcaccattaactcctcctgagctctgataagagaatcaacatttctcaataatttcctccacaaattattaatgaaaataagaattattttgatggctctaacaatgacatttatatcacatgttttctctggagtattctataagttttatgttaaatcaataaagaccactttacaaaagtattatcagatgctttcctgcacattaaggagaaatctatagaactgaatgagaaccaacaagtaaatatttttggtcattgtaatcactgttggcgtggggcctttgtcagaactagaatttgattattaacataggtgaaagttaatccactgtgactttgcccattgtttagaaagaatattcatagtttaattatgccttttttgatcaggcacagtggctcacgcctgtaatcctagcagtttgggaggctgagccgggtggatcgcctgaggtcaggagttcaagacaagcctggcctacatggttgaaaccccatctctactaaaaatacacaaattagctaggcatggtggactcgcctgtaatctcactacacaggaggctgaggcaggagaatcacttgaacctgggaggcggatgttgaagtgagctgagattgcaccactgcactccagtctgggtgagagtgagactcagtcttaaaaaaatatgcctttttgaagcacgtacattttgtaacaaagaactgaagctcttattatattattagttttgatttaatgttttcagcccatctcctttcatatttctgggagacagaaaacatgtttccctacacctcttgcattccatcctcaacacccaactgtctcgatgcaatgaacacttaataaaaaacagtcgattggtc

SEQ ID NO: 55768 - DNA, 2080 bp, Homo sapiens
tcactgctgtgcagggcaggaaagctccacacacacagcccagcaaacagcagcacgctgctgaaaaaaagactcagaggagagagataaggaaggaaagtagtgatggatctcatcccaaacttggccgtggaaacctggcttctcctggctgtcagcctgatactcctctatctatatggaacccgtacacatggactttttaagaagcttggaattccagggcccacacctctgccttttttgggaaatgctttgtccttccgtaagggctattggacgtttgacatggaatgttataaaaagtatagaaaagtctggggtatttatgactgtcaacagcctatgctggctatcacagatcccgacatgatcaaaacagtgctagtgaaagaatgttattctgtcttcacaaaccggaggcctttcgggccagtgggatttatgaaaaatgccatctctatagctgaggatgaagaatggaagagaatacgatcattgctgtctccaacattcaccagcggaaaactcaaggagatggtccctatcattgcccagtatggagatgtgttggtgagaaatctgaggcgggaagcagagacaggcaagcctgtcaccttgaaacacgtctttggggcctacagcatggatgtgatcactagcacatcatttggagtgagcatcgactctctcaacaatccacaagacccctttgtggaaaacaccaagaagcttttaagatttaatccattagatccattcgttctctcaataaaagtctttccattccttaccccaattcttgaagcattaaatatcactgtgtttccaagaaaagttataagttttctaacaaaatctgtaaaacagataaaagaaggtcgcctcaaagagacacaaaagcaccgagtggatttccttcagctgatgattgactctcagaattcaaaagactctgagacccacaaagctctgtctgatctggagctcatggcccaatcaattatctttatttttgctggctatgaaaccacgagcagtgttctctccttcattatatatgaactggccactcaccctgatgtccagcagaaagtgcagaaggaaattgatacagttttacccaataaggcaccacccacctatgatactgtgctacagttggagtatcttgacatggtggtgaatgaaacactcagattattcccagttgctatgagacttgagagggtctgcaaaaaagatgttgaaatcaatgggatgtttattcccaaaggggtggtggtgatgattccaagctatgttcttcatcatgacccaaagtactggacagagcctgagaagttcctccctgaaaggttcagtaaaaagaacaaggacaacatagatccttacatatacacaccctttggaagtggacccagaaactgcattggcatgaggtttgctctcgtgaacatgaaacttgctctagtcagagtccttcagaacttctccttcaaaccttgtaaagaaacacagatccccctgaaattacgctttggaggacttcttctaacagaaaaacccattgttctaaaggctgagtcaagggatgagaccgtaagtggagcctgatttccctaaggacttctggtttgctctttaagaaagctgtgccccagaacaccagagacctcaaattactttacaaatagaaccctgaaatgaagacgggcttcatccaatgtgctgcataaataatcagggattctgtacgtgcattgtgctctctcatggtctgtatagagtgttatacttggtaatatagaggagatgaccaaatcagtgctggggaagtagatttggcttctctgcttctcataggactatctccaccacccccagttagcaccattaactcctcctgagctctgataacataattaacatttctcaataatttcaaccacaatcattaataaaaataggaattattttgatggctctaacagtgacatttatatcatgtgttatatctgtagtattctatagtaagctttatattaagcaaatcaataaaaacctctttacaaaagta

SEQ ID NO: 55769 - DNA, 3951 bp, Homo sapiens
gaaggtgcaagagctgtctgaaaaggtcagagcaaagcatgaagctggtgagcagctgtgaccatagctggaagcttctctctgagctttctcctggttacctcctcctcccctacgtgaccagtcagccaagtgttaagtccaggggaacattttgctgcttccaagtactgtctcactagtgttatttgccataacttgcggccacagggcaaggtccaggtgctcagacctttacatcctggactttccaaggcctcccaaagctctctggcacccagggaacagtgtgcgtgtcgagagcttaatccgcaggagcatagccatggttctctggggtccagtgctgggagctctgctggtggtcattgctggatacctgtgcctgccagggatgctccgacaacgcaggccatgggagccccctctggacaagggtaccgtgccctggcttggccatgccatggctttccggaagaatatgtttgaatttctgaagcgcatgaggaccaagcatggggatgtgttcacagtgcagctagggggccagtacttcaccttcgtcatggaccccctctcctttggccccatcctcaaggacacacagagaaaactagactttgggcaatatgcaaaaaaactggtgctgaaggtatttggataccgttcagtgcaaggggaccatgagatgatacactcagccagcaccaagcatctgaggggggatggcttgaaggatcttaatgagaccatgctggacagcctgtcctttgtaatgctgacgtccaaaggctggagtctggatgccagttgctggcatgaggacagcctctttcgcttctgctattacatcttgttcacagctggctacctgagcttgttcggctacacgaaggacaaggagcaggacctgctacaggcaggagagttattcatggagttccgcaagtttgaccttcttttcccaaggtttgtctactccctgctgtggccccgggagtggctagaagtgggccgactccagcgtctctttcacaagatgctctccgtgagccacagccaggagaaggagggcatcagcaactggctgggcaacatgcttcagtttctgagggagcagggggtaccctcagctatgcaggacaagttcaacttcatgatgctctgggcctcccaggggaacacggggcctacctctttctgggccctcttgtacctcctgaagcacccagaagctattcgggctgtgagggaggaagctacccaggtcctgggtgaggccaggctggagaccaagcagtcctttgccttcaaactcggtgccctgcaacacaccccagttctagacagcgtggtggaggagacgctgcggctgagggctgcacccaccctcctcaggttggttcatgaagactataccctgaagatgtccagtgggcaggagtatctgttccgccatggagacatcctggccctctttccctacctctcagtgcacatggaccctgacatccaccctgagcccaccgtcttcaagtacgatcgcttcctcaaccctaatggcagccggaaagtggacttcttcaagacaggcaagaagatccaccactacaccatgccctggggttcgggcgtttccatctgccctgggaggttctttgcactcagtgaggtgaagctctttatcctgcttatggtcacacactttgacttagagttggtggaccctgacacaccactaccccatgttgacccgcagcgctggggttttggcaccatgcagcccagccacgatgtgcgcttccgctaccgcctgcatcctacagagtgagcttggccaagccagctgcaaacctggccagaggagttctattgcatctctcacctgttctcacccctctgcagccccaagaccccactggccacccctccctctggtcctgtggcaccccctacctctgttctgcctgtcctcgctctctccccgcctagtcatctgacaggcttatcattctctttaaaataccatctctcagagtgggttctgccgaaccctcctctcacaggaagtccagaggaagggggagtatctgtgggcaacttggtttgggagatgatgcctgccttgagaagtcctgagtacagagactggttccccccagacacgagtaacatggcatcttgcaaacatcagcctccactctcccagcttgctttagttttttcagcaacacttatcccacatcctatggaattcaggttctagaacagtgtcatccaacataaatatgaagcaagctacatgagtagtggggttttttggttttgtttgtttgttttgagacagagtcttgctctgtcgccgaggctgcagtgcagcggtgcgatctctgctcactgcaacctctgcctcctgggtttaagcaattctcctgcctcagcctccccagtagctgggattacaggcacctaccaccttgcccagctaatttagtttcctggtaaacacatttttaaaaagtaaaatgaaacaattcatttttataatatactttacttaatccaatatatccaaaatattggcatttcaacgtgatcactattaaaaattttaacgtaatagtttttaccttccctttttcatcctgtcttcaaagtctggtatgtactgtacttttgcagttcttcccagttcagactagccacattccaagtgcttaattgccgtgtgtggcaggtggctgccctattggatacaacaggtctagagaaatgataccttttttttttttttgagacagagtctcactctgttgcccaggctgcagtgcagtggtgtgatcttggctcactacaacctctgcctcccgggttcaagtaattctcctgcctcaggcttctgagtagctgggattataggtgcgcaccaccacacccggctagtttctgtatttttagtagagacggcgtttcaccattttggccggcctcctcggcctcccaaagttctgggattacaggcatgagccactgtgcccagtcaggatgtctttaatgtaggaatcattcaagatccctcctcagtgcccatgtctcccccacctcagggtgctgtcaaccctcccttggtttccatgatcattgctgaactcagagctttcttctatccccagacccacatgggagtctcccagcacctctgactcagcttggccaatgcagaacttggcatctgaacccctgcctcttccctgaaccactcctcctcctgatttccctgctctctctgctcagaacactaccattcaccccatctcccagagacactctccctcctcctctttcaccttcatacaagcaggcccccgtcctatcagtacacccccctgtgatgcctctgaaatatgtaccctcctcccctctcctactgtcattcttatacctgtgatctctgcgtttctcttctacactgctgccagaggcctttttgccaaaagcactgctgattgtcactcttttactttcctggttcccctttgacttcacacacttgacgtttacattttgtcacagttggtcccccttgccttcacatacctgatgtttaaattttgtcacggttggtctccaaacttctcaactttgccagctttctccaatgaaaccatcagtagagacattgctgttcctgcccatcccagtgccagctactccttcctggaagccttcctggatttcacgcatcccatcctctggccagaaatggcctccgaactgtgcagctcctgcggcaccatttgtatcatagcatatctgttatgtgtcgttgctttctgtgtcttggtttctgcctgctgcccacttccctagactggagcctactggggcatggtattttattcatttctgacctccaattccctaagtggagattaaatgttagaaacctga

SEQ ID NO: 55770 - DNA, 1576 bp, Homo sapiens
tgcactccagtccgggctggcggacagagggctggaaacaagacgctccagaatcaggagcttcccctcaggaaatagcatcctgtgtccccgcactgcagttgtctggtctctccagcagtttggtacttccggctgctgcaatgcgtgtggtggtgattggagcaggagtcatcgggctgtccaccgccctctgcatccatgagcgctaccactcagtcctgcagccactgcacataaaggtctacgcggaccgcttcaccccactcaccaccaccgacgtggctgccggcctctggcagccctacctttctgaccccaacaacccacaggaggcggactggagccaacagacctttgactatctcctgagccatgtccattctcccaacgctgaaaacctgggcctgttcctaatctcgggctacaacctcttccatgaagccattccggacccttcctggaaggacacagttctgggatttcggaagctgacccccagagagctggatatgttcccagattacggctatggctggttccacacaagcctaattctggagggaaagaactatctacagtggctgactgaaaggttaactgagaggggagtgaagttcttccagcggaaagtggagtcttttgaggaggtggcaagagaaggcgcagacgtgattgtcaactgcactggggtatgggctggggcgctacaacgagaccccctgctgcagccaggccgggggcagatcatgaaggtggacgccccttggatgaagcacttcattctcacccatgacccagagagaggcatctacaattccccgtacatcatcccagggacccagacagttactcttggaggcatcttccagttgggaaactggagtgaactaaacaatatccaggaccacaacaccatttgggaaggctgctgcagactggagcccacactgaagaatgcaagaattattggtgaacgaactggcttccggccagtacgcccccagattcggctagaaagagaacagcttcgcactggaccttcaaacacagaggtcatccacaactatggccatggaggctacgggctcaccatccactggggatgtgccctggaggcagccaagctctttgggagaatcctggaagaaaagaaattgtccagaatgccaccatcccacctctgaagactccagtgactgctgcctccccccacaagaactcccttctcccctcagccaatgaatcaatgtgctccttcataagccattgcttctccctcacttctttcctcaaagaagcatgaggtgagagaaagccacaaagtcagtgcctggagaagggttcagcccaacatggggcccctctcatcactgaaatccctctaccttctctgggtctggcattataaagaacagctgaggctgtcattccatgagtcttcagaagaaaggacagctcagaaaatcaaagaggccaactgcccagagccacagaaaatggaggataattgaggctaagtaacctgattacaagttgtactaacatattaaaggttctgaaaagtcctgcaaaa

SEQ ID NO: 55771 - DNA, 487 bp, Homo sapiens
ccttgctatagaagacctgggacagaggactgctgtctgccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggactgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatctcaaataaatgccttgttac

SEQ ID NO: 55772 - DNA, 1868 bp, Homo sapiens
gagcttactctggctttgccgagatggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtatgaccaggaacccccatttcagccacgacaactggataccaacctttttcagcacccagtatttctggttcgtcttgaaggtccgttggcagcgactagaggacacgactgagctagggggtctggccccaaactgcccggtggtccgcctctcaggacagaggtgcaacatttgggagtttatgcaaggtaataggccactggtgctgaattttggaagttgtacctgaccttcatttatgttcaaatttgaccagttcaagaggcttattgaagactttagttccatagcagattttcttgtcatttacattgaagaagcacatgcatcagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaagggtaaatctggcccttggaactacaacccagaggaagttcgtgctgttctggaaaagctccacagttaatctggacagatacctcaattctaggtgaccaacgggagggcttctcaaggcttagctctccctgagacccagctggcttttacccttgacctgtgtccctagctgaatcactagctcagatttttctgatctaagcaaacaactcccagctgaggaatgcaggccacagcacccaatcaagacaaattgttattatcagaaaatgaagcaacacttgagctgttcaggccagttccctgttgaagaaacagttccctgttgaagaaagtagagcctgacactgctcccactttggagaccacattccctgcacacggtctttgagagagcagttgcactctacaggcacacttctgaggtacggtatctctctccagccactctgataccaagtaattcaagctggcattccttctattagggaaattcattttacccaatttgcatttatggaattgatcatttaagacactaaattagtttttagaaccaattatgggaagaattccagttgttaggaagagatgaggagttggaagaggagggattagaaacaggaggaggcagtcatcctctccttgccaaaagatttaaacctgtccacattggtggtgatgatgggtgagtttccatggtaacacatccctaattttaccagggaagaggagagtactcactttaccatctttgaatatatttcatagaaatctagctctctgtaccctgaaatcttccactagcctcacttttcaacagagtcatctagaagggagggttggcttcccaaaagcataaccttgaccaaaccaaacaataggcaccagcaatgctgtcattcagttatgcagaagctcatttgtgaaattctgtttctctgatttcttcgcaagtctcttaatggtcatttgtgttagattacatcaaactgatggatagccattggtattcatctattttaactctgtgtctttacatatttgtttatgatggccacagcctaaagtacacacggctgtgacttgattcaaaagaaaatgttataagatgcagtaaactaataacagaattattaaaatatatcaggctaaaaaaaaa

SEQ ID NO: 55773 - DNA, 1676 bp, Homo sapiens
gagcttactctggctttgccgagatggggctgccccagccagggctgtggctgaagaggctctgggtgctcttggaggtggctgtgcatgtggtcgtgggtaaagtgcttctgatattgtttccagacagagtcaagcggaacatcctggccatgggcgagaagacgggtaataggccactggtgctgaattttggaagttgtacctgaccttcatttatgttcaaatttgaccagttcaagaggcttattgaagactttagttccatagcagattttcttgtcatttacattgaagaagcacatgcatcagatggctgggcttttaagaacaacatggacatcagaaatcaccagaaccttcaggatcgcctgcaggcagcccatctactgctggccaggagcccccagtgccctgtggtggtggacaccatgcagaaccagagcagccagctctacgcagcactgcctgagaggctctacataatccaggagggcaggatcctctacaagggtaaatctggcccttggaactacaacccagaggaagttcgtgctgttctggaaaagctccacagttaatctggacagatacctcaattctaggtgaccaacgggagggcttctcaaggcttagctctccctgagacccagctggcttttacccttgacctgtgtccctagctgaatcactagctcagatttttctgatctaagcaaacaactcccagctgaggaatgcaggccacagcacccaatcaagacaaattgttattatcagaaaatgaagcaacacttgagctgttcaggccagttccctgttgaagaaacagttccctgttgaagaaagtagagcctgacactgctcccactttggagaccacattccctgcacacggtctttgagagagcagttgcactctacaggcacacttctgaggtacggtatctctctccagccactctgataccaagtaattcaagctggcattccttctattagggaaattcattttacccaatttgcatttatggaattgatcatttaagacactaaattagtttttagaaccaattatgggaagaattccagttgttaggaagagatgaggagttggaagaggagggattagaaacaggaggaggcagtcatcctctccttgccaaaagatttaaacctgtccacattggtggtgatgatgggtgagtttccatggtaacacatccctaattttaccagggaagaggagagtactcactttaccatctttgaatatatttcatagaaatctagctctctgtaccctgaaatcttccactagcctcacttttcaacagagtcatctagaagggagggttggcttcccaaaagcataaccttgaccaaaccaaacaataggcaccagcaatgctgtcattcagttatgcagaagctcatttgtgaaattctgtttctctgatttcttcgcaagtctcttaatggtcatttgtgttagattacatcaaactgatggatagccattggtattcatctattttaactctgtgtctttacatatttgtttatgatggccacagcctaaagtacacacggctgtgacttgattcaaaagaaaatgttataagatgcagtaaactaataacagaattattaaaatatatcaggctaaaaaaaaa

SEQ ID NO: 55774 - DNA, 3104 bp, Homo sapiens
ctagtcatgctccgtcccggcgcgcagctgctgcggggcctcctgctgcggagctgcccgctgcagggctcccccgggcgcccgcgctctgtctgcggccgggaaggagaggaaaaaccacccttatctgcagaaacacaatggaaagacagagcagaaacagtgataattggaggtggctgtgttggtgtgagtctggcttatcacctggccaaagcagggatgaaagatgtggtcctgctggagaaatcagagctcacggctggatctacctggcacgcagcaggtttaacaacttactttcatcctggaataaacttgaagaaaatacattatgatagcatcaaactttatgagaaactggaagaagaaactggtcaggtggtgggattccatcagccaggtagtatcagacttgctaccacccctgtaagggtagatgaatttaaatatcaaatgactcggactggctggcatgcaacagaacagtatctcattgaacctgaaaaaattcaagagatgttccctttactcaacatgaataaggttttagctggattgtataatcctggagatggtcacattgatccttattctctaactatggcactggctgctggggctaggaaatgtggtgcccttttaaaatatcctgcaccagtaacttctctgaaagccaggtcagatggaacatgggacgttgaaacaccacaggggtctatgagagcaaatagaattgtgaatgctgcaggattttgggctcgtgaagtaggtaaaatgattggactagaacatcctctcattccggttcaacatcaatatgttgttacatcgactatatctgaagtgaaagctttgaaacgagaactgcctgtgctccgtgacctggaaggatcatattatctccgacaggaaagggatgggcttttgtttggtccatatgaaagtcaagagaaaatgaaagttcaggactcctgggtcaccaatggagttcctccaggttttggaaaggaactctttgagtctgatctagatcgaatcatggaacacatcaaagctgccatggaaatggttcctgtcttgaaaaaggctgacatcatcaatgttgtcaatggtcctatcacgtattctcctgacattctgcctatggtggggccccatcagggggtcagaaactactgggtggctataggctttggatatggcataatccacgctggtggggtagggaaatatctcagtgactggatcctgcatggagaacctccttttgatctgatagaattggatcctaatcgctatggcaaatggacaacaacccagtacactgaggccaaagcaagagaatcatatggattcaacaatattgttggttatcctaaagaagaacggtttgctgggaggccgactcaacgagtcagtgggctctatcaaaggctggagtctaagtgttccatggggttccatgctggctgggagcagccgcactggttctacaaaccaggccaggacactcagtacaggccaagttttcgccgcacaaactggtttgagcctgtgggctcggagtataaacaggttatgcaaagagtagcggtaactgacctatcaccatttggcaagtttaacatcaaaggccaagattccattagactactggaccatctctttgcaaatgtcattccaaaggtgggttttacaaatataagtcacatgttaacacccaagggtcgagtgtatgctgagctgactgtttctcaccaatctcctggggagtttcttttaattactggctctggatcagaacttcatgatcttagatggattgaagaagaagcagtcaaaggtggatatgatgttgaaattaaaaacataactgatgagcttggagttcttggagttgctgggccacaggcaagaaaggtccttcagaaactgacctctgaagatcttagtgatgatgttttcaagtttcttcaaaccaagtccttaaaggtttccaacattcctgtcactgctattaggatatcttatactggtgagctgggttgggagctgtatcacagaagagaagattctgtggcgctgtatgacgctatcatgaatgcaggccaggaggagggaatcgacaattttggaacctatgccatgaatgccttacgcctggagaaagccttcagagcctgggggttagagatgaactgtgatacaaatcctttggaagctggactggaatattttgtgaagttaaataagccagcagacttcataggaaagcaagcactgaaacagattaaagccaaggggctgaaacgaagactggtctgcctcaccttggcaacggatgatgttgatccagagggaaatgaaagcatctggtacaatggcaaggtggttggcaacacgacatctggaagctatagctacagcatccagaagagtctggctttcgcatatgtccctgtacaactaagtgaagtgggacagcaagtggaagttgaactattaggcaaaaattacccagcagtcatcatacaagaacctttggtattgaccgaaccaaccagaaaccggcttcagaaaaaaggtggaaaggacaaaacttgaaaaaagaccttcagcagtcaactgaattagagttgctaatgactgtccttgaaattattataactggctcccaggggaatagaggaaaccaggaattcatttcaaaatcatcaaagtctaaatttagaatcttaatgaaacctttctgttaagtgttttctaagcaagacagaataatagataaatgatttacattgttcttttaaatgaagaaatttgaaatgaatgtttttttatttaccccacattacccaatcagtaaaacatttaggtgtttgctaatatacacaatcattactataacctaattaagggacattttataattttagtaacaaatgcattcggttcttgacagctgaaaacaaattaataaattatcttttacataaaaacatgtacaatattgtttatggatttacttctttgagaaatctttccttagatgaataaatgaaagttttaatttttcatgaaaaaaaaaaaaaaaaaaaaaa

SEQ ID NO: 55775 - DNA, 1705 bp, Homo sapiens
cccatctccacccctcccctgaaccccactccccactgaggtccccaaaccccacccctcactccaccctgagggccccatcctctgaaccccaatcccccagccccactgagctcttaaccctccccacctgagggttccctttccctgcccgtcccccagcttcctagctccccaccccaagtgaccccccgcagctcctcgcccctcccactgcaaaccggcactgaagggctgccccgcccccgcccctccccgcccccgcgggacacgcccagattctttgcccccatagcctggtgacctctggccacccgctgtcccaggtgggcctggatccttccagctcattctttgcctgcgccgtccctcgttccatggcccagtcctccccggggaccctgagcctggaagccccggaccactggaaccttgaacccaccagctggctgtacccggagccgtggcagcagccctcatccccatggcggccatcccagccctggacccagaggccgagcccagcatggacgtgattttggtgggatccagtgagctctcaagctccgtttcacccgggacaggcagagatcttattgcatatgaagtcaaggctaaccagcgaaatatagaagacatctgcatctgctgcggaagtctccaggttcacacacagcaccctctgtttgagggagggatctgcgccccatgtaaggacaagttcctggatgccctcttcctgtacgacgatgacgggtaccaatcctactgctccatctgctgctccggagagacgctgctcatctgcggaaaccctgattgcacccgatgctactgcttcgagtgtgtggatagcctggtcggccccgggacctcggggaaggtgcacgccatgagcaactgggtgtgctacctgtgcctgccgtcctcccgaagcgggctgctgcagcgtcggaggaagtggcgcagccagctcaaggccttctacgaccgagagtcggagaatccccttgagatgttcgaaaccgtgcctgtgtggaggagacagccagtccgggtgctgtccctttttgaagacatcaagaaagagctgacgagtttgggctttttggaaagtggttctgacccgggacaactgaagcatgtggttgatgtcacagacacagtgaggaaggatgtggaggagtggggacccttcgatcttgtgtacggcgccacacctcccctgggccacacctgtgaccgtcctcccagctggtacctgttccagttccaccggctcctgcagtacgcacggcccaagccaggcagccccaggcccttcttctggatgttcgtggacaatctggtgctgaacaaggaagacctggacgtcgcatctcgcttcctggagatggagccagtcaccatcccagatgtccacggcggatccttgcagaatgctgtccgcgtgtggagcaacatcccagccataaggagcagcaggcactgggctctggtttcggaagaagaattgtccctgctggcccagaacaagcagagctcgaagctcgcggccaagtggcccaccaagctggtgaagaactgctttctccccctaagagaatatttcaagtatttttcaacagaactcacttcctctttataaatgagtcactatactgtgaagaaaaagacttttcctagaacaaaggcaactttcctc

SEQ ID NO: 55776 - DNA, 1702 bp, Homo sapiens
cccatctccacccctcccctgaaccccactccccactgaggtccccaaaccccacccctcactccaccctgagggccccatcctctgaaccccaatcccccagccccactgagctcttaaccctccccacctgagggttccctttccctgcccgtcccccagcttcctagctccccaccccaagtgaccccccgcagctcctcgcccctcccactgcaaaccggcactgaagggctgccccgcccccgcccctccccgcccccgcgggacacgcccagattctttgcccccatagcctggtgacctctggccacccgctgtcccaggtgggcctggatccttccagctcattctttgcctgcgccgtccctcgttccatggcccagtcctccccggggaccctgagcctggaagccccggaccactggaaccttgaacccaccagctggctgtacccggagccgtggcagcagccctcatccccatggcggccatcccagccctggacccagaggccgagcccagcatggacgtgattttggtgggatccagtgagctctcaagctccgtttcacccgggacaggcagagatcttattgcatatgaagtcaaggctaaccagcgaaatatagaagacatctgcatctgctgcggaagtctccaggttcacacacagcaccctctgtttgagggagggatctgcgccccatgtaaggacaagttcctggatgccctcttcctgtacgacgatgacgggtaccaatcctactgctccatctgctgctccggagagacgctgctcatctgcggaaaccctgattgcacccgatgctactgcttcgagtgtgtggatagcctggtcggccccgggacctcggggaaggtgcacgccatgagcaactgggtgtgctacctgtgcctgccgtcctcccgaagcgggctgctgcagcgtcggaggaagtggcgcagccagctcaaggccttctacgaccgagagtcggagaatccccttgagatgttcgaaaccgtgcctgtgtggaggagacagccagtccgggtgctgtccctttttgaagacatcaagaaagagctgacgagtttgggctttttggaaagtggttctgacccgggacaactgaagcatgtggttgatgtcacagacacagtgaggaaggatgtggaggagtggggacccttcgatcttgtgtacggcgccacacctcccctgggccacacctgtgaccgtcctcccagctggtacctgttccagttccaccggctcctgcagtacgcacggcccaagccaggcagccccaggcccttcttctggatgttcgtggacaatctggtgctgaacaaggaagacctggacgtcgcatctcgcttcctggagatggagccagtcaccatcccagatgtccacggcggatccttgcagaatgctgtccgcgtgtggagcaacatcccagccataaggagcaggcactgggctctggtttcggaagaagaattgtccctgctggcccagaacaagcagagctcgaagctcgcggccaagtggcccaccaagctggtgaagaactgctttctccccctaagagaatatttcaagtatttttcaacagaactcacttcctctttataaatgagtcactatactgtgaagaaaaagacttttcctagaacaaaggcaactttcctc

SEQ ID NO: 55777 - DNA, 1856 bp, Homo sapiens
ctgacttggcaggactgtgcaattgtcagaaggccgtggggagtgggggccagtgcctgcagcctgccctgcctctctcacaggcccttagagcatcgccaggtgcagagctccacagctctctttcccaaggagtaatcagagggtgagaacgtggagcctggtggacaggtgaaagcactgggatctttctgcccagaaaggggaaagttgcacatttatatcctagagggaagcgacagcagtgcttctccctgtgctgaggtacaggagccatgtggctagaaatcctcctcacttcagtgctgggctttgccatctactggttcatctcccgggacaaagaggaaactttgccacttgaagatgggtggtgggggccaggcacgaggtccgcagccagggaggacgacagcatccgccctttcaaggtggaaacgtcagatgaggagatccacgacttacaccagaggatcgataagttccgtttcaccccacctttggaggacagctgcttccactatggcttcaactccaactacctgaagaaagtcatctcctactggcggaatgaatttgactggaagaagcaggtggagattctcaacagataccctcacttcaagactaagattgaagggctggacatccacttcatccacgtgaagcccccccagctgcccgcaggccataccccgaagcccttgctgatggtgcacggctggcccggctctttctacgagttttataagatcatcccactcctgactgaccccaagaaccatggcctgagcgatgagcacgtttttgaagtcatctgcccttccatccctggctatggcttctcagaggcatcctccaagaaggggttcaactcggtggccaccgccaggatcttttacaagctgatgctgcggctgggcttccaggaattctacattcaaggaggggactgggggtccctgatctgcactaatatggcccagctggtgcccagccacgtgaaaggcctgcacttgaacatggctttggttttaagcaacttctctaccctgaccctcctcctgggacagcgtttcgggaggtttcttggcctcactgagagggatgtggagctgctgtaccccgtcaaggagaaggtattctacagcctgatgagggagagcggctacatgcacatccagtgcaccaagcctgacaccgtaggctctgctctgaatgactctcctgtgggtctggctgcctatattctagagaagttttccacctggaccaatacggaattccgatacctggaggatggaggcctggaaaggaagttctccctggacgacctgctgaccaacgtcatgctctactggacaacaggcaccatcatctcctcccagcgcttctacaaggagaacctgggacagggctggatgacccagaagcatgagcggatgaaggtctatgtgcccactggcttctctgccttcccttttgagctattgcacacgcctgaaaagtgggtgaggttcaagtacccaaagctcatctcctattcctacatggttcgtgggggccactttgcggcctttgaggagccggagctgctcgcccaggacatccgcaagttcctgtcggtgctggagcggcaatgacccacccctctccccccgcctgccacctccccccacaagtgccctccaggcttttcttggggaagataccccttttctgaggaatgagtttgcctccgtcccctgcccatgctgggagcccacgctcaccccctcacccctccaagctcactccccaacccccaactccgtgtggtaagcaacatggctttgatgataaacgactttactcta

SEQ ID NO: 55778 - DNA, 2217 bp, Homo sapiens
tgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagcgcttgcaacaaagacatttatgtggacctagacatgaagggcataaactataacagctcagttgccaagagtgctcaagaatgccaagaaagatgcacggatgacgtccactgccactttttcacgtacgccacaaggcagtttcccagcctggagcatcgtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtcc

SEQ ID NO: 55779 - DNA, 2055 bp, Homo sapiens
tgctgtactgagagagaatgttacataacattgagaactagtacaagtaaatattaaagtgaagtgaccatttcctacacaagctcattcagaggaggatgaagaccattttggaggaagaaaagcacccttattaagaattgcagcaagtaagccaacaaggtcttttcaggatgattttcttatatcaagtggtacatttcattttatttacttcagtttctggtgaatgtgtgactcagttgttgaaggacacctgctttgaaggaggggacattactacggtcttcacaccaagcgccaagtactgccaggtagtctgcacttaccacccaagatgtttactcttcactttcacggcggaatcaccatctgaggatcccacccgatggtttacttgtgtcctgaaagacagtgttacagaaacactgccaagagtgaataggacagcagcgatttctgggtattctttcaagcaatgctcacaccaaataagtaacatttgtctactgaagcacacccaaacagggacaccaaccagaataacgaagctcgataaagtggtgtctggattttcactgaaatcctgtgcactttctaatctggcttgtattagggacattttccctaatacggtgtttgcagacagcaacatcgacagtgtcatggctcccgatgcttttgtctgtggccgaatctgcactcatcatcccggttgcttgttttttaccttcttttcccaggaatggcccaaagaatctcaaagaaatctttgtctccttaaaacatctgagagtggattgcccagtacacgcattaaaaagagcaaagctctttctggtttcagtctacaaagctgcaggcacagcatcccagtgttctgccattcttcattttaccatgacactgatttcttgggagaagaactggatattgttgctgcaaaaagtcacgaggcctgccagaaactgtgcaccaatgccgtccgctgccagttttttacctataccccagcccaagcatcctgcaacgaagggaagggcaagtgttacttaaagctttcttcaaacggatctccaactaaaatacttcacgggagaggaggcatctctggatacacattaaggttgtgtaaaatggataatgagtgtaccaccaaaatcaagcccaggatcgttggaggaactgcgtctgttcgtggtgagtggccgtggcaggtgaccctgcacacaacctcacccactcagagacacctgtgtggaggctccatcattggaaaccagtggatattaacagccgctcactgtttctatggggtagagtcacctaagattttgcgtgtctacagtggcattttaaatcaatctgaaataaaagaggacacatctttctttggggttcaagaaataataatccatgatcagtataaaatggcagaaagcgggtatgatattgccttgttgaaactggaaaccacagtgaattacacagattctcaacgacccatatgcctgccttccaaaggagatagaaatgtaatatacactgattgctgggtgactggatgggggtacagaaaactaagagacaaaatacaaaatactctccagaaagccaagatacccttagtgaccaacgaagagtgccagaagagatacagaggacataaaataacccataagatgatctgtgccggctacagggaaggagggaaggacgcttgcaagggagattcgggaggccctctgtcctgcaaacacaatgaggtctggcatctggtaggcatcacgagctggggcgaaggctgtgctcaaagggagcggccaggtgtttacaccaacgtggtcgagtacgtggactggattctggagaaaactcaagcagtgtgaatgggttcccaggggccattggagtccctgaaggacccaggatttgctgggagagggtgttgagttcactgtgccagcatgcttcctccacagtaacacgctgaaggggcttggtgtttgtaagaaaatgctagaagaaaacaaactgtcacaagttgttatgtcc

SEQ ID NO: 55780 - DNA, 2048 bp, Homo sapiens
ctattgatctggactcctggataggcagctggaccaacggacggacgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggacccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgaggaactcaataaagtgctttgaaaatgctgag

SEQ ID NO: 55781 - DNA, 2208 bp, Homo sapiens
cttattgataacctcagacgttcccaccactgaagatgaggttgaaaaacctgacttttatcatcatattgataatctcaggagaactctatgcagaagagaaaccctgtggttttcctcatgtggaaaatggaagaattgcccaatattactatacttttaaaagcttttactttccaatgagcatagacaaaaaattgtcatttttctgcttggctggttataccactgaaagtggaagacaagaagagcaaaccacgtgtacaacagaaggctggtctccagagccaaggtgcttcaaaaaatgcactaagcctgacctgagtaatggttacatctctgatgtaaagttattgtataaaattcaagagaacatgcattatggttgcgcttcagggtacaaaaccactggagggaaggatgaagaagtggttcaatgtctctctgatggatggtcttctcaaccaacctgtaggaaagaacatgaaacgtgtttggctcctgaattatataatggaaattattccacaacacagaaaacattcaaagtgaaggacaaagtacaatacgaatgtgctactggctactacacagctggaggaaagaagacagaggaggtagaatgtctcacatacggatggtctctcacaccaaaatgtaccaaattaaagtgctcttctttaagattaattgaaaatggttattttcatcctgtaaagcaaacctatgaagaaggagatgtcgttcagtttttctgtcatgaaaattattatctaagtggatctgatttaattcaatgctataactttggttggtacccagaatctcctgtatgcgaaggaagaagaaacagatgtcctcctccacctctgcccataaactccaaaattcaaacacattcaacaacttatcgtcatggagaaatagttcatatagaatgtgaacttaattttgagatccatgggtcagcagaaatacgttgtgaagatggaaaatggacagaacctccaaaatgcattgaaggacaggagaaggtagcctgtgaggaaccacccttcattgaaaatggtgcagcaaatttacactctaagatttattacaatggggataaagtgacatatgcatgtaaaagcggctaccttctccatggatcgaatgagataacttgtaatcgtggaaaatggacacttcctcctgagtgtgttgaaaataatgagaattgtaagcatcctcctgttgtaatgaatggggctgttgcagacgggatattggcaagctatgcaacaggatcctcagtggaatatagatgcaatgaatattacttactgaggggatcaaaaatatctcgttgcgaacaaggaaaatggtcatccccacctgtttgcttggaaccatgtactgttaatgtggattacatgaacagaaataacatagaaatgaagtggaaatatgaagggaaagtcttacatggagatttaatagattttgtatgtaaacagggatatgacttatctccattaaccccattgtctgaattatctgtgcagtgcaacagaggagaagtgaaatatcctttatgtactagaaaagaatctaaaggaatgtgcacatctcctcctcttattaaacatggagtcattattagttcaacagtagacacctatgaaaatggctcttcagtagaatacagatgttttgatcaccatttcctagaaggatctagggaggcctattgtttagatggaatgtggactacaccaccattgtgtttagagccatgcacattatcttttactgaaatggaaaagaataatttacttctgaaatgggattttgacaacagaccacacattttgcatggtgaatatattgagtttatttgtagaggagatacttatccagctgaattatatattactggatctatacttagaatgcaatgtgacagagggcagttaaaatatccaagatgtattccaagacaaagcactctgtcttatcaagaacccttaagaacatagaaatgaatggcagaaagaggagtcatatttcaatacatcatgaaattccttataaaatataattttgaggaaataagttaaaaacttcggagtttttccttgcttaaatatttgaatctaaattatttgtgctgaacatttcattatttataaatgaaaaccaataaatgtctaatttttagtttgt

SEQ ID NO: 55782 - DNA, 2804 bp, Homo sapiens
accactttcacaatctgctagcaaaggttatgcagcgcgtgaacatgatcatggcagaatcaccaggcctcatcaccatctgccttttaggatatctactcagtgctgaatgtacagtttttcttgatcatgaaaacgccaacaaaattctgaatcggccaaagaggtataattcaggtaaattggaagagtttgttcaagggaaccttgagagagaatgtatggaagaaaagtgtagttttgaagaagcacgagaagtttttgaaaacactgaaagaacaactgaattttggaagcagtatgttgatggagatcagtgtgagtccaatccatgtttaaatggcggcagttgcaaggatgacattaattcctatgaatgttggtgtccctttggatttgaaggaaagaactgtgaattagatgtaacatgtaacattaagaatggcagatgcgagcagttttgtaaaaatagtgctgataacaaggtggtttgctcctgtactgagggatatcgacttgcagaaaaccagaagtcctgtgaaccagcagtgccatttccatgtggaagagtttctgtttcacaaacttctaagctcacccgtgctgagactgtttttcctgatgtggactatgtaaattctactgaagctgaaaccattttggataacatcactcaaagcacccaatcatttaatgacttcactcgggttgttggtggagaagatgccaaaccaggtcaattcccttggcaggttgttttgaatggtaaagttgatgcattctgtggaggctctatcgttaatgaaaaatggattgtaactgctgcccactgtgttgaaactggtgttaaaattacagttgtcgcaggtgaacataatattgaggagacagaacatacagagcaaaagcgaaatgtgattcgaattattcctcaccacaactacaatgcagctattaataagtacaaccatgacattgcccttctggaactggacgaacccttagtgctaaacagctacgttacacctatttgcattgctgacaaggaatacacgaacatcttcctcaaatttggatctggctatgtaagtggctggggaagagtcttccacaaagggagatcagctttagttcttcagtaccttagagttccacttgttgaccgagccacatgtcttcgatctacaaagttcaccatctataacaacatgttctgtgctggcttccatgaaggaggtagagattcatgtcaaggagatagtgggggaccccatgttactgaagtggaagggaccagtttcttaactggaattattagctggggtgaagagtgtgcaatgaaaggcaaatatggaatatataccaaggtatcccggtatgtcaactggattaaggaaaaaacaaagctcacttaatgaaagatggatttccaaggttaattcattggaattgaaaattaacagggcctctcactaactaatcactttcccatcttttgttagatttgaatatatacattctatgatcattgctttttctctttacaggggagaatttcatattttacctgagcaaattgattagaaaatggaaccactagaggaatataatgtgttaggaaattacagtcatttctaagggcccagcccttgacaaaattgtgaagttaaattctccactctgtccatcagatactatggttctccactatggcaactaactcactcaattttccctccttagcagcattccatcttcccgatcttctttgcttctccaaccaaaacatcaatgtttattagttctgtatacagtacaggatctttggtctactctatcacaaggccagtaccacactcatgaagaaagaacacaggagtagctgagaggctaaaactcatcaaaaacactactccttttcctctaccctattcctcaatcttttaccttttccaaatcccaatccccaaatcagtttttctctttcttactccctctctcccttttaccctccatggtcgttaaaggagagatggggagcatcattctgttatacttctgtacacagttatacatgtctatcaaacccagacttgcttccatagtggagacttgcttttcagaacatagggatgaagtaaggtgcctgaaaagtttgggggaaaagtttctttcagagagttaagttattttatatatataatatatatataaaatatataatatacaatataaatatatagtgtgtgtgtgtatgcgtgtgtgtagacacacacgcatacacacatataatggaagcaataagccattctaagagcttgtatggttatggaggtctgactaggcatgatttcacgaaggcaagattggcatatcattgtaactaaaaaagctgacattgacccagacatattgtactctttctaaaaataataataataatgctaacagaaagaagagaaccgttcgtttgcaatctacagctagtagagactttgaggaagaattcaacagtgtgtcttcagcagtgttcagagccaagcaagaagttgaagttgcctagaccagaggacataagtatcatgtctcctttaactagcataccccgaagtggagaagggtgcagcaggctcaaaggcataagtcattccaatcagccaactaagttgtccttttctggtttcgtgttcaccatggaacattttgattatagttaatccttctatcttgaatcttctagagagttgctgaccaactgacgtatgtttccctttgtgaattaataaactggtgttctggttcat

SEQ ID NO: 55783 - DNA, 2033 bp, Homo sapiens
aagccgcagattcccatccagtatcctagaggaggagacccagggctgtgtcctaggaggcccaggaagcctggtcagcctggaggccgagggcgggcccgggagatctgggaaggacatcagtgtctccacgaagagcagcagggtctcagcccatggcagccgcaggccccatgactggggccgcagcctccagagccgccacagcagcccattgttctggggggtcaaaggtggaggctgtcagaggggcagtgcagggggctgctggggtgaagccccctgtagcagcagcacccagcctgctgtggctctgccctcctggaccccctgtcctcctggaccccctgccctcctggaccctctgccctcctggacccccttccctcctgggccctcctggaccccctgccctcctggatcctctgtcctcctggaccccctgccctcctggaccccctgtctgtggcccctgctcctctcctccttccccgacacatgactggaccccccgatctgcagccggggtctgggcactgggggtcctgtgggcctctcggtgtctggggacaatcacaggttcccgtgcccacacccagcctctgcttccagaacacactagagggtcccggcatcctgatgagtccactgtccccgcgatggttttcagggatggagaaggctccctgtcctccgctggaaccctgcagccgggctgacggtacccccaccacccacccaggggccccagaccctccccatctccaccgccaacccaggccccggctgcgcacgcggggccaggccgtgagctgctgtccccggatggggccgccccgggctggcctggctcactccgtgtcacagatattcccacagagaccccagcgagacctgcagaacattacagcagaatgaaggagagccagaggaagaggcagatgtgctggcctgtaaacagtctgatttccaatgtaaaccagattcaggcccacgacatcaggtaaacatctgcatcagagcccccggccccccaccgcccgggaggccccggggtccacacggccgactctgggacccgtcacagtgaccgccgagacatttcgtaattaggcaaaattgatccttgcattccttccctaaatcccaaatctctgcaattttacttcttctcaaaaatgaaaacatttggcaattagctgatccaagtgaaaaaggtagagaatgtgctctcaactggaaaatgccaattaaggaagcagctctgacttcccacccgccctggctaagctgggagcttatcttccccgagaagaatctgctgggataagggggcttgggaaacaccgagggcagggctgcctcctcagcttcctttgagagcagattagccgtggccttgtgccagcagggcctgggtgccacacagggtggcaggggtggcagagccgggcccggctctggtactgggatttggggtggcgggacccagtggggcacccgcttgtgggcggcactgagggcggtgacgtaggcagcgggtgccggtgtctgcccctccatctggccgggctccccaccctgctcctgcagccctggacctcagggcccatttgcggtgcaaggcggctcttggccattttgcccgcagggccctaccttgggtcttgggagcttctgtcccttgccctctcttgtccaggtcagcatctcccactgtgggaatcctatgtggccccatcgtctggacagtgtgggtcaggtcactgtggctgttttgtgatgcgtgtgtgggctcatccctcagtgctcagaagctgcagacactatggaaccgcttttcaggccccgtggccgtcacccccgctctagagacttgattgcagggaccatgcccggccggcctaactgcacccctcactccaggtgggtggggggacccaggcctgctggcccctgtggtggtgcagcccagaaggtgtgaatcagtttacactgttcagtgcctgaataaaagtcacaggacaaagagg

SEQ ID NO: 55784 - DNA, 1057 bp, Homo sapiens
accagaagagatggagctggacagagctgtgggggtcctgggcgctgccaccctgctgctctctttcctgggcatggcctgggctctccaggcggcagacacctgtccagaggtgaagatggtgggcctggagggctctgacaagctcaccattctccgaggctgtccggggctgcctggggcccctgggcccaagggagaggcaggcaccaatggaaagagaggagaacgtggcccccctggacctcctgggaaggcaggaccacctgggcccaacggagcacctggggagccccagccgtgcctgacaggcccgcgtacctgcaaggacctgctagaccgagggcacttcctgagcggctggcacaccatctacctgcccgactgccggcccctgactgtgctctgtgacatggacacggacggagggggctggaccgttttccagcggagggtggatggctctgtggacttctaccgggactgggccacgtacaagcagggcttcggcagtcggctgggggagttctggctggggaatgacaacatccacgccctgaccgcccagggaaccagcgagctccgtgtagacctggtggactttgaggacaactaccagtttgctaagtacagatcattcaaggtggccgacgaggcggagaagtacaatctggtcctgggggccttcgtggagggcagtgcgggagattccctgacgttccacaacaaccagtccttctccaccaaagaccaggacaatgatcttaacaccggaaattgtgctgtgatgtttcagggagcttggtggtacaaaaactgccatgtgtcaaacctgaatggtcgctacctcagggggactcatggcagctttgcaaatggcatcaactggaagtcggggaaaggatacaattatagctacaaggtgtcagagatgaaggtgcgacctgcctagcccaggccggcctcagggtcaggacgcctccacacatagttggttggggggtagggttgggagcttggccctacggtttgtaaaagaaacacatgtcgtgattct

SEQ ID NO: 55785 - DNA, 943 bp, Homo sapiens
accagaagagatggagctggacagagctgtgggggtcctgggcgctgccaccctgctgctctctttcctgggcatggcctgggctctccaggcggcagacacctgtccaggagaacgtggcccccctggacctcctgggaaggcaggaccacctgggcccaacggagcacctggggagccccagccgtgcctgacaggcccgcgtacctgcaaggacctgctagaccgagggcacttcctgagcggctggcacaccatctacctgcccgactgccggcccctgactgtgctctgtgacatggacacggacggagggggctggaccgttttccagcggagggtggatggctctgtggacttctaccgggactgggccacgtacaagcagggcttcggcagtcggctgggggagttctggctggggaatgacaacatccacgccctgaccgcccagggaaccagcgagctccgtgtagacctggtggactttgaggacaactaccagtttgctaagtacagatcattcaaggtggccgacgaggcggagaagtacaatctggtcctgggggccttcgtggagggcagtgcgggagattccctgacgttccacaacaaccagtccttctccaccaaagaccaggacaatgatcttaacaccggaaattgtgctgtgatgtttcagggagcttggtggtacaaaaactgccatgtgtcaaacctgaatggtcgctacctcagggggactcatggcagctttgcaaatggcatcaactggaagtcggggaaaggatacaattatagctacaaggtgtcagagatgaaggtgcgacctgcctagcccaggccggcctcagggtcaggacgcctccacacatagttggttggggggtagggttgggagcttggccctacggtttgtaaaagaaacacatgtcgtgattct

SEQ ID NO: 55786 - DNA, 1640 bp, Homo sapiens
gttgtaacaaaaccgctcaagtctgccttaaagagccttacaagccagccagtccctgcagctccacaaactgacccatcctgggccttgttctccacagaatgggtctgctccttcccctggcactctgcatcctagtcctgtgctgcggagcaatgtctccaccccagctggccctcaacccctcggctctgctctcccggggctgcaatgactcagatgtgctggcagttgcaggctttgccctgcgggatattaacaaagacagaaaggatggctatgtgctgagactcaaccgagtgaacgacgcccaggaatacagacggggtggcctgggatctctgttctatcttacactggatgtgctagagactgactgccatgtgctcagaaagaaggcatggcaagactgtggaatgaggatattttttgaatcagtttatggtcaatgcaaagcaatattttatatgaacaacccaagtagagttctctatttagctgcttataactgtactcttcgcccagtttcaaaaaaaaagatttacatgacgtgccctgactgcccaagctccatacccactgactcttccaatcaccaagtgctggaggctgccaccgagtctcttgcgaaatacaacaatgagaacacatccaagcagtattctctcttcaaagtcaccagggcttctagccagtgggtggtcggcccttcttactttgtggaatacttaattaaagaatcaccatgtactaaatcccaggccagcagctgttcacttcagtcctccgactctgtgcctgttggtctttgcaaaggttctctgactcgaacacactgggaaaagtttgtctctgtgacttgtgacttctttgaatcacaggctccagccactggaagtgaaaactctgctgttaaccagaaacctacaaaccttcccaaggtggaagaatcccagcagaaaaacacccccccaacagactccccctccaaagctgggccaagaggatctgtccaatatcttcctgacttggatgataaaaattcccaggaaaagggccctcaggaggcctttcctgtgcatctggacctaaccacgaatccccagggagaaaccctggatatttccttcctcttcctggagcctatggaggagaagctggtggtcctgcctttccccaaagaaaaagcacgcactgctgagtgcccagggccagcccagaatgccagccctcttgtccttccgccatgagaatcacacagagtcttctgtaggggtatggtgcgccgcatgacatgggaggcgatggggacgatggacagagacagagcgtgcacacgtagagtggctagtgaaggacgcctttttgactcttcttggtctcagcatgttgactgggattggaaataatgagactgagccctcggcttgggctgcactctaccctgtacactgccttgtaccctgagctgcatcacctcctaaactgagcagtctcataccatggagagatgcctctcttatgtcttcagccactcacttataaagatacttatcttttcagcagtatatatgtgctgaaatctcagcatgaaagcattgcatgagtaaagatactttccctaacaaaaaaaaaaaaaa

SEQ ID NO: 55787 - DNA, 3655 bp, Homo sapiens
agcaatcctttctttcagctggagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagagactgtgatgatgtcctccaaacacatccttcaggtacccaaagtggcattttcaatatcaagctaccgggatccagtaagattttttctgtttattgcgatcaagagaccagtttgggaggatggcttttgatccagcaaagaatggatggatcactgaattttaaccggacctggcaagactacaagagaggtttcggcagcctgaatgacgagggggaaggagaattctggctaggcaatgactacctccacttactaacccaaaggggctctgttcttagggttgaattagaggactgggctgggaatgaagcttatgcagaatatcacttccgggtaggctctgaggctgaaggctatgccctccaagtctcctcctatgaaggcactgcgggtgatgctctgattgagggttccgtagaggaaggggcagagtacacctctcacaacaacatgcagttcagcacctttgacagggatgcagaccagtgggaagagaactgtgcagaagtctatgggggaggctggtggtataataactgccaagcagccaatctcaatggaatctactaccctgggggctcctatgacccaaggaataacagtccttatgagattgagaatggagtggtctgggtttcctttagaggggcagattattccctcagggctgttcgcatgaaaattaggccccttgtgacccaataggctgaagaagtgggaatgggagcactctgtcttctttgctagagaagtggagagaaaatacaaaaggtaaagcagttgagattctctacaacctaaaaaattcctaggtgctattttcttatcctttgtactgtagctaaatgtacctgagacatattagtctttgaaaaataaagttatgtaaggttttttttatctttaaatagctctgtgggttttaacatttttataaagatataccaagggccattcagtacatcaggaaagtggcagacagaagcttctctctgcaaccttgaagactattggtttgagaacttctcttcccataccacccaaaatcataatgccattggaaagcaaaaagttgttttatccatttgatttgaattgttttaagccaatattttaaggtaaaactcactgaatctaaccatagctgacctttgtagtagaatttacaacttataattacaatgcacaatttataattacaatatgtatttatgtcttttgctatggagcaaatccaggaaggcaagagaaacattctttcctaaatataaatgaaaatctatcctttaaactcttccactagacgttgtaatgcacacttatttttttcccaaggagtaaccaatttctttctaaaacacatttaaaattttaaaactatttatgaatattaaaaaaagacataattcacacattaataaacaatctcccaagtattgatttaacttcatttttctaataatcataaactatattctgtgacatgctaattattattaaatgtaagtcgttagttcgaaagcctctcactaagtatgatctatgctatattcaaaattcaacccatttactttggtcaatatttgatctaagttgcatctttaatcctggtggtcttgccttctgatttttaatttgtatccttttctattaagatatatttgtcattttctcttgaatatgtattaaaatatcccaagc

SEQ ID NO: 55788 - DNA, 2210 bp, Homo sapiens
agcaatcctttctttcagctggagtgctcctcaggagccagccccacccttagaaaagatgttttccatgaggatcgtctgcctggtcctaagtgtggtgggcacagcatggactgcagatagtggtgaaggtgactttctagctgaaggaggaggcgtgcgtggcccaagggttgtggaaagacatcaatctgcctgcaaagattcagactggcccttctgctctgatgaagactggaactacaaatgcccttctggctgcaggatgaaagggttgattgatgaagtcaatcaagattttacaaacagaataaataagctcaaaaattcactatttgaatatcagaagaacaataaggattctcattcgttgaccactaatataatggaaattttgagaggcgatttttcctcagccaataaccgtgataatacctacaaccgagtgtcagaggatctgagaagcagaattgaagtcctgaagcgcaaagtcatagaaaaagtacagcatatccagcttctgcagaaaaatgttagagctcagttggttgatatgaaacgactggaggtggacattgatattaagatccgatcttgtcgagggtcatgcagtagggctttagctcgtgaagtagatctgaaggactatgaagatcagcagaagcaacttgaacaggtcattgccaaagacttacttccctctagagataggcaacacttaccactgataaaaatgaaaccagttccagacttggttcccggaaattttaagagccagcttcagaaggtacccccagagtggaaggcattaacagacatgccgcagatgagaatggagttagagagacctggtggaaatgagattactcgaggaggctccacctcttatggaaccggatcagagacggaaagccccaggaaccctagcagtgctggaagctggaactctgggagctctggacctggaagtactggaaaccgaaaccctgggagctctgggactggagggactgcaacctggaaacctgggagctctggacctggaagtactggaagctggaactctgggagctctggaactggaagtactggaaaccaaaaccctgggagccctagacctggtagtaccggaacctggaatcctggcagctctgaacgcggaagtgctgggcactggacctctgagagctctgtatctggtagtactggacaatggcactctgaatctggaagttttaggccagatagcccaggctctgggaacgcgaggcctaacaacccagactggggcacatttgaagaggtgtcaggaaatgtaagtccagggacaaggagagagtaccacacagaaaaactggtcacttctaaaggagataaagagctcaggactggtaaagagaaggtcacctctggtagcacaaccaccacgcgtcgttcatgctctaaaaccgttactaagactgttattggtcctgatggtcacaaagaagttaccaaagaagtggtgacctccgaagatggttctgactgtcccgaggcaatggatttaggcacattgtctggcataggtactctggatgggttccgccataggcaccctgatgaagctgccttcttcgacactgcctcaactggaaaaacattcccaggtttcttctcacctatgttaggagagtttgtcagtgagactgagtctaggggctcagaatctggcatcttcacaaatacaaaggaatccagttctcatcaccctgggatagctgaattcccttcccgtggtaaatcttcaagttacagcaaacaatttactagtagcacgagttacaacagaggagactccacatttgaaagcaagagctataaaatggcagatgaggccggaagtgaagccgatcatgaaggaacacatagcaccaagagaggccatgctaaatctcgccctgtcagaggtatccacacttctcctttggggaagccttccctgtccccctagactaagttaaatatttctgcacagtgttcccatggccccttgcatttccttcttaactctctgttacacgtcattgaaactacacttttttggtctgtttttgtgctagactgtaagttccttgggggcagggcctttgtctgtctcatctctgtattcccaaatgcctaacagtacagagccatgactcaataaatacatgttaaatggatgaatg

SEQ ID NO: 55789 - DNA, 1949 bp, Homo sapiens
ttgaagatctctcagttaagtctacatgaaaaggatggtttcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggcctgccccaccgcccatcagtggaggtggctatcgggctcgtccagccaaagcagctgccactcaaaagaaagtagaaagaaaagcccctgatgctggaggctgtcttcacgctgacccagacctgggggtgttgtgtcctacaggatgtcagttgcaagaggctttgctacaacaggaaaggccaatcagaaatagtgttgatgagttaaataacaatgtggaagctgtttcccagacctcctcttcttcctttcagtacatgtatttgctgaaagacctgtggcaaaagaggcagaagcaagtaaaagataatgaaaatgtagtcaatgagtactcctcagaactggaaaagcaccaattatatatagatgagactgtgaatagcaatatcccaactaaccttcgtgtgcttcgttcaatcctggaaaacctgagaagcaaaatacaaaagttagaatctgatgtctcagctcaaatggaatattgtcgcaccccatgcactgtcagttgcaatattcctgtggtgtctggcaaagaatgtgaggaaattatcaggaaaggaggtgaaacatctgaaatgtatctcattcaacctgacagttctgtcaaaccgtatagagtatactgtgacatgaatacagaaaatggaggatggacagtgattcagaaccgtcaagacggtagtgttgactttggcaggaaatgggatccatataaacagggatttggaaatgttgcaaccaacacagatgggaagaattactgtggcctaccaggtgaatattggcttggaaatgataaaattagccagcttaccaggatgggacccacagaacttttgatagaaatggaggactggaaaggagacaaagtaaaggctcactatggaggattcactgtacagaatgaagccaacaaataccagatctcagtgaacaaatacagaggaacagccggtaatgccctcatggatggagcatctcagctgatgggagaaaacaggaccatgaccattcacaacggcatgttcttcagcacgtatgacagagacaatgacggctggttaacatcagatcccagaaaacagtgttctaaagaagacggtggtggatggtggtataatagatgtcatgcagccaatccaaacggcagatactactggggtggacagtacacctgggacatggcaaagcatggcacagatgatggtgtagtatggatgaattggaaggggtcatggtactcaatgaggaagatgagtatgaagatcaggcccttcttcccacagcaatagtccccaatacgtagatttttgctcttctgtatgtgacaacatttttgtacattatgttattggaattttctttcatacattatattcctctaaaactctcaagcagacgtgagtgtgactttttgaaaaaagtataggataaattacattaaaatagcacatgattttcttttgttttcttcatttctcttgctcaccaagaagtaacaaaagtatagttttgacagagttggtgttcataatttcagttctagttgattgcgagaattttcaaataaggaagaggggtcttttatccttgtcgtaggaaaaccatgacggaaaggaaaaactgatgtttaaaagtccacttttaaaactatatttatttatgtaggatctgtcaaagaaaacttccaaaaagatttattaattaaaccagactctgttgcaataaaaaaaaaaaaaa

SEQ ID NO: 55790 - DNA, 940 bp, Homo sapiens
ctgtcagctgaggatccagccgaaagaggagccaggcactcaggccacctgagtctactcacctggacaactggaatctggcaccaattctaaaccactcagcttctccgagctcacaccccggagatcacctgaggacccgagccattgatggactcggacgagaccgggttcgagcactcaggactgtgggtttctgtgctggctggtcttctgctgggagcctgccaggcacaccccatccctgactccagtcctctcctgcaattcgggggccaagtccggcagcggtacctctacacagatgatgcccagcagacagaagcccacctggagatcagggaggatgggacggtggggggcgctgctgaccagagccccgaaagtctcctgcagctgaaagccttgaagccgggagttattcaaatcttgggagtcaagacatccaggttcctgtgccagcggccagatggggccctgtatggatcgctccactttgaccctgaggcctgcagcttccgggagctgcttcttgaggacggatacaatgtttaccagtccgaagcccacggcctcccgctgcacctgccagggaacaagtccccacaccgggaccctgcaccccgaggaccagctcgcttcctgccactaccaggcctgccccccgcactcccggagccacccggaatcctggccccccagccccccgatgtgggctcctcggaccctctgagcatggtgggaccttcccagggccgaagccccagctacgcttcctgaagccagaggctgtttactatgacatctcctctttatttattaggttatttatcttatttatttttttatttttcttacttgagataataaagagttccagaggagaaaaaaaaaaaaaaaaaaaaaaaaaaaaaaaaaaaaaaaaaaaaaaaaaaaaaaa

SEQ ID NO: 55791 - DNA, 1665 bp, Homo sapiens
cttctggtaaggaggccccgtgatcagctccagccatttgcagtcctggctatcccaggagcttacataaagggacaattggagcctgagaggtgacagtgctgacactacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaagattgttaacctgaaagagaaggtagcccagcttgaagcacagtgccaggaaccttgcaaagacacggtgcaaatccatgatatcactgggaaagattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggctggagacgtttaaaagaccgtttcaaaagagatttacttttttaaaggactttatctgaacagagagatataatatttttcctattggacaatggacttgcaaagcttcacttcattttaagagcaaaagaccccatgttgaaaactccataacagttttatgctgatgataatttatctacatgcatttcaataaaccttttgtttcctaagactagaaaaa

SEQ ID NO: 55792 - DNA, 1763 bp, Homo sapiens
cttctggtaaggaggccccgtgatcagctccagccatttgcagtcctggctatcccaggagcttacataaagggacaattggagcctgagaggtgacagtgctgacactacaaggctcggagctccgggcactcagacatcatgagttggtccttgcacccccggaatttaattctctacttctatgctcttttatttctctcttcaacatgtgtagcatatgttgctaccagagacaactgctgcatcttagatgaaagattcggtagttattgtccaactacctgtggcattgcagatttcctgtctacttatcaaaccaaagtagacaaggatctacagtctttggaagacatcttacatcaagttgaaaacaaaacatcagaagtcaaacagctgataaaagcaatccaactcacttataatcctgatgaatcatcaaaaccaaatatgatagacgctgctactttgaagtccaggaaaatgttagaagaaattatgaaatatgaagcatcgattttaacacatgactcaagtattcgatatttgcaggaaatatataattcaaataatcaaaagattgttaacctgaaagagaaggtagcccagcttgaagcacagtgccaggaaccttgcaaagacacggtgcaaatccatgatatcactgggaaagattgtcaagacattgccaataagggagctaaacagagcgggctttactttattaaacctctgaaagctaaccagcaattcttagtctactgtgaaatcgatgggtctggaaatggatggactgtgtttcagaagagacttgatggcagtgtagatttcaagaaaaactggattcaatataaagaaggatttggacatctgtctcctactggcacaacagaattttggctgggaaatgagaagattcatttgataagcacacagtctgccatcccatatgcattaagagtggaactggaagactggaatggcagaaccagtactgcagactatgccatgttcaaggtgggacctgaagctgacaagtaccgcctaacatatgcctacttcgctggtggggatgctggagatgcctttgatggctttgattttggcgatgatcctagtgacaagtttttcacatcccataatggcatgcagttcagtacctgggacaatgacaatgataagtttgaaggcaactgtgctgaacaggatggatctggttggtggatgaacaagtgtcacgctggccatctcaatggagtttattaccaaggtggcacttactcaaaagcatctactcctaatggttatgataatggcattatttgggccacttggaaaacccggtggtattccatgaagaaaaccactatgaagataatcccattcaacagactcacaattggagaaggacagcaacaccacctggggggagccaaacaggtcagaccagagcaccctgcggaaacagaatatgactcactttaccctgaggatgatttgtagaaaattaactgctaacttctattgacccacaaagtttcagaaattctctgaaagtttcttccttttttctcttactatatttattgatttcaagtcttctattaaggacatttagccttcaatggaaattaaaactcatttaggactgtatttccaaattactgatatcagagttatttaaaaattgtttatttgaggagataacatttcaactttgttcctaaatatataataataaaatgattgactttatttgcaaa

SEQ ID NO: 55793 - DNA, 1285 bp, Homo sapiens
aattacaaattcccaatgcagttacaggatcctgggaagcagagtgtctggatggaacctgagctgggtctctgactcacttctgactttagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaaaaaaaaaaaaaaaaaaaaaaaaaaaaaaaaaaaaaa

SEQ ID NO: 55794 - DNA, 1373 bp, Homo sapiens
aatgctaatttatttcacaggtatgatagtaaccaaaactcaggtaacaaccattagcttttgcaagaagtcaggttgactagcaaggagtctgcttctgctacttggagaagagatttagaattatgtatcttttgttacagatatacagatatacaaatatacagatatacaaataagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaaaaaaaaaaaaaaaaaaaaaaaaaaaaaaaaaaaaaa

SEQ ID NO: 55795 - DNA, 1412 bp, Homo sapiens
aattacaaattcccaatgcagttacaggatcctgggaagcagagtgtctggatggaacctgagctgggtctctgactcacttctgactttagggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaaaaaaaaaaaaaaaaaaaaaaaaaaaaaaaaaaaaaa

SEQ ID NO: 55796 - DNA, 1500 bp, Homo sapiens
aatgctaatttatttcacaggtatgatagtaaccaaaactcaggtaacaaccattagcttttgcaagaagtcaggttgactagcaaggagtctgcttctgctacttggagaagagatttagaattatgtatcttttgttacagatatacagatatacaaatatacagatatacaaataagggtgaagatggagggaatctgataaagacatcttataaattcaacagacacaaaagaatttgatctcccataagcaactgtgaaattacaataacagatcctgggaagttctacaattctaattcagttttttcaagggggaacatggcaaaggtgttcagtttcatccttgttaccaccgctctgacaatgggcagggaaatttcggcgctcgaggactgtgcccaggagcagatgcggctcagagcccaggtgcgcctgcttgagacccgggtcaaacagcaacaggtcaagatcaagcagcttttgcaggagaatgaagtccagttccttgataaaggagatgagaatactgtcattgatcttggaagcaagaggcagtatgcagattgttcagagattttcaatgatgggtataagctcagtggattttacaaaatcaaacctctccagagcccagcagaattttctgtttattgtgacatgtccgatggaggaggatggactgtaattcagagacgatctgatggcagtgaaaactttaacagaggatggaaagactatgaaaatggctttggaaattttgtccaaaaacatggtgaatattggctgggcaataaaaatcttcacttcttgaccactcaagaagactacactttaaaaatcgaccttgcagattttgaaaaaaatagccgttatgcacaatataagaatttcaaagttggagatgaaaagaatttctacgagttgaatattggggaatattctggaacagctggagattcccttgcggggaattttcatcctgaggtgcagtggtgggctagtcaccaaagaatgaaattcagcacgtgggacagagatcatgacaactatgaagggaactgcgcagaagaagatcagtctggctggtggtttaacaggtgtcactctgcaaacctgaatggtgtatactacagcggcccctacacggctaaaacagacaatgggattgtctggtacacctggcatgggtggtggtattctctgaaatctgtggttatgaaaattaggccaaatgattttattccaaatgtaatttaattgctgctgttgggctttcgtttctgcaattcagctttgtttaaagtgatttgaaaaatactcattctgaacatatccatgcgcaatcatgataactgttgtgagtagtgcttttcattcttctcacttgcctttgttacttaatgtgctttcagtacagcagatatgcaatattcaccaaataaatgtagactgtgttaaaaaaaaaaaaaaaaaaaaaaaaaaaaaaaaaaaaaa

SEQ ID NO: 55797 - DNA, 1799 bp, Homo sapiens
agaccacgaacccaccagaaggaagaaactccgaacacatctgaacatcagaaggaacaaactctggacacactgcctttaagaactgtaatactcaccgtgagggcccgcggcttcattcttgaagtcagtgagaccaagaacccaccaattccagacacagtgggatcacagagagagccaacagtccaggccatgacaagctggcacccagctctgcttcacatttgtccaactggcgtggctgtagctccttcctgcaaggcaatgctgaagaagctatggaagcaagaaggaagcatggattctaaaaactgacaacaaaccacttacccctattgctcttcttcctaaagctaaaggatcaaactgcatcacggaagctgcacacgatgacaccctgtctggaaagtttttgccagagggcaaaagactgcaagcagaatatccctttgccatttctcattcaggactggccgttgtctgaaagcaaacctcaaggacaggacttctggactccgcagccacttcaggctgctgctccatcgcatgaattccagcaggtggcgctgcaccccgcgcggacccggcttgcctctcggccccagggaggtcggttgatgagcagtcgggaagtgggtctgcgcgcaccccgctgcagctgtggcaaacgcaaacgatgacacacaggcttgacgagggcctttgtcagaagcaatggggatctggcgtcaccgcacaatggaaaacaaagtgcttctgcctggctggccagaatgcacgtttgctcactattgatgctggggcatttacaggcagaatgagttcatgtgaaatttcaggatctgccatgactcagattcactttctgtaaaccagagtcaacattacatttccctttactctgggccattccttgaatttttaggtcaccagttgtttttgtactaactgaagggatttgagtatttcacaagcaccttatttttattagcatttttagggcattaccaatttgggacggatctgtagtgtgagagattgttgtcactcttagctccaaacataggttgactttatatattatttacatgttcagaattatactgtgtagaaattcaaatgaaacttgcaaaatacttttctggcaggaagccctggagaggatcgttcatggaaacaaggatgacgactggggtaagaaatgcaggtgactcgtgagtggtcagggagtggaagagaagacggctggaaggttttagcattcagaaaaaaaatggagacaactagagttgatctgaagattatggcagaattcaatattgggggaaagaaacaagatgggggttagaaattagaaacagcagagctccacaggttggaaaggttggaaaggatttgagcaagagaacaagaaggagcctgctaatagcaccctgggtttacatcaagagaagcacctggagagaattaactcgggaggaggtgggggcatgggaaaccttttcatctccaagagcgggcaggaacagcagctggcctgaacttgaaggtacaccaggtagcttgcgtgggccaggagaaggtgattctcttctatgcctctctccaacgccctgcttctgatgctgctcctctacctgtattgaggggaagatacatccctaagaagttccctgaaccccattctttgttgtggctaactggtccccttggaatttttctactaattttcaattccccctctcacctggtgaaatcttgaatcttactgttcaataaaagttcttctaccgaaa

SEQ ID NO: 55798 - DNA, 2475 bp, Homo sapiens
ctctctacacagaatcggctgttgagtgtgctctcagtggagctttggttttagctgttctctgacaaagagcttgttctgagctgcacatctcgtcctctttgttcagcctcaggcttcaagcattgaatcctaaatattctccagctgggaatcagacaagggcagaaatgaagaacccagaagcccagcaggatgtttcagtttcccagggatttcgcatgttgttttacacgatgaaacccagtgaaacttcattccaaacattagaagaggtgcctgattatgtaaaaaaggcaactccatttttcatttctttgatgctgcttgaacttgttgtcagctggattctcaaaggaaagccaccaggtcgcctggatgatgctttaacgtcaatctcagctggtgttctgtctcgacttccaagtctatttttcaggagcattgaactgaccagttatatttatatctgggagaactacaggctgttcaatttgccttgggattctccatggacttggtattcagccttcttaggagttgactttggctactactggttccatcgtatggctcatgaagttaatattatgtgggccggacaccaaacacatcatagttctgaagactataacttatccacagcactgagacagtctgtcctccagatatatacttcctggattttctactctcccctggccctcttcatacccccttcagtatatgctgttcatcttcaattcaatcttctttaccaattttggatccatacagaggtcatcaataaccttggtcctttggaactgattcttaatactcctagccatcatagggttcatcatggcagaaatcgttattgcatagacaaaaattatgctggtgttcttattatttgggataaaatttttgggacatttgaagcagaaaatgaaaaagttgtatatggcttaacacatcccattaatacatttgaaccaatcaaagtgcagttccatcacttattttccatatggactacattctgggccacacctggattcttcaataagttttctgtcatatttaagggaccgggatggggtccaggtaaaccaagacttggtctcagtgaagaaattccagaggtcaccggcaaagaagttcccttctcatcatcttcatctcagctattaaagatatatacagttgtacagtttgctctgatgttggcattttatgaagagacctttgcagatacagctgcactgtcgcaagttactctccttctgagggtttgcttcattatcctgaccttgacttccattggatttcttctggatcaaagacccaaggcagctattatggaaactctccgttgcttgatgttcttaatgctgtaccgatttggtcacctgaagcctcttgtcccttcattgtcatctgcttttgagattgttttttccatttgcattgctttctggggagttagaagcatgaaacaactcacctctcacccttggaaataacctgaatttgtacataattctcttcttttaatgagttgtccacacgcatattatgactgcatattaaaatgtaattattttatgtaatgcttatatgaactatttcttcaatgaaaagtaaaattacttatttactattgtttgcctttcacatttgttattttctattaaaaattaaagtcagttttggttacttcccccctttactacaattaaaaaaagatttcaaatataatgatgttatattaactgatagccttatatgacaagtataaaaagaagggatgaaacttaaaaacagtaaaaacaagaaggaatattgcctttacatcaatttgaaaacaatgtttcctttgatgtttgctaaaattatgcatagatacatgtttgtagtcataaaaatgtattacattggttgtcttcctaaggccacagttacctttgcaatccatataacctaagaagctgcattccagaaaaagacatcactgaggccaggcgcggtggctcacccctgtaatcccagcactttgtggggctgaggtgggcggatcatgaggtccagagatagagaccatcctggccaacatggtgaagtcctgtctctactaaaaatataaaaatttagctggacatggtggtgtgcgcctgtagtcccagctactctggaggctgaggcaggagaatcgcttgaacctgggaggcagaagttggagtgagtggagattgcaccactgcactccagcctgggcgacagagcgagactccgtctcaaagaaaaaagacatcactgaaagaaaaatgaacagaatttgtcagaattagttttttcaacaggttactttgtcatacatttctctaatatgcttggtcaatttgttttggcagactgggcagcatgcagcaattctgcattatttaaagttatcagaacaatgttaattctctaaataaaattacccaaggt

SEQ ID NO: 55799 - DNA, 2428 bp, Homo sapiens
gcatttggggctgaagttccctgtgggaggctgttttctgagggagctgagtgtttacagccactcagccctgctctgctcagctgaagcagaaaacagagaccttttgcattactttggttcaagagcaagacaggaggcgactgcatgagaccatggctgagacacctagtcctccaggcactgaggaactccagggcattctgtgggtctcatgggaagccagcacctctacctgttcctcagaagatcgtggccacctgggaagccatcagcctgggaaggcagctggtgcctgagtacttcaacttcgcccatgatgtgctggatgtgtggagtcggctggaagaggctggacaccgccccccaaatcctgccttctggtgggtcaatggcacaggagcagagatcaagtggagctttgaggagctggggaagcagtccaggaaggcagccaatgtgctggggggtgcatgcggcctgcagcctggggacagaatgatgctggtactcccacggctcccggagtggtggctggtcagtgtggcttgcatgcggacagggactgtgatgattccgggtgtgactcagctgacagagaaggacctcaagtaccggctgcaggcgtccagggccaagtccattatcaccagtgactccctagctccaagggtggatgccatcagtgccgaatgcccctccctccagaccaagctgctggtgtcagacagcagtcggccaggctggttgaacttcagggaactcctccgggaggcttctacagagcacaactgcatgaggacaaagagtcgagacccgctggccatctactttaccagcggaaccaccggggcccccaagatggtcgagcactcccagagcagctacggactgggttttgtggccagcggaagacggtgggtggccttgaccgaatctgacatcttctggaacacgactgacactggctgggtgaaggcagcctggactctcttctctgcctggcctaatggatcttgcatttttgtgcatgagctgccccgagttgatgccaaagttatcctgaatactctctccaaattcccgataaccaccctctgctgtgtcccaaccatctttcggctgcttgtgcaggaggatctgaccaggtaccagtttcagagcctgaggcactgtctgaccggaggagaggccctcaaccctgacgtgagggagaagtggaaacaccagactggtgtggagctgtacgaaggctatggccagtctgaaacggttgtcatctgtgccaatccaaaaggcatgaaaatcaagtctggatccatggggaaggcgtccccaccctacgatgtgcagattgtggatgatgagggcaacgtcctgcctcctggagaagaggggaatgttgccgtccgtatcagacccactcggcccttctgtttcttcaattgctatttggacaatcctgagaagacagctgcatcagaacaaggggacttttacatcacaggggaccgagctcgcatggacaaggatggctacttttggttcatgggaagaaacgacgatgtgatcaattcttcaagctaccggatcgggcctgttgaagtggaaagtgccctggcagagcatcctgctgtcctggagtcggctgtggtcagcagcccagaccccatcaggggagaggtggtaaaggcatttatagtccttactccagcctactcctctcatgacccagaggcactaacgcgggaactccaggagcatgtgaaaagggtgactgctccatacaaataccccaggaaggtggcctttgtttcagaactgccaaagacggtttctggaaagatccaaaggagtaaattgcgaagtcaggagtgggggaaatgaggtgcaccccaggaaggccccgtagacctccgaagactccacaagaaactaatggatcactggtcagtccccatggggagcatcatctcttcgaccctaaagatgtcaaaggtgtgcagcttccaaacggcatccccaggatcactgggcaatgctggaaagagcaaaagaatatcattggccctgatcacatagatgctgcgccgcctagcaaatgcttggtggttcgacttctccctctgtctgggggcaggctcagcatctgcccactggtctcactaagagctttcagatttccctccataggacaggttaccatagacttggggcacttgtgggtactcattttctgccagtgggaatgtaaaggcttcatcctttgtatgtaaccatttggcaaaagtatgcaggaacataaaataaaatatcctttagctcagaaattctatcttcgggagtcaccacaaaagaaaaaaatcaaaatgcagaaaatgtgtggtgcactaagatgatcacacagcattaaaactaaaaaaaaaaa

SEQ ID NO: 55800 - DNA, 2070 bp, Homo sapiens
tttctctttcaaactgcccagacggttggacaggacgtagacacacagaagaaaagaagacaaagaacgggtaggaaaattaaaaaggttaccatggggaagaaagtggccatcattggagctggtgtgagtggcttggcctccatcaggagctgtctggaagaggggctggagcccacctgctttgagaagagcaatgacattgggggcctgtggaaattttcagaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagaaaagaacctcctgaagtacatacaatttaagacatttgtatccagtgtaaataaacatcctgattttgcaactactggccagtgggatgttaccactgaaagggatggtaaaaaagaatcggctgtctttgatgctgtaatggtttgttccggacatcatgtgtatcccaacctaccaaaagagtcctttccaggactaaaccactttaaaggcaaatgcttccacagcagggactataaagaaccaggtgtattcaatggaaagcgtgtcctggtggttggcctggggaattcgggctgtgatattgccacagaactcagccgcacagcagaacaggtcatgatcagttccagaagtggctcctgggtgatgagccgggtctgggacaatggttatccttgggacatgctgctcgtcactcgatttggaaccttcctcaagaacaatttaccgacagccatctctgactggttgtacgtgaagcagatgaatgcaagattcaagcatgaaaactatggcttgatgcctttaaatggagtcctgaggaaagagcctgtatttaacgatgagctcccagcaagcattctgtgtggcattgtgtccgtaaagcctaacgtgaaggaattcacagagacctcggccatttttgaggatgggaccatatttgagggcattgactgtgtaatctttgcaacagggtatagttttgcctaccccttccttgatgagtctatcatcaaaagcagaaacaatgagatcattttatttaaaggagtatttcctcctctacttgagaagtcaaccatagcagtgattggctttgtccagtcccttggggctgccattcccacagttgacctccagtcccgctgggcagcacaagtaataaagggaacttgtactttgccttctatggaagacatgatgaatgatattaatgagaaaatggagaaaaagcgcaaatggtttggcaaaagcgagaccatacagacagattacattgtttatatggatgaactctcctccttcattggggcaaagcccaacatcccatggctgtttctcacagatcccaaattggccatggaagtttattttggcccttgtagtccctaccagtttaggctggtgggcccagggcagtggccaggagccagaaatgccatactgacccagtgggaccggtcgttgaaacccatgcagacacgagtggtcgggagacttcagaagccttgcttctttttccattggctgaagctctttgcaattcctattctgttaatcgctgttttccttgtgttgacctaatcatcattttctctaggatttctgaaagttactgacaatacccagacaggggctttgctatttaaaaattaaaattttcacaccacctgcttttctattcagcatcttttgcagtactctgtagacattagtcagtaatacagtgttatttctaggctctgaaatagccactttaagaatcatgtcatgatcttaagagagcactaatcatttctgtttgagttccactaacacttcaaaatcagaactatgttctttatatctaacttaaatcatttcctgaaacattttgacatgattcctttttccttttaaacaatgtatgaaagatgtattttaaatctaaataaagagcaaattaagcagaataattataaa

SEQ ID NO: 55801 - DNA, 2053 bp, Homo sapiens
tttctctttcaaactgcccagacggttggacaggacgtagacacacagaagaaaagaagacaaagaacgggttaccatggggaagaaagtggccatcattggagctggtgtgagtggcttggcctccatcaggagctgtctggaagaggggctggagcccacctgctttgagaagagcaatgacattgggggcctgtggaaattttcagaccatgcagaggagggcagggctagcatttacaaatcagtcttttccaactcttccaaagagatgatgtgtttcccagacttcccatttcccgatgacttccccaactttatgcacaacagcaagatccaggaatatatcattgcatttgccaaagaaaagaacctcctgaagtacatacaatttaagacatttgtatccagtgtaaataaacatcctgattttgcaactactggccagtgggatgttaccactgaaagggatggtaaaaaagaatcggctgtctttgatgctgtaatggtttgttccggacatcatgtgtatcccaacctaccaaaagagtcctttccaggactaaaccactttaaaggcaaatgcttccacagcagggactataaagaaccaggtgtattcaatggaaagcgtgtcctggtggttggcctggggaattcgggctgtgatattgccacagaactcagccgcacagcagaacaggtcatgatcagttccagaagtggctcctgggtgatgagccgggtctgggacaatggttatccttgggacatgctgctcgtcactcgatttggaaccttcctcaagaacaatttaccgacagccatctctgactggttgtacgtgaagcagatgaatgcaagattcaagcatgaaaactatggcttgatgcctttaaatggagtcctgaggaaagagcctgtatttaacgatgagctcccagcaagcattctgtgtggcattgtgtccgtaaagcctaacgtgaaggaattcacagagacctcggccatttttgaggatgggaccatatttgagggcattgactgtgtaatctttgcaacagggtatagttttgcctaccccttccttgatgagtctatcatcaaaagcagaaacaatgagatcattttatttaaaggagtatttcctcctctacttgagaagtcaaccatagcagtgattggctttgtccagtcccttggggctgccattcccacagttgacctccagtcccgctgggcagcacaagtaataaagggaacttgtactttgccttctatggaagacatgatgaatgatattaatgagaaaatggagaaaaagcgcaaatggtttggcaaaagcgagaccatacagacagattacattgtttatatggatgaactctcctccttcattggggcaaagcccaacatcccatggctgtttctcacagatcccaaattggccatggaagtttattttggcccttgtagtccctaccagtttaggctggtgggcccagggcagtggccaggagccagaaatgccatactgacccagtgggaccggtcgttgaaacccatgcagacacgagtggtcgggagacttcagaagccttgcttctttttccattggctgaagctctttgcaattcctattctgttaatcgctgttttccttgtgttgacctaatcatcattttctctaggatttctgaaagttactgacaatacccagacaggggctttgctatttaaaaattaaaattttcacaccacctgcttttctattcagcatcttttgcagtactctgtagacattagtcagtaatacagtgttatttctaggctctgaaatagccactttaagaatcatgtcatgatcttaagagagcactaatcatttctgtttgagttccactaacacttcaaaatcagaactatgttctttatatctaacttaaatcatttcctgaaacattttgacatgattcctttttccttttaaacaatgtatgaaagatgtattttaaatctaaataaagagcaaattaagcagaataattataaa

SEQ ID NO: 55802 - DNA, 3095 bp, Homo sapiens
tagcagagcaatcaccaccaagcctggaataactgcaagggctctgctgacatcttcctgaggtgccaaggaaatgaggatggaggaaggaatgaatgttctccatgactttgggatccagtcaacacattacctccaggtgaattaccaagactcccaggactggttcatcttggtgtccgtgatcgcagacctcaggaatgccttctacgtcctcttccccatctggttccatcttcaggaagctgtgggcattaaactcctttgggtagctgtgattggagactggctcaacctcgtctttaagtggattctctttggacagcgtccatactggtgggttttggatactgactactacagcaacacttccgtgcccctgataaagcagttccctgtaacctgtgagactggaccagggagcccctctggccatgccatgggcacagcaggtgtatactacgtgatggtcacatctactctttccatctttcagggaaagataaagccgacctacagatttcggtgcttgaatgtcattttgtggttgggattctgggctgtgcagctgaatgtctgtctgtcacgaatctaccttgctgctcattttcctcatcaagttgttgctggagtcctgtcaggcattgctgttacagaaactttcagccacatccacagcatctataatgccagcctcaagaaatattttctcattaccttcttcctgttcagcttcgccatcggattttatctgctgctcaagggactgggtgtagacctcctgtggactctggagaaagcccagaggtggtgcgagcagccagaatgggtccacattgacaccacaccctttgccagcctcctcaagaacctgggcacgctctttggcctggggctggctctcaactccagcatgtacagggagagctgcaaggggaaactcagcaagtggctcccattccgcctcagctctattgtagcctccctcgtcctcctgcacgtctttgactccttgaaacccccatcccaagtcgagctggtcttctacgtcttgtccttctgcaagagtgcggtagtgcccctggcatccgtcagtgtcatcccctactgcctcgcccaggtcctgggccagccgcacaagaagtcgttgtaagagatgtggagtcttcggtgtttaaagtcaacaaccatgccagggattgaggaggactactatttgaagcaatgggcactggtatttggagcaagtgacatgccatccattctgccgtcgtggaattaaatcacggatggcagattggagggtcgcctggcttattcccatgtgtgactccagcctgccctcagcacagactctttcagatggaggtgccatatcacgtacaccatatgcaagtttcccgccaggaggtcctcctctctctacttgaatactctcacaagtagggagctcactcccactggaacagcccattttatctttgaatggtcttctgccagcccattttgaggccagaggtgctgtcagctcaggtggtcctcttttacaatcctaatcatattgggtaatgtttttgaaaagctaatgaagctattgagaaagacctgttgctagaagttgggttgttctggattttcccctgaagacttacttattcttccgtcacatatacaaaagcaagacttccaggtagggccagctcacaagcccaggctggagatcctaactgagaattttctacctgtgttcattcttaccgagaaaaggagaaaggagctctgaatctgataggaaaagaaggctgcctaaggaggagtttttagtatgtggcgtatcatgcaagtgctatgccaagccatgtctaaatggctttaattatatagtaatgcactctcagtaatgggggaccagcttaagtataattaatagatggttagtggggtaattctgcttctagtattttttttactgtgcatacatgttcatcgtatttccttggatttctgaatggctgcagtgacccagatattgcactaggtcaaaacattcaggtatagctgacatctcctctatcacattacatcatcctccttataagcccagctctgctttttccagattcttccactggctccacatccaccccactggatcttcagaaggctagagggcgactctggtggtgcttttgtatgtttcaattaggctctgaaatcttgggcaaaatgacaaggggagggccaggattcctctctcaggtcactccagtgttacttttaattcctagagggtaaatatgactcctttctctatcccaagccaaccaagagcacattcttaaaggaaaagtcaacatcttctctctttttttttttttttgagacagggtctcactatgttgcccaggctgctcttgaattcctgggctcaagcagtcctcccaccctaccacagcgtcccgcgtagctggcatacaggtgcaagccactatgtccagctagccaactcctccttgcctgcttttctttttttttctttttttgagacggcgcacctatcacccaggctggagtggagtggcacgatcttggctcactgcaacctcttcctcctggttcaagcgattctcatgtctcagcctcctcagtagctaggactaccggcgtgcaccaccatgccaggctaatttttatatttttagaattttagaagagatgggatttcatcatgttggccaggctggtctcgaactcctgacctcaagtgatccacctgccttggcctcccaaggtgctaggattacaggcatgagccaccgcaccgggccctccttgcctgtttttcaatctcatctgatatgcagagtatttctgccccacccacctaccccccaaaaaaagctgaagcctatttatttgaaagtccttgtttttgctactaattatatagtataccatacattatcattcaaaacaaccatcctgctcataacatctttgaaaagaaaaatatatatgtgcagtattttattaaagcaacattttatttaagaataaagtcttgttaattactatattttagatgcaatgtgatc

SEQ ID NO: 55803 - DNA, 2001 bp, Homo sapiens
agtctgtataaaaagcaattgctcttttgtttccaaaacaggtattacaagtggataaataatgtgcactgctctgagcccaaaggtacgcagtggacctggcctctctgatatgcatcagtatagccaatggctagccagcagacatgaagctaatttgctaccaatgaaagaagatctggccttgtggttaaccaatctattagggaaggagattacagcagaaacttttatggagaagttggacaatggtgccttgctctgtcaacttgcagaaactatgcaggagaaattcaaggagagcatggatgctaacaagcccacaaagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttggtcctccacaagcaacccagagaagtgtgtctctgtctgctagagcttggccggattgcagccaggtatggtgtggagcctcctggtttgataaagctggaaaaagagattgaacaagaagaaacactttctgccccttctccttcaccttctccttcatcaaagtcttctggaaaaaagagtacaggaaacttactggatgatgcagtgaaacgaatttctgaagatcctccttgcaaatgcccaaacaagttctgtgtggagcggctctcccaaggaagataccgagtgggagaaaagatcctcttcattaggatgctgcacaacaaacatgtcatggtccgtgtgggaggaggctgggaaacttttgcagggtatttgttgaaacacgacccctgccgaatgctgcagatctcccgtgtggatggcaaaacatcccctatccaaagcaaatctccaactctaaaggacatgaatccagataactacttggtggtctctgccagttataaggctaagaaggaaattaagtgaaacaaattggtcatgacaaggggaccctcataatggcctgtatccacttctccagtatagtcagtttagttcatatgttctgaaaactgttttggagaaagatagacagaaaaatgtcatcatattgaaaaatgttcaaagagtagcactatttatttttaatgcttctgtagaatatgacctattaaaagaaaatctaaactcaaatttaaattatccaaattttaggcaaattattatttctcaatatgcgaacacagtatttagaacacaatattagaaacacaattctaactaaagataaataaggagaaaacatttaggatttgcagataagtcaacagaaagtgcctgctttacactcatgagtaaaagcactccagacatttttataattgcaagatttttatgctttttttttttttttttacaaaatgatgattagtgtgataatgtgctgcaaaaaatatccaacagcactacacataagtacagagtattcacaatagtaatatgttactggaaaggccacttccgaaaagtttacattcacttggaaggctgccttaaagtatatctcttatctatgaccaaatatctggggtacttttagaagttttcagtacacccccttagagaatagcttatgagttatttcacacattcctgagcacatggctgtgtttagaatgatctagtgtaattcatacatgagctgacatacgttgatactttgacgagtaaattgtacagtcaaatgttcattgatttcatgttatttcaaagcattttcttattaaaaatatatctttagttaatcctattttgctatgctttctagtaaagtaaattcactgtagctaatgatgttacagacttacgtatacccttgtatacctgggacagggctgttttataccaataaacagcaaaatattgtccttactcattcaagaattaaaaggataaattttaaaaatgttaaaaaaaaaaaaaaa

SEQ ID NO: 55804 - DNA, 2196 bp, Homo sapiens
gagattcacagaggcaaggcagagaacaagacctgtgcttctttactccaaactcttagcagtgtggacactgattaactgcagctggggtctgatttgcccagcctgtctttgatattgatcaatgaactccttctcaaggaatgctttcctctaactgcggtgaaggtggtggctctggtggttctctccaacatgggtgtctgggttttgactgcctaagagaaggtattacaagtggataaataatgtgcactgctctgagcccaaaggtacgcagtggacctggcctctctgatatgcatcagtatagccaatggctagccagcagacatgaagctaatttgctaccaatgaaagaagatctggccttgtggttaaccaatctattagggaaggagattacagcagaaacttttatggagaagttggacaatggtgccttgctctgtcaacttgcagaaactatgcaggagaaattcaaggagagcatggatgctaacaagcccacaaagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttggtcctccacaagcaacccagagaagtgtgtctctgtctgctagagcttggccggattgcagccaggtatggtgtggagcctcctggtttgataaagctggaaaaagagattgaacaagaagaaacactttctgccccttctccttcaccttctccttcatcaaagtcttctggaaaaaagagtacaggaaacttactggatgatgcagtgaaacgaatttctgaagatcctccttgcaaatgcccaaacaagttctgtgtggagcggctctcccaaggaagataccgagtgggagaaaagatcctcttcattaggatgctgcacaacaaacatgtcatggtccgtgtgggaggaggctgggaaacttttgcagggtatttgttgaaacacgacccctgccgaatgctgcagatctcccgtgtggatggcaaaacatcccctatccaaagcaaatctccaactctaaaggacatgaatccagataactacttggtggtctctgccagttataaggctaagaaggaaattaagtgaaacaaattggtcatgacaaggggaccctcataatggcctgtatccacttctccagtatagtcagtttagttcatatgttctgaaaactgttttggagaaagatagacagaaaaatgtcatcatattgaaaaatgttcaaagagtagcactatttatttttaatgcttctgtagaatatgacctattaaaagaaaatctaaactcaaatttaaattatccaaattttaggcaaattattatttctcaatatgcgaacacagtatttagaacacaatattagaaacacaattctaactaaagataaataaggagaaaacatttaggatttgcagataagtcaacagaaagtgcctgctttacactcatgagtaaaagcactccagacatttttataattgcaagatttttatgctttttttttttttttttacaaaatgatgattagtgtgataatgtgctgcaaaaaatatccaacagcactacacataagtacagagtattcacaatagtaatatgttactggaaaggccacttccgaaaagtttacattcacttggaaggctgccttaaagtatatctcttatctatgaccaaatatctggggtacttttagaagttttcagtacacccccttagagaatagcttatgagttatttcacacattcctgagcacatggctgtgtttagaatgatctagtgtaattcatacatgagctgacatacgttgatactttgacgagtaaattgtacagtcaaatgttcattgatttcatgttatttcaaagcattttcttattaaaaatatatctttagttaatcctattttgctatgctttctagtaaagtaaattcactgtagctaatgatgttacagacttacgtatacccttgtatacctgggacagggctgttttataccaataaacagcaaaatattgtccttactcattcaagaattaaaaggataaattttaaaaatgttaaaaaaaaaaaaaaaaaaaaaaa

SEQ ID NO: 55805 - DNA, 2418 bp, Homo sapiens
aagaaaaaaagtgggagaaatcagtgcagccaaattcagaactaaagagaagagaataaagactcataactttctcattgaagctgccttcttaccaagtccagaggatctctactctggacagaggaacgccctgaacatggcatcagagatccacatgccaggcccagtgtgcctcattgagaacactaaagggcatctggtggtgaattcagaagctctggaaatcctgtctgccattacacagcctgtagtagtggtggcaattgtgggcctctaccgcacaggcaaatcctacctaatgaacaagctggctgggaagaacaaaggcttccctctgggctgcacagtgaagtctgaaaccaaaggcatctggatgtggtgtgtgccccacccctccaagccaaaccacaccctgatccttctggacacggagggcctgggtgatatggaaaagagtgaccctaagagtgactcgtggatctttgccctggctgtgcttctaagcagcagctttgtctacaacagcatgggcaccatcaaccaccaggccctggagcagctgcactacgtgactgagctaacagagctaatcagggcaaaatcgtgccccagacctgatgaagttgaggactccagcgagtttgtgagtttctttccagactttatttggactgttcgagattttaccctggagctgaagttagatggacaccccatcacagaagatgagtacctggagaatgccttgaagctgatttcaggcaagaatccccaaatccaaaattctaacaagcccagggagtggatcaggcatttctttccaaaacagaagtgctttgtctttgaccggccaataaatgacaaaaaactcttactccatgttgaagaagtacgagaagaccaactggatagtaatttccagatgcaatcagaaaatttctgttcttatatcttcacccatgcaaagaccaagaccctgagagagggaatccttgtcactggaaaccggctggggatgctggtggagacctacctggatgccatcaacagtggagcgactccttgtctggagaatgcaatggcagttctggcccagtgtgagaactcagcagccgtgcagagggcagccaaccactacagccagcagatggcccagcaagtgagattccccacagacacactccaggagctgctggacgtgcatgcagtttgtgagagggaagccattgcagtcttcatggagtactccttcaaagataaaagccaggaatttcagaagaagcttgtggacaccatggagaaaaagaaggaagactttgtgctgcagaatgaagaggcatctgccaaatattgtcaggctgagcttaagcggctttcagagctcttgacagaaagtatttcaagaggaactttctttgttccgggggggcacaatatctacttagaagcaaaaaagaagattgaacaggactatacactagtgcccagaaaaggagttaaggcagacgaggtcctccagagcttcctgcagtcacaggtggttatagaggaatccatcctgcagtcagacaaagccctcactgctggagagaaggccatagcagctaagcaggctaagaaggaggcagctgaaaaggaacaggagctgctaagacaaaaacagaaggaacagcagcaaatgatggaggctcaagagagaagtttccaggaaaacatagctcaactcaagaagaagatggagagggaaagggaaaactatatgagagaactgagaaagatgttgagtcacaagatgaaggtcctagaagaactgcttactgaaggatttaaagagatatttgagtcgttaaatgaagagattaatcgactgaaagaacaaattgaagcagctgaaaatgaagagccctcagtgttttcacagattcttgatgtggctggcagtatatttattgcagcactacctggggctgctaagctagttgatttaggaatgaaaattcttagctcattatgtaataggctgagaaatcctggtaagaaaattataagctgaggtttcttttgttaaaatggtataacgctgttgctcattttaaaagtatatgtgttattgcagtttcatttaagaagagtttaaaattaaaaagcaaatttcaaagaatattatggcctgaagttcataaaaacaaacttaattttgactaaagtaataattaatagaaatggggaacaagttagaagataaaattattcctagaaaagatttaagtaaagcaaaaggacaaatggtaatataaagaaattattttcaattaatgttatagtcacagagataatttaagttataattagctcttgcaaatcagtgagaagagagtaacgccacatattttaaacaggcaaaaatatgataat

SEQ ID NO: 55806 - DNA, 1801 bp, Homo sapiens
tttaataataattctgtgttgcttctgagattaataattgattaattcatagtcaggaatctttgtaaaaaggaaaccaattacttttggctaccacttttacatggtcacctacaggagagaggaggtgctgcaagactctctggtagaaaaatgaagagggtcctggtactactgcttgctgtggcatttggacatgctttagagagaggccgggattatgaaaagaataaagtctgcaaggaattctcccatctgggaaaggaggacttcacatctctgtcactagtcctgtacagtagaaaatttcccagtggcacgtttgaacaggtcagccaacttgtgaaggaagttgtctccttgaccgaagcctgctgtgcggaaggggctgaccctgactgctatgacaccaggacctcagcactgtctgccaagtcctgtgaaagtaattctccattccccgttcacccaggcactgctgagtgctgcaccaaagagggcctggaacgaaagctctgcatggctgctctgaaacaccagccacaggaattccctacctacgtggaacccacaaatgatgaaatctgtgaggcgttcaggaaagatccaaaggaatatgctaatcaatttatgtgggaatattccactaattacggacaagctcctctgtcacttttagtcagttacaccaagagttatctttctatggtagggtcctgctgtacctctgcaagcccaactgtatgctttttgaaagagagactccagcttaaacatttatcacttctcaccactctgtcaaatagagtctgctcacaatatgctgcttatggggagaagaaatcaaggctcagcaatctcataaagttagcccaaaaagtgcctactgctgatctggaggatgttttgccactagctgaagatattactaacatcctctccaaatgctgtgagtctgcctctgaagattgcatggccaaagagctgcctgaacacacagtaaaactctgtgacaatttatccacaaagaattctaagtttgaagactgttgtcaagaaaaaacagccatggacgtttttgtgtgcacttacttcatgccagctgcccaactccccgagcttccagatgtagagttgcccacaaacaaagatgtgtgtgatccaggaaacaccaaagtcatggataagtatacatttgaactaagcagaaggactcatcttccggaagtattcctcagtaaggtacttgagccaaccctaaaaagccttggtgaatgctgtgatgttgaagactcaactacctgttttaatgctaagggccctctactaaagaaggaactatcttctttcattgacaagggacaagaactatgtgcagattattcagaaaatacatttactgagtacaagaaaaaactggcagagcgactaaaagcaaaattgcctgatgccacacccacggaactggcaaagctggttaacaagcactcagactttgcctccaactgctgttccataaactcacctcctctttactgtgattcagagattgatgctgaattgaagaatatcctgtagtcctgaagcatgtttattaactttgaccagagttggagccacccaggggaatgatctctgatgacctaacctaagcaaaaccactgagcttctgggaagacaactaggatactttctactttttctagctacaatatcttcatacaatgacaagtatgatgatttgctatcaaaataaattgaaatataatgcaaaccataaaaaaaaaaaaaaaaaaaaaaa

SEQ ID NO: 55807 - DNA, 2034 bp, Homo sapiens
ggatctggcagcgccgcgaagacgagcggtcaccggcgcccgacccgagcgcgcccagaggacggcggggagccaagccgacccccgagcagcgccgcgcgggccctgaggctcaaaggggcagcttcaggggaggacaccccactggccaggacgccccaggctctgctgctctgccactcagctgccctcggaggagcgtacacacacaccaggactgcattgccccagtgtgcagcccctgccagatgtgggaggcagctagctgcccagaggcatgcccccctgccagccacagcgacccctgctgctgttgctgctgctgctggcctgccagccacaggtcccctccgctcaggtgatggacttcctgtttgagaagtggaagctctacggtgaccagtgtcaccacaacctgagcctgctgccccctcccacggagctggtgtgcaacagaaccttcgacaagtattcctgctggccggacacccccgccaataccacggccaacatctcctgcccctggtacctgccttggcaccacaaagtgcaacaccgcttcgtgttcaagagatgcgggcccgacggtcagtgggtgcgtggaccccgggggcagccttggcgtgatgcctcccagtgccagatggatggcgaggagattgaggtccagaaggaggtggccaagatgtacagcagcttccaggtgatgtacacagtgggctacagcctgtccctgggggccctgctcctcgccttggccatcctggggggcctcagcaagctgcactgcacccgcaatgccatccacgcgaatctgtttgcgtccttcgtgctgaaagccagctccgtgctggtcattgatgggctgctcaggacccgctacagccagaaaattggcgacgacctcagtgtcagcacctggctcagtgatggagcggtggctggctgccgtgtggccgcggtgttcatgcaatatggcatcgtggccaactactgctggctgctggtggagggcctgtacctgcacaacctgctgggcctggccaccctccccgagaggagcttcttcagcctctacctgggcatcggctggggtgcccccatgctgttcgtcgtcccctgggcagtggtcaagtgtctgttcgagaacgtccagtgctggaccagcaatgacaacatgggcttctggtggatcctgcggttccccgtcttcctggccatcctgatcaacttcttcatcttcgtccgcatcgttcagctgctcgtggccaagctgcgggcacggcagatgcaccacacagactacaagttccggctggccaagtccacgctgaccctcatccctctgctgggcgtccacgaagtggtctttgccttcgtgacggacgagcacgcccagggcaccctgcgctccgccaagctcttcttcgacctcttcctcagctccttccagggcctgctggtggctgtcctctactgcttcctcaacaaggaggtgcagtcggagctgcggcggcgttggcaccgctggcgcctgggcaaagtgctatgggaggagcggaacaccagcaaccacagggcctcatcttcgcccggccacggccctcccagcaaggagctgcagtttgggaggggtggtggcagccaggattcatctgcggagacccccttggctggtggcctccctagattggctgagagccccttctgaaccctgctgggaccccagctagggctggactctggcacccagaggcgtcgctggacaacccagaactggacgcccagctgaggctgggggcgggggagccaacagcagcccccacctaccccccacccccagtgtggctgtctgcgagattgggcctcctctccctgcacctgccttgtccctggtgcagaggtgagcagaggagtccagggcgggagtgggggctgtgccgtgaactgcgtgccagtgtccccacgtatgtcggcacgtcccatgtgcatggaaatgtcctccaacaataaagagctcaagtggtcaccgtg

SEQ ID NO: 55808 - DNA, 2197 bp, Homo sapiens
attgtgaccagaggggtttgtgtggctgaagaggcaggaggaacagtgtatccacagcgtgggaccatgccaggcacaaaacggtttcaacatgtcattgagaccccggagcctggcaagtgggagttgtctgggtacgaggcagctgtgccaatcacggagaagtcaaacccactgacccaggatctagacaaagcagatgctgagaacattgttcgactgctagggcaatgtgatgctgagatcttccaggaggaggggcaagccctgtccacataccagagactctacagcgaatccattctgaccaccatggtacaggtggctgggaaagttcaggaagtgctgaaggagccagatggggggctggttgtgctgagtggagggggcacctctggccggatggcattcctcatgtcggtgtcctttaatcagctgatgaaaggtctgggacagaaacctctttacacctacctcattgcaggtggtgacaggtctgtggtggcctctagggaggggacagaagatagtgccttgcacgggattgaggaactgaagaaggtggctgccgggaagaagagagtgattgtcattggcatttctgtgggactctctgctccctttgtggcaggccagatggactgctgcatgaacaacacagctgtcttcttgccagtcctggttggcttcaatccagtgagcatggccagaaatgaccccattgaagactggagttcaacattccgacaagtagcagagcggatgcagaaaatgcaggagaaacagaaagcttttgtgctcaatcctgccatcgggcccgagggtctcagcggctcctcccggatgaaaggtggaagtgccaccaagattctgctggaaaccctgttattagcagcccataagactgtggaccagggcattgcagcatctcaaagatgcctcctggaaatcttgcggacatttgagcgagctcatcaggtgacctacagccaaagccccaagattgccaccctgatgaagagtgtcagcaccagtctggagaagaaaggccacgtgtacctggttggctggcagaccctgggcatcattgccatcatggatggagtagagtgcatccacacctttggtgctgatttccgagatgtccgtggctttctcattggtgatcacagtgacatgtttaaccagaaggctgagctcaccaaccagggtccccagttcaccttctcccaggaggacttcctgacttccatccttccctctctcacggaaatcgatactgtggtcttcattttcaccctggatgacaacctcacggaggtgcagactatagtggagcaggtgaaagagaagaccaaccacatccaggccctggcacacagcaccgtgggtcagaccttgccgatccctctgaagaagctctttccctccatcatcagcatcacatggccactgcttttctttgaatatgaagggaacttcatccagaagttccagcgtgagctaagcaccaaatgggtgctgaatacagtgagtacaggtgctcatgtgcttcttggtaagatcctacaaaaccacatgttggaccttcggattagcaactccaagctcttctggcgggcgctggccatgctgcagcggttctctggacagtccaaggctcgatgcatcgagagcctcctccgagcgatccactttccccagccactgtcagatgatattcgggctgctcccatctcctgccatgtccaggttgcacatgagaaggaacaggtgatacccatcgccttgctgagcctcctattccggtgctcgatcactgaggctcaggcacacctggctgcagctccttctgtctgtgaggctgtcaggagtgctcttgctgggccaggtcagaagcgcactgcggaccccctcgagatcctagagcctgacgttcagtgaacccatgtttctgggtgggtgaaaggggcccaaccctgcccacttcagcccagcccgcccaaggggacttgtgccagcagaacatgtgggaggaagaagccccgtttccagggcatccgcagcccagggtagggagaaatattctctccactttgggggagagttcttgctctcgacctagtggtttctactctcaccgacttattctgatttcagaaataaaatgaaatgtcttattttggaaaaaaaaaaa

SEQ ID NO: 55809 - DNA, 1638 bp, Homo sapiens
gcggtgatgaattgggacgcaggcgcggagcccagggaccactccccctgcacagacatgagaccataggggacctgtctgggtggcctcagggataggcgctccccaaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagccaaaaaaaaaaaaaaaaaaaaaaa

SEQ ID NO: 55810 - DNA, 1157 bp, Homo sapiens
agaaatttctggaggtggtgtatcaaaatttactctgcgagactctgctgaactggctgcatcagggagaaatttcatctcccagaagggtgttgctcatcgtttcttcccggaaacatctgcagagactagcttttcaggctaaggtatcctccatgatgttaccattgcaaggtgcccagatgctgcagatgctggagaaatccttgaggaagagcctcccagcatccttaaaggtttatggaactgtctttcacataaaccatggaaatccattcaatctgaaggctgtggtggacaagtggcctgattttaatacagtggttgtctgccctcaggagcaggatatgacagatgaccttgatcactataccaatacttaccaaatctactccaaagatccccaaaactgtcaggaattccttggatcaccagaactcatcaactggaaacagcatttacagattcaaagttcacagcctagcctgaatgaggctatacaaaatcttgcagccattaagtccttcaaagtcaaacaaacacaacgcattctctatatggcagctgaaacagccaaggaactgactcctttcctgctgaaatcaaagattttatctcccagtggtggcaaacccaaggccatgtgagtttgataaaatccagtctataccactcacacctctcaagtaacctcccaacttctctccctgcattcactctggctttcctacaatcaatgttgtacaaagaaatcagaattacatttttaaaaaatgtaactcagaacatgtttctctcctgcttaaaagactccaccatctcccttctcatctagaataaaccaggcctctggctaccacttggacctttattgcccttcctgctttcttcctccaacagctctgaccttcactctgttcctctttcatcacaagctcatctatattccaggacttcacatttgttatttcttctgtctactctgtctctcaagacaatagaggtcacagcaaatacaaacctttatactaatggattttgttttcttcttggaccctccatagcaaccaagagatgtttaaactctcatccatggatgttacccatgctcacttggtgaataaattctggcattttggtggtaaaaaaaaaaaaaa

SEQ ID NO: 55811 - DNA, 2068 bp, Homo sapiens
agtgttggccaatcccagcagccatacttcaactactcatagactgctgaatgttcaaactgtgttcaaataagatggtgtcacaagaaggatctgaagtggagcttctagtatccccaggagcgcgaagtgaacacggaaggtacctgcaggatccaattgtgtccattgatctctcagagtggctgaggataatagagtttcttcttcaaggtctcaaggtgtatggctctgtgtatcacatcaatcacgggaaccccttcaacatggaggtgctggtggattcctggcctgaatatcagatggttattatccggcctcaaaagcaggagatgactgatgacatggattcatacacaaacgtatatcgtatgttctccaaagagcctcaaaaatcagaagaagttttgaaaaattgtgagatcgtaaactggaaacagagactccaaatccaaggtcttcaagaaagtttaggtgaggggataagagtggctacattttcaaagtcagtgaaagtagagcattcgagagcactcctcttggttacggaagatattctgaagctcaatgcctccagtaaaagcaagcttggaagctgggctgagacaggccacccagatgatgaatttgaaagtgaaactcccaactttaagtatgcccagctggatgtctcttattctgggctggtaaatgacaactggaagcgagggaagaatgagaggagcctgcattacatcaagcgctgcatagaagacctgccagcagcctgtatgctcggcccagagggagtcccggtctcatgggtaaccatggacccttcttgtgaagtaggaatggcctacagcatggaaaaataccgaaggacaggcaacatggcacgagtgatggtgcgatacatgaaatatctgcgtcagaagaatattccattttacatctctgtgttggaagaaaatgaagactcccgcagatttgtggggcagtttggtttctttgaggcctcctgtgagtggcaccaatggacttgctacccacagaatctagttccattttagacaatgaagctgcttagtaatctctgccaagccatctcttaatattaaagcagacaccacagaatagatttcttcacttacaaatgcatattgggcacttataatacagcaggaactcttctcacctggagccttgatgttaaaagacacagccatgctcttgaggagcttacaatcctggctggaggcaggggagggtatattctttaaatatgcttaagtgttatagggaaagacggggttaccagtaaacatgtaactagaaagccaggctcagttcttacctctgggaatcagaactctttatgcaacttggttaatagaatctactatctggaagataaatgaaggattttaataaaattttcaatagaataaacctaatctgtatggatactttatcaaaaatgaatgtccctgctatttctggatttatgaggcaatggtacactaaagaatggaatcagttcagtgagtagaaaggtatccaaggtgaagcctgagacgaatggctttcccaggctaccttccatcactgttgtacagaaaagaaatccagagaatcaaatggactggccttgggggtctctgctatggaaatgccattttttgtgtctcctttctcctactctttctcacatcctcttcatgattgaagcatggcacaaggcaaggtgttgcctgcgagtctggttgtaagttcagcctttggtgtttgcactactgctatcataaggggtcagggacattccggggagaagtgaccactaaggtgaggattagagagtgagtagaagtgagccagacaaaaaaagcagaaaatgcagatgatggaaaggacatgtgccatgcactatcataagaacttcctaactgaacactgatactacaattctgaatccctgatcttaaaaaataattatacttcaccaacaaaacttggcctcttttggttccactctgccaccctgccattggaacttggattactgtgaacattgcagctatagcaaaat

SEQ ID NO: 55812 - DNA, 976 bp, Homo sapiens
tattgagaggaacaaagagcttataaatacattaggacctggaattcggttgtccagccacaaaggtgacagcatttaacaaagcttagagaaacctccaggagactgctaccatggcagagaagcccaagctccactactccaatatacggggcagaatggagtccatccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagaaagccctgattgatatgtatatagaaggtatagcagatttgggtgaaatgatccttcttctgccctttactcaacctgaggaacaagatgccaagcttgccttgatccaagagaaaacaaaaaatcgctacttccctgcctttgaaaaagtcttaaagagccacggacaagactaccttgttggcaacaagctgagccgggctgacattcacctggtggaacttctctactacgtggaagagcttgactctagccttatttccagcttccctctgctgaaggccctgaaaaccagaatcagtaacctgcccacagtgaagaagtttctacagcctggcagcccaaggaagcctcccatggatgagaaatctttagaagaatcaaggaagattttcaggttttaataaaccagccatagaggtcaagaacatgcaagaccagtattctaaagttttgcaacaattaagtgctttacctaagtgttgattgtgcctgttgtgaagctaatgaactctttcaaattatatgctaattaaataatacaactcctattcacccacttagttaaaattgatttcttctcattaggatctgatgt

SEQ ID NO: 55813 - DNA, 2912 bp, Homo sapiens
aaaggagtctcggaggactgtaagaagaatgcttcgaggccgatccctctctgtaacatccctgggtgggcttccccagtgggaagtcgaagaacttcctgtggaggagttactgctctttgaagttgcttgggaagtgaccaataaagttggaggcatctatactgtgattcagacaaaggccaaaacaacagcagatgaatggggagagaactattttctgataggtccatattttgagcataatatgaagactcaggtggaacagtgtgaacctgtaaatgatgctgtcagaagagcagtggacgcaatgaataagcatggctgccaggtgcattttggaagatggctgatagaaggaagtccttatgtggtactttttgacataggctattcagcttggaatctggacaggtggaagggtgacctctgggaagcatgcagtgtcggcattccttatcatgaccgagaagccaatgatatgctgatatttggatctttaactgcctggttcttaaaagaggtgacagatcatgcagatggtaaatatgtcgttgcccaattccatgaatggcaggctggaattggactgatcctttctcgagccaggaaacttcctattgccacaatatttacaacccacgctacactacttgggaggtatctctgtgcagcaaatattgatttctacaaccatcttgataagtttaacattgacaaagaggctggggaaaggcagatttaccaccggtactgcatggagcgagcttccgttcattgcgctcacgtgttcaccacggtttctgaaataacagcaatagaagctgaacatatgctgaagagaaagcctgatgtagttactccaaacggcttgaatgttaagaaattttcagcagtgcatgagtttcaaaatctacatgccatgtacaaggccagaatccaagattttgttcgaggtcatttctatggtcatctcgactttgatcttgaaaagactttgttccttttcattgctgggaggtatgagttttcaaacaaaggagctgacatcttcctagaatccttatccaggctaaatttcctgctgaggatgcataaaagtgacatcacagtggtggtgtttttcattatgcctgccaagacaaataatttcaacgtggaaaccctgaaaggacaagcagtgcgaaaacagctgtgggatgttgcacattctgtgaaggaaaagtttggaaaaaaactctatgatgcattattaagaggagaaattcctgacctgaacgatattttagatcgagatgatctaacaattatgaaaagagccatcttttcaactcagcgacagtcattgcccccagtgaccacgcacaacatgattgatgactccaccgaccccatcctcagcaccattagacggattggacttttcaacaaccgcacagatagagtcaaggtgattttgcacccagagtttctatcctccaccagtcccttactacccatggactatgaagagtttgttagaggttgtcatcttggagtatttccatcatactatgaaccctggggttatactccagctgaatgcactgtgatgggtatccccagtgtgaccacgaatctctccgggtttggctgtttcatgcaggagcacgtggctgatcctactgcttacggtatttacatcgttgacaggcggttccgttctccagatgattcttgcaatcagctgactaagtttctctatggattttgcaaacagtcacgccgccaaaggattatccagaggaacagaactgagaggctctcagatcttctggattggagatacttaggcagatattaccagcatgccagacacctgacattaagcagagcttttccagataaattccatgtggaactaacatcaccaccaacgacagaaggatttaaatatcccaggccttcctcagtaccaccttctccttcagggtctcaggcctccagtcctcagagcagtgatgtggaagatgaagtggaggatgagagatacgatgaggaagaggaggctgaaagggatcggttaaatatcaagtcaccattttcactgagccacgttcctcatgggaagaaaaagctgcatggtgaatataagaactgaattcatgtgctgcatgaagagctaatttaaaaaagcaaagtaagactaattatttaaaataaaaatgccacaaatttcattttctccttctaagtattacaatggagtttattctctgcctaaaaagtggaagaaattgagtgaatgataattttgtaatttaggataagatccaagttattttccccaactcttgtttcccccataaagttaggcatgaggaggagcactcattaaaggcagaagacggaaaagtgtttttaaaatggtgaatttaagtggtaaggattttctcttactctgtttatttttaaatgatcatcataatcctttgcttactatttatgcagcttctctaccccaccacacaaatttcccatttcccccccgaaaaccttgatcttacccatgaatgtgcactacctacattttttaaatagctaggtttttactgattattttcatttttcacatgcatcagaaccatgatttagatgtagttttacagagacaaaaatccatgagtgaatagctatcctaagtccatattttgatgcatattaatggacatttatgtcacttttgaaatctagaattgatgttgtaattaatgcaagatattaccatgtacatggtaccaccatcttactgtaacatttttctattgtttaaatagaaagcctttttaaaatttggtcaatcttcatagatgataacttgtaaaatccaagtaaataaacacattaatatttaataacttaaaaaaaaaaaa

SEQ ID NO: 55814 - DNA, 3008 bp, Homo sapiens
cctgaatccttggagactgacatttttcccccctaaaggcatagacaacaaaagaaattttattgagaggaaaacacaagtccttaaactgcaaagatgtttgccaggatgtctgatctccatgttctgctgttaatggctctggtgggaaagacagcctgtgggttctccctgatgtctttattggaaagcctggacccagactggacccctgaccagtatgattacagctacgaggattataatcaggaagagaacaccagtagcacacttacccacgctgagaatcctgactggtactacactgaggaccaagctgatccatgccagcccaacccctgtgaacacggtggggactgcctcgtccatgggagcaccttcacatgcagctgcctggctcctttctctgggaataagtgtcagaaagtgcaaaatacgtgcaaggacaacccatgtggccggggccaatgtctcattacccagagtcctccctactaccgctgtgtctgtaaacacccttacacaggtcccagctgctcccaagtggttcctgtatgcaggccaaacccctgccagaatggggctacctgctcccggcataagcggagatccaagttcacctgtgcctgtcccgaccagttcaaggggaaattctgtgaaataggttctgatgactgctatgttggcgatggctactcttaccgagggaaaatgaataggacagtcaaccagcatgcgtgcctttactggaactcccacctcctcttgcaggagaattacaacatgtttatggaggatgctgaaacccatgggattggggaacacaatttctgcagaaacccagatgcggacgaaaagccctggtgctttattaaagttaccaatgacaaggtgaaatgggaatactgtgatgtctcagcctgctcagcccaggacgttgcctacccagaggaaagccccactgagccatcaaccaagcttccggggtttgactcctgtggaaagactgagatagcagagaggaagatcaagagaatctatggaggctttaagagcacggcgggcaagcacccatggcaggcgtccctccagtcctcgctgcctctgaccatctccatgccccagggccacttctgtggtggggcgctgatccacccctgctgggtgctcactgctgcccactgcaccgacataaaaaccagacatctaaaggtggtgctaggggaccaggacctgaagaaagaagaatttcatgagcagagctttagggtggagaagatattcaagtacagccactacaatgaaagagatgagattccccacaatgatattgcattgctcaagttaaagccagtggatggtcactgtgctctagaatccaaatacgtgaagactgtgtgcttgcctgatgggtcctttccctctgggagtgagtgccacatctctggctggggtgttacagaaacaggaaaagggtcccgccagctcctggatgccaaagtcaagctgattgccaacactttgtgcaactcccgccaactctatgaccacatgattgatgacagtatgatctgtgcaggaaatcttcagaaacctgggcaagacacctgccagggtgactctggaggccccctgacctgtgagaaggacggcacctactacgtctatgggatagtgagctggggcctggagtgtgggaagaggccaggggtctacacccaagttaccaaattcctgaattggatcaaagccaccatcaaaagtgaaagtggcttctaaggtactgtcttctggacctcagagcccactctccttggcaccctgacaccgggaggcctcatggccaacaatggacacctccagagcctccaggggaccacacagtagactatccctactctaagcagagacaactgccacccagcctgggccttcccagaccagcatttgcacaatatcaccaggcttcttctgcctcccttggtaacccaaggaatgatggaatcaacacaacatagtatgtttgctttccttacccaattgtaccttctagaaaatcagtgttcacagagactgcctccaccacaggcatcctgcaaatgcagactccagaatccccagcatcagcgggaaccaccatcacatctttattcctcagcccagacactcgaggcactcaacagaatcagccatccacgtctaggtatcagagaggaccacaaatacaacattctccatctgctttcagagttattattttaataaaggaagatctgggatgggctggtgggccattccagcttgccgaaatcaaagccatctgaagcctgtctctggtgaacaaacttcctctctggcctctcaggaatcagggtggcatggctcacaacagcagggccttcttctttttgacgtgcagaatctcagtggcatctgggttcacctccccactctgatgatctccagcctccactgcttctgccccccgctgctgaaatcaaacataccccaagttaaaatgaagctcccccacccccactcccggccccggttcccacaggacacgctaagaagcacagggagcatttaacaggctcaccctccctttccttttcccctcttctaccctccccaagaaaaagggccttcaaggcaggaatgagaaagcaaagccaatctctcatttagacctggcttctttcttctgaacaaagtagggttcaaaatgcagactgtcatatccagcgagtccctgaccctttctgcgaatgtaacgagcaagcagtcagcacagcctgggctgccctggcccgggattgatgtagccccggtaggtttgcctctgcagaactaatggctgtgacttcagagaaagccctgcaggaagtttaacctgcgtgtcatctgcctggtcatctcagacccatgaaattaggcgccttgtttgagctgcgtttcacacttctttagagctagctgacctttggccaaaaataaactttgaaaag

SEQ ID NO: 55815 - DNA, 3139 bp, Homo sapiens
acagacagaaacgagggaagagagagaaattggggaccctgaagaaagggggccagcagcaggtaggtgccatcagggacaagaacagcacctcccagggtgggagaccccaggcctttctggcagcaggtctggatggaaagtggacaggaggctcacccgtctgcatcccctgctcctgcccctgctcggctacaaaaaccaaagggacagcagctgaccacaccccggtagccactcctgcataaagctctcccctcctgtgaccagctgaggacctcaggctgcagcggagccatgcccagatacacggtgcacgtacgtggggaatggctggcagtgccctgccaggacgcgcagctcactgtgggctggctgggccgggaggccgtgaggcgctatatcaagaataagcccgacaatggtggcttcacctccgtggatgacgcgcacttccttgtgcgccggtgcaagggcctgggcctgctggacaacgaggaccggctcgaggtggccctagagaacaacgagttcgtggaagtggttatagagggtgatgccatgtctcctgacttcattccatctcaaccagaaggagtttatctatacagcaagtaccgggagcctgaaaagtacatcgagttagatggagaccgtctgaccacggaggatctggtcaacttgggaaagggacgctacaaaataaagctcaccccaacagctgagaagagggtgcagaaatccagggaggtcatagatagcatcataaaagagaaaacagttgtttacggtattactacaggttttgggaaatttgccagaactgtaattcctatcaataagctacaggagcttcaggtcaacttagtacgctcacattcttcaggtgttgggaaaccactaagtcctgagaggtgtcggatgctcttggctttaaggatcaatgtcttagccaaaggatacagtggcatttccctggagaccctcaaacaagtcatagaaatgtttaatgcctcctgcctgccctatgtcccagagaaaggaaccgttggtgccagtggagaccttgccccactctctcatcttgctcttgggctagttggagaagggaagatgtggtctccgaagagtggctgggctgatgctaaatacgtgctagaagcccatggattgaaaccagttattttaaaaccaaaagagggcctggcactcatcaatgggacgcagatgatcacatccctgggctgtgaagctgtagagcgagccagtgctattgcacggcaggctgacattgtggcagccctgacccttgaggtgctgaagggcaccaccaaagcctttgacactgacattcatgctcttcgacctcaccgtgggcaaattgaagttgcttttcggtttcggtcactcttggactcagatcaccacccatcagaaatagcagagagtcacaggttctgtgatcgcgtccaggatgcatacaccttgcgctgctgtccacaggtccatggtgtggtgaatgatacaatagcatttgtgaagaacatcattaccacagaactgaacagcgcaacagataatcctatggtctttgccaataggggagagacagtttctggaggaaacttccatggtgaatacccagccaaagccctagactacttggccattggcatccatgaacttgctgcaatcagtgagagaagaatcgagcggctctgcaatccctccctcagtgagctgcctgccttcctggtggctgaaggtggtctgaactctgggttcatgatagctcactgcacggcagcagcccttgtttctgagaacaaggctctgtgccatccctcgtctgttgactccctctccaccagcgcagccacggaggaccacgtctccatgggaggatgggcagcaaggaaagccctcagggtcatcgagcatgtggagcaagtgctggccatcgagctccttgcagcctgccagggcatagagtttctacgtcccctgaaaacaaccactccgctggagaaggtctatgacctggtgcgctctgttgtaaggccctggataaaagatcgcttcatggccccggacatcgaggcagcccacaggctgctcctggagcagaaggtttgggaagtagctgctccatacattgaaaaatacagaatggagcatattccagaatcaagacctctttctccaacagccttttcactgcaatttctgcacaagaaatccaccaaaatcccggagtctgaggacctttaatgggctttgtcatgaagtagcagatgagagggcagtcagtttagcacaaagcaatactaggctgaaggagagacctgagaactttcctaggtagatcaatccattgtatcattcagttcttctaaagcctacgttggttaggctgatggcagtattatagttgctaaattcagcactgtgttcctgttgtcgtggttcaagacccaccaggtattttcagattataaaacttttctttctttcttaacagtttcaacaggccactcactcttaagggtgagaagaataaccacaattgtatgtgcctgttttttactcttagcattagatgaattcaaatttggaaacagattgatagcaattttttctaaaaacattagacttttgttaacctttttttttttttttaaatttgcttcaacaagctctccaccagttgactttctttggctaattttactttgcatgatatgccttaatatgccttcataaataaccattttaagtcataatttgtccttaagctgcttttttcttctattaattggatcatagtaaagagtagtcaatagggtcttcagctattaattgtagaggtgattaaaaccaacaaggagtttcatgtgcaaaggagataaggaatgaatataaagattgctatttgggtggctcttattaaactgtgtattttgtacttatcactacacgtatcccccaaatgcttacatgggagtttgaggttagtattttcacttccttggtgttagtactctattcacattcttattgtaaccttcctcatttcacagataaggaatctttggggattaaccaacctcctttctgtaatggtaatcattaaaataag

SEQ ID NO: 55816 - DNA, 430 bp, Homo sapiens
gactgtcactcggtcccagacaccagagcaagctcaagacccagcagtgggacagccagacagacggcacgatggcactgagctcccagatctgggccgcttgcctcctgctcctcctcctcctcgccagcctgaccagtggctctgttttcccacaacagacgggacaacttgcagagctgcaaccccaggacagagctggagccagggccagctggatgcccatgttccagaggcgaaggaggcgagacacccacttccccatctgcattttctgctgcggctgctgtcatcgatcaaagtgtgggatgtgctgcaagacgtagaacctacctgccctgcccccgtcccctcccttccttatttattcctgctgccccagaacataggtcttggaataaaatggctggttcttttgttttccaaaaaa

SEQ ID NO: 55817 - DNA, 1746 bp, Homo sapiens
ctgggatagcaataacctgtgaaaatgctcccccggctaatttgtatcaatgattatgaacaacatgctaaatcagtacttccaaagtctatatatgactattacaggtctggggcaaatgatgaagaaactttggctgataatattgcagcattttccagatggaagctgtatccaaggatgctccggaatgttgctgaaacagatctgtcgacttctgttttaggacagagggtcagcatgccaatatgtgtgggggctacggccatgcagcgcatggctcatgtggacggcgagcttgccactgtgagagcctgtcagtccctgggaacgggcatgatgttgagttcctgggccacctcctcaattgaagaagtggcggaagctggtcctgaggcacttcgttggctgcaactgtatatctacaaggaccgagaagtcaccaagaagctagtgcggcaggcagagaagatgggctacaaggccatatttgtgacagtggacacaccttacctgggcaaccgtctggatgatgtgcgtaacagattcaaactgccgccacaactcaggatgaaaaattttgaaaccagtactttatcattttctcctgaggaaaattttggagacgacagtggacttgctgcatatgtggctaaagcaatagacccatctatcagctgggaagatatcaaatggctgagaagactgacatcattgccaattgttgcaaagggcattttgagaggtgatgatgccagggaggctgttaaacatggcttgaatgggatcttggtgtcgaatcatggggctcgacaactcgatggggtgccagccactattgatgttctgccagaaattgtggaggctgtggaagggaaggtggaagtcttcctggacgggggtgtgcggaaaggcactgatgttctgaaagctctggctcttggcgccaaggctgtgtttgtggggagaccaatcgtttggggcttagctttccagggggagaaaggtgttcaagatgtcctcgagatactaaaggaagaattccggttggccatggctctgagtgggtgccagaatgtgaaagtcatcgacaagacattggtgaggaaaaatcctttggccgtttccaagatctgacagtgcacaatattttcccatctgtattattttttttcagcatgtattacttgacaaagagacactgtgcagagggtgaccacagtctgtaattccccacttcaatacaaagggtgtcgttcttttccaacaaaatagcaatcccttttatttcattgcttttgacttttcaatgggtgtcctaggaaccttttagaaagaaatggactttcatcctggaaatatattaactgttaaaaagaaaacattgaaaatgtgtttagacaacgtcatcccctggcaggctaaagtgctgtatcctttagtaaaattggaggtagcaaacactaaggtgaaaagataatgatctcattgtttattaacctgtattctgtttacatgtctttaaaacagtggttcttaaattgtaagctcaggttcaaagtgttggtaatgcctgattcacaactttgagaaggtagcactggagagaattggaatgggtggcggtaattggtgatacttctttgaatgtagatttccaatcacatctttagtgtctgaatatatccaaatgttttaggatgtatgttacttcttagagagaaataaagcatttttgggaagaat

SEQ ID NO: 55818 - DNA, 816 bp, Homo sapiens
caacaaaaaagagcctcaggatccagcacacattatcacaaacttagtgtccatccatcactgctgaccctctccggacctgactccacccctgagggacacaggtcagccttgaccaatgacttttaagtaccatggagaacagggggccagaacttcggcagtaaagaataaaaggccagacagagaggcagcagcacatatctgcttccgacacagctgcaatcactagcaagctctcaggcctggcatcatggtgcattttactgctgaggagaaggctgccgtcactagcctgtggagcaagatgaatgtggaagaggctggaggtgaagccttgggcagactcctcgttgtttacccctggacccagagattttttgacagctttggaaacctgtcgtctccctctgccatcctgggcaaccccaaggtcaaggcccatggcaagaaggtgctgacttcctttggagatgctattaaaaacatggacaacctcaagcccgcctttgctaagctgagtgagctgcactgtgacaagctgcatgtggatcctgagaacttcaagctcctgggtaacgtgatggtgattattctggctactcactttggcaaggagttcacccctgaagtgcaggctgcctggcagaagctggtgtctgctgtcgccattgccctggcccataagtaccactgagttctcttccagtttgcaggtgttcctgtgaccctgacaccctccttctgcacatggggactgggcttggccttgagagaaagccttctgtttaataaagtacattttcttcagtaatc

SEQ ID NO: 55819 - DNA, 584 bp, Homo sapiens
acactcgcttctggaacgtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagctttggcaacctgtcctctgcctctgccatcatgggcaaccccaaagtcaaggcacatggcaagaaggtgctgacttccttgggagatgccacaaagcacctggatgatctcaagggcacctttgcccagctgagtgaactgcactgtgacaagctgcatgtggatcctgagaacttcaagctcctgggaaatgtgctggtgaccgttttggcaatccatttcggcaaagaattcacccctgaggtgcaggcttcctggcagaagatggtgactgcagtggccagtgccctgtcctccagataccactgagctcactgcccatgattcagagctttcaaggataggctttattctgcaagcaatacaaataataaatctattctgctgagagatcac

SEQ ID NO: 55820 - DNA, 2038 bp, Homo sapiens
gccatggggcgctgggcctgggtccccagcccctggcccccaccggggctgggccccttcctcctcctcctcctgctgctgctgctgctgccacgggggttccagccccagcctggcgggaaccgtacggagtccccagaacctaatgccacagcgacccctgcgatccccactatcctggtgacctctgtgacctctgagaccccagcaacaagtgctccagaggcagagggaccccaaagtggggggctcccgcccccgcccagggcagttccctcgagcagtagcccccaggcccaagcactcaccgaggacgggaggccctgcaggttccccttccgctacgggggccgcatgctgcatgcctgcacttcggagggcagtgcacacaggaagtggtgtgccacaactcacaactacgaccgggacagggcctggggctactgtgtggaggccaccccgcctccagggggcccagctgccctggatccctgtgcctccggcccctgcctcaatggaggctcctgctccaatacccaggacccccagtcctatcactgcagctgcccccgggccttcaccggcaaggactgcggcacagagaaatgctttgatgagacccgctacgagtacctggaggggggcgaccgctgggcccgcgtgcgccagggccacgtggaacagtgcgagtgcttcgggggccggacctggtgcgaaggcacccgacatacagcttgtctgagcagcccttgcctgaacgggggcacctgccacctgatcgtggccaccgggaccaccgtgtgtgcctgcccaccaggcttcgctggacggctctgcaacatcgagcctgatgagcgctgcttcttggggaacggcactgggtaccgtggcgtggccagcacctcagcctcgggcctcagctgcctggcctggaactccgatctgctctaccaggagctgcacgtggactccgtgggcgccgcggccctgctgggcctgggcccccatgcctactgccggaatccggacaatgacgagaggccctggtgctacgtggtgaaggacagcgcgctctcctgggagtactgccgcctggaggcctgcgaatccctcaccagagtccaactgtcaccggatctcctggcgaccctgcctgagccagcctccccggggcgccaggcctgcggcaggaggcacaagaagaggacgttcctgcggccacgtatcatcggcggctcctcctcgctgcccggctcgcacccctggctggccgccatctacatcggggacagcttctgcgccgggagcctggtccacacctgctgggtggtgtcggccgcccactgcttctcccacagcccccccagggacagcgtctccgtggtgctgggccagcacttcttcaaccgcacgacggacgtgacgcagaccttcggcatcgagaagtacatcccgtacaccctgtactcggtgttcaaccccagcgaccacgacctcgtcctgatccggctgaagaagaaaggggaccgctgtgccacacgctcgcagttcgtgcagcccatctgcctgcccgagcccggcagcaccttccccgcaggacacaagtgccagattgcgggctggggccacttggatgagaacgtgagcggctactccagctccctgcgggaggccctggtccccctggtcgccgaccacaagtgcagcagccctgaggtctacggcgccgacatcagccccaacatgctctgtgccggctacttcgactgcaagtccgacgcctgccagggggactcaggggggcccctggcctgcgagaagaacggcgtggcttacctctacggcatcatcagctggggtgacggctgcgggcggctccacaagccgggggtctacacccgcgtggccaactatgtggactggatcaacgaccggatacggcctcccaggcggcttgtggctccctcctgaccctccagcgggacaccctggttcccaccattccctgccttgctgacaataaagatatttccaagaa

SEQ ID NO: 55821 - DNA, 2082 bp, Homo sapiens
aggtttctgctgggtttctgaactgctgggtttctgcttgctcctctggagatgcagcgtctgttgactccagtgaagcgcattctgcaactgacaagagcggtgcaggaaacctccctcacacctgctcgcctgctcccagtagcccaccaaaggttttctacagcctctgctgtccccctggccaaaacagatacttggccaaaggacgtgggcatcctggccctggaggtctacttcccagcccaatatgtggaccaaactgacctggagaagtataacaatgtggaagcaggaaagtatacagtgggcttgggccagacccgtatgggcttctgctcagtccaagaggacatcaactccctgtgcctgacggtggtgcaacggctgatggagcgcatacagctcccatgggactctgtgggcaggctggaagtaggcactgagaccatcattgacaagtccaaagctgtcaaaacagtgctcatggaactcttccaggattcaggcaatactgatattgagggcatagataccaccaatgcctgctacggtggtactgcctccctcttcaatgctgccaactggatggagtccagttcctgggatggtcgttatgccatggtggtctgtggagacattgccgtctatcccagtggtaatgctcgtcccacaggtggggccggagctgtggctatgctgattgggcccaaggcccctctggccctggagcgagggctgaggggaacccatatggagaatgtgtatgacttctacaaaccaaatttggcctcggagtacccaatagtggatgggaagctttccatccagtgctacttgcgggccttggatcgatgttacacatcataccgtaaaaaaatccagaatcagtggaagcaagctggcagcgatcgacccttcacccttgacgatttacagtacatgatctttcatacacccttttgcaagatggtccagaagtctctggctcgcctgatgttcaatgacttcctgtcagccagcagtgacacacaaaccagcttatataaggggctggaggctttcggggggctaaagctggaagacacctacaccaacaaggacctggataaagcacttctaaaggcctctcaggacatgttcgacaagaaaaccaaggcttccctttacctctccactcacaatgggaacatgtacacctcatccctgtacgggtgcctggcctcgcttctgtcccaccactctgcccaagaactggctggctccaggattggtgccttctcttatggctctggtttagcagcaagtttcttttcatttcgagtatcccaggatgctgctccaggctctcccctggacaagttggtgtccagcacatcagacctgccaaaacgcctagcctcccgaaagtgtgtgtctcctgaggagttcacagaaataatgaaccaaagagagcaattctaccataaggtgaatttctccccacctggtgacacaaacagccttttcccaggtacttggtacctggagcgagtggacgagcagcatcgccgaaagtatgcccggcgtcccgtctaaaggtgttctgcagatccatggaaagcttcctgggaaacgtatgctagcagagcttctccccgtgaatcatatttttaagatcccactcttagctggtaaatgaatttgaatcgacatagtagccccataagcatcagccctgtagagtgaggagccatctctagcgggcccttcattcctctccatgctgcaatcactgtcctgggcttatggtgctatggactaggggtcctttgtgaaagagcaagatggagcaatggagagaagacctcttcctgaatcactggactccagaaatgtgcatgcagatcagctgttgccttcaagatccagataaactttcctgtcatgtgttagaactttattattattaatattgttaaacttctgtgctgttcctgtgaatctccaaattttgtaccttgttctaagctaatatatagcaattaaaaagagagaaagaggaaaaaaaaaaaaaaaaaaaaaaaaaaaaaaaaaaaaaaa

SEQ ID NO: 55822 - DNA, 3239 bp, Homo sapiens
gggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtgtgagtggccccgacccaggggacaggcagccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctagtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattca

SEQ ID NO: 55823 - DNA, 3209 bp, Homo sapiens
gggaggaggcagtgggagggcggagggcgggggccttcggggtgggcgcccagggtagggcaggtggccgcggcgtggaggcagggagaatgcgactctccaaaaccctcgtcgacatggacatggccgactacagtgctgcactggacccagcctacaccaccctggaatttgagaatgtgcaggtgttgacgatgggcaatgacacgtccccatcagaaggcaccaacctcaacgcgcccaacagcctgggtgtcagcgccctgtgtgccatctgcggggaccgggccacgggcaaacactacggtgcctcgagctgtgacggctgcaagggcttcttccggaggagcgtgcggaagaaccacatgtactcctgcagatttagccggcagtgcgtggtggacaaagacaagaggaaccagtgccgctactgcaggctcaagaaatgcttccgggctggcatgaagaaggaagccgtccagaatgagcgggaccggatcagcactcgaaggtcaagctatgaggacagcagcctgccctccatcaatgcgctcctgcaggcggaggtcctgtcccgacagatcacctcccccgtctccgggatcaacggcgacattcgggcgaagaagattgccagcatcgcagatgtgtgtgagtccatgaaggagcagctgctggttctcgttgagtgggccaagtacatcccagctttctgcgagctccccctggacgaccaggtggccctgctcagagcccatgctggcgagcacctgctgctcggagccaccaagagatccatggtgttcaaggacgtgctgctcctaggcaatgactacattgtccctcggcactgcccggagctggcggagatgagccgggtgtccatacgcatccttgacgagctggtgctgcccttccaggagctgcagatcgatgacaatgagtatgcctacctcaaagccatcatcttctttgacccagatgccaaggggctgagcgatccagggaagatcaagcggctgcgttcccaggtgcaggtgagcttggaggactacatcaacgaccgccagtatgactcgcgtggccgctttggagagctgctgctgctgctgcccaccttgcagagcatcacctggcagatgatcgagcagatccagttcatcaagctcttcggcatggccaagattgacaacctgttgcaggagatgctgctgggagggtcccccagcgatgcaccccatgcccaccaccccctgcaccctcacctgatgcaggaacatatgggaaccaacgtcatcgttgccaacacaatgcccactcacctcagcaacggacagatgtccacccctgagaccccacagccctcaccgccaggtggctcagggtctgagccctataagctcctgccgggagccgtcgccacaatcgtcaagcccctctctgccatcccccagccgaccatcaccaagcaggaagttatctagcaagccgctggggcttgggggctccactggctccccccagccccctaagagagcacctggtgatcacgtggtcacggcaaaggaagacgtgatgccaggaccagtcccagagcaggaatgggaaggatgaagggcccgagaacatggcctaagggccacatcccactgccacccttgacgccctgctctggataacaagactttgacttggggagacctctactgccttggacaacttttctcatgttgaagccactgccttcaccttcaccttcatccatgtccaacccccgacttcatcccaaaggacagccgcctggagatgacttgaggccttacttaaacccagctcccttcttccctagcctggtgcttctcctctcctagcccctgtcatggtgtccagacagagccctgtgaggctgggtccaattgtggcacttggggcaccttgctcctccttctgctgctgcccccacctctgctgcctccctctgctgtcaccttgctcagccatcccgtcttctccaacaccacctctccagaggccaaggaggccttggaaacgattcccccagtcattctgggaacatgttgtaagcactgactgggaccaggcaccaggcagggtctagaaggctgtggtgagggaagacgcctttctcctccaacccaacctcatcctccttcttcagggacttgggtgggtacttgggtgaggatccctgaaggccttcaacccgagaaaacaaacccaggttggcgactgcaacaggaacttggagtggagaggaaaagcatcagaaagaggcagaccatccaccaggcctttgagaaagggtagaattctggctggtagagcaggtgagatgggacattccaaagaacagcctgagccaaggcctagtggtagtaagaatctagcaagaattgaggaagaatggtgtgggagagggatgatgaagagagagagggcctgctggagagcatagggtctggaacaccaggctgaggtcctgatcagcttcaaggagtatgcagggagctgggcttccagaaaatgaacacagcagttctgcagaggacgggaggctggaagctgggaggtcaggtggggtggatgatataatgcgggtgagagtaatgaggcttggggctggagaggacaagatgggtaaaccctcacatcagagtgacatccaggaggaataagctcccagggcctgtctcaagctcttccttactcccaggcactgtcttaaggcatctgacatgcatcatctcatttaatcctcccttcctccctattaacctagagattgtttttgttttttattctcctcctccctccccgccctcacccgccccactccctcctaacctagagattgttacagaagctgaaattgcgttctaagaggtgaagtgattttttttctgaaactcacacaactaggaagtggctgagtcaggacttgaacccaggtctccctggatcagaacaggagctcttaactacagtggctgaatagcttctccaaaggctccctgtgttctcaccgtgatcaagttgaggggcttccggctcccttctacagcctcagaaaccagactcgttcttctgggaaccctgcccactcccaggaccaagattggcctgaggctgcactaaaattcacttagggtcgagcatcctgtttgctgataaatattaaggagaattca

SEQ ID NO: 55824 - DNA, 1433 bp, Homo sapiens
agatgccccacagcactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtatacaccttaaatgataagaagcagtggataaataaggctgttggagataaacttcctgaatgtgaagcagatgacggctgcccgaagccccccgagattgcacatggctatgtggagcactcggttcgctaccagtgtaagaactactacaaactgcgcacagaaggagatggagtgtacaccttaaacaatgagaagcagtggataaataaggctgttggagataaacttcctgaatgtgaagcagtatgtgggaagcccaagaatccggcaaacccagtgcagcggatcctgggtggacacctggatgccaaaggcagctttccctggcaggctaagatggtttcccaccataatctcaccacaggtgccacgctgatcaatgaacaatggctgctgaccacggctaaaaatctcttcctgaaccattcagaaaatgcaacagcgaaagacattgcccctactttaacactctatgtggggaaaaagcagcttgtagagattgagaaggttgttctacaccctaactactcccaggtagatattgggctcatcaaactcaaacagaaggtgtctgttaatgagagagtgatgcccatctgcctaccttcaaaggattatgcagaagtagggcgtgtgggttatgtttctggctgggggcgaaatgccaattttaaatttactgaccatctgaagtatgtcatgctgcctgtggctgaccaagaccaatgcataaggcattatgaaggcagcacagtccccgaaaagaagacaccgaagagccctgtaggggtgcagcccatactgaatgaacacaccttctgtgctggcatgtctaagtaccaagaagacacctgctatggcgatgcgggcagtgcctttgccgttcacgacctggaggaggacacctggtatgcgactgggatcttaagctttgataagagctgtgctgtggctgagtatggtgtgtatgtgaaggtgacttccatccaggactgggttcagaagaccatagctgagaactaatgcaaggctggccggaagcccttgcctgaaagcaagatttcagcctggaagagggcaaagtggacgggagtggacaggagtggatgcgataagatgtggtttgaagctgatgggtgccagccctgcattgctgagtcaatcaataaagagctttcttttgacccattt

SEQ ID NO: 55825 - DNA, 1440 bp, Homo sapiens
aggcctctagtcccagtaggaggtttgactaagatcaatcatgacgacttacagtgacaaaggggcaaagcctgagagaggccgattcctccacttccactctgtgaccttctgggttggcaacgccaagcaggccgcgtcattctactgcagcaagatgggctttgaacctctagcctacaggggcctggagaccggttcccgggaggtggtcagccatgtaatcaaacaagggaagattgtgtttgtcctctcctcagcgctcaacccctggaacaaagagatgggcgatcacctggtgaaacacggtgacggagtgaaggacattgcgttcgaggtggaagattgtgactacatcgtgcagaaagcacgggaacggggcgccaaaatcatgcgggagccctgggtagagcaagacaagtttgggaaggtgaagtttgctgtgctgcagacgtatggggacaccacacacaccctggtggagaagatgaactacatcggccaattcttgcctggatatgaggccccagcgttcatggaccccctacttcctaaactgcccaaatgcagtctggagatgatcgaccacattgtgggaaaccagcctgatcaggagatggtgtccgcctccgaatggtacctgaaaaacctgcagttccaccgcttctggtccgtggatgacacgcaggtgcacacggaatatagctctctgcgatccattgtggtggccaactatgaagagtccatcaagatgcccatcaatgagccagcgcctggcaagaagaagtcccagatccaggaatatgtggactataacgggggcgctggggtccagcacatcgctctcaagaccgaagacatcatcacagcgattcgccacttgagagagagaggcctggagttcttatctgttccctccacgtactacaaacaactgcgggagaagctgaagacggccaagatcaaggtgaaggagaacattgatgccctggaggagctgaaaatcctggtggactacgacgagaaaggctacctcctgcagatcttcaccaaaccggtgcaggaccggcccacgctcttcctggaagtcatccagcgccacaaccaccagggttttggagccggcaacttcaactcactgttcaaggctttcgaggaggagcagaacctgcggggtaacctcaccaacatggagaccaatggggtggtgcccggcatgtaagccccgcccaccccacggaggccacagccacacagccacgccccctgattctggaactcgcccaacttccctactggctgctccccttgggtcccgcccaccagcggactcggcccccaaggctccgcccacactgaccacgcccctcggcggggccgccctctgctccagccctcccgattaaagcgtgccccggtccaaaaaaaaaaaaaaaaaaa

SEQ ID NO: 55826 - DNA, 1783 bp, Homo sapiens
tcgagcccgctttccagggaccctacctgagggcccacaggtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggccgaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgatgggatgctctttaaataataaagatggttttgatt

SEQ ID NO: 55827 - DNA, 2363 bp, Homo sapiens
tcgagcccgctttccagggaccctacctgagggcccacaggtgaggcagcctggcctagcaggccccacgccaccgcctctgcctccaggccgcccgctgctgcggggccaccatgctcctgcccaggcctggagactgacccgaccccggcactacctcgaggctccgcccccacctgctggaccccagggtaaggacaagggcccccagactcacagttccagccctgaggacaggggttccctcatccccccacccagcctaatgcccacctcctaatagaggggttcctggggacctgaagagggggcactatgacgtctccccaagcacctaggtgttctgtcctgctcttccttcagactcagccgttggaccccagtcctttcctccccagacccaggagttccagccctcaggcccctcctccctcatactagggagtcctggcccccaaattcctcctttcccaagacttatgatttcaggtcctcagctgtctcctccctcaaaccgggatcctcagtcccctgctccaccaggctcaggcatgggggtccccatccctgcaaatccaggcgtccccccgctgctggtcagacactgaccccatccttgaacccagcccaatctgcgtccgtgatcacggcgtgctctggccaaggcccagtccctacagcctgcctggatggacgcctgggactgggggcgccaggactgggctgggctgggctcccccaggccctgcctccccgtccatctcctcacaggtcccaccctggcccaggaggtcagccagggaatcattaacaagaggcagtgacatggcgcagaaggagggtggccggactgtgccatgctgctccagacccaaggtggcagctctcactgcggggaccctgctacttctgacagccatcggggcggcatcctgggccattgtggctgttctcctcaggagtgaccaggagccgctgtacccagtgcaggtcagctctgcggacgctcggctcatggtctttgacaagacggaagggacgtggcggctgctgtgctcctcgcgctccaacgccagggtagccggactcagctgcgaggagatgggcttcctcagggcactgacccactccgagctggacgtgcgaacggcgggcgccaatggcacgtcgggcttcttctgtgtggacgaggggaggctgccccacacccagaggctgctggaggtcatctccgtgtgtgattgccccagaggccgtttcttggccgccatctgccaagactgtggccgcaggaagctgcccgtggaccgcatcgtgggaggccgggacaccagcttgggccggtggccgtggcaagtcagccttcgctatgatggagcacacctctgtgggggatccctgctctccggggactgggtgctgacagccgcccactgcttcccggagcggaaccgggtcctgtcccgatggcgagtgtttgccggtgccgtggcccaggcctctccccacggtctgcagctgggggtgcaggctgtggtctaccacgggggctatcttccctttcgggaccccaacagcgaggagaacagcaacgatattgccctggtccacctctccagtcccctgcccctcacagaatacatccagcctgtgtgcctcccagctgccggccaggccctggtggatggcaagatctgtaccgtgacgggctggggcaacacgcagtactatggccaacaggccggggtactccaggaggctcgagtccccataatcagcaatgatgtctgcaatggcgctgacttctatggaaaccagatcaagcccaagatgttctgtgctggctaccccgagggtggcattgatgcctgccagggcgacagcggtggtccctttgtgtgtgaggacagcatctctcggacgccacgttggcggctgtgtggcattgtgagttggggcactggctgtgccctggcccagaagccaggcgtctacaccaaagtcagtgacttccgggagtggatcttccaggccataaagactcactccgaagccagcggcatggtgacccagctctgaccggtggcttctcgctgcgcagcctccagggcccgaggtgatcccggtggtgggatccacgctgggccgaggatgggacgtttttcttcttgggcccggtccacaggtccaaggacaccctccctccagggtcctctcttccacagtggcgggcccactcagccccgagaccacccaacctcaccctcctgacccccatgtaaatattgttctgctgtctgggactcctgtctaggtgcccctgatgatgggatgctctttaaataataaagatggttttgatt

SEQ ID NO: 55828 - DNA, 4451 bp, Homo sapiens
ccgcgggcggggccggctggcgttcacgtgacccggcgtcattggctcgctcgcggaagtagtcctacattcgcggtcagcgcggggtctccgggcgccctgcagggcgggcaggctgtgccatcccgccggacgtcgggatggtgcagctgtacaacctgcacccgttcgggtcgcagcaggtggtgccctgcaagctggagccggaccggttctgtggcggggggcgtgacgcgcttttcgtggcggcgggctgcaaggtggaggcgttcgcggtggccggccaggagctgtgccagccgcggtgcgccttctccacgctgggccgggtgttgcgcctggcctacagcgaggctggagattatttggtagcaattgaagagaaaaacaaagctacatttctacgtgcttatgtgaactggagaaataaaaggactgaaaactctcgtgtgtgtatccgaatgattgggcataatgtggagggaccattcagcaaagccttcagagaccagatgtacattattgaaatgccgctttcggaggcccccttgtgcatttcctgttgccctgtgaaaggagaccttctcgttggctgcacaaataaattagtcttatttagtttgaagtaccagatcattaatgaggaattctcactattggactttgaacgttctttaattatacacatagataatatcactcctgttgaggtttctttttgtgttggatatgttgctgtcatgtcagacttagaagtcttaatcgtaaaactggagtcaggccctaaaaatggagagagagttcaccaccatccacataagaccaacaatcgaataagacggacagaagaaggcatcagtaatgaaatttcacagcttgagtcagatgattttgtcatctgccagaagcccctggaacttcttggtgaaaaaagtgaacagtctggattatctgttacactggagtctacgggattagctgatgaaaaaagaaaatattcccactttcagcacctgctctatagacgttttgctcctgatatttcgtcctatgtcttgtctgatgacatcaagctacattccctccagctgctacccatttaccagaccggttctcttacatctgatggaaaaaatttgtctcaggaaaaagaattgctgagtctcttttgctttttctccttacctcatgtgggctatctctacatggttgtcaaatctgttgaattgatgtcagtctaccagtatcctgaaaagtctcagcaggcagtactcacgccacaatttttgcacgtcattacaagtaacaacctgcagtgtttcactgtgcggtgcagtgcggcggcagctcgtgaggaggacccgtacatggacaccaccctgaaggcttgcccacctgtcagtatggatgtctgtgctttaagaatacagcttttcataggcttgaaagccatctgtcactttaaaaaccacatcatacttttgactaaagcagaacctgaagccattccagagagaagacagtcacccaagaggcttctttcgagaaaagataccagtgttaaaatcaaaatacctcctgtagctgaggctgggtggaatttgtatattgtgaatacgatctcaccagtgcagctgtacaaagagatggtagactatagcaatacctataagactgtcaaaacccagagctgcattcaccttctcagtgaggctcatctgttagtgcgagctgccctgatggatgccagtcagctggaacctggagagaaggcagagcttttggaagcatttaaggaaagctgtgggcaccttggggactgttacagcaggcttgactcccagcattctcatctcaccttgccatactataagatgtctggtttgtctatggctgaagttctggcccgcacggactggacagtagaggatggattacagaaatacgagagaggattaatcttttacattaatcattcactttatgaaaacctggatgaagaattaaatgaagaattagcagcaaaagtggttcagatgttttatgtggctgagccaaagcaagtgccccatattctctgtagtccttctatgaagaatattaatcctttaactgccatgagctatctaaggaagctggatacttctgggttttcatcgatcttagtgacattgaccaaggcagcagtggctctgaaaatgggagatcttgacatgcacagaaatgaaatgaaaagccattcagagatgaagttggtatgtggcttcattctggaacctcggctgttgattcaacagagaaagggacagattgttccaaccgagcttgcacttcacttgaaggaaactcagcctggattgcttgtggcttcagttctgggcttgcagaagaacaacaaaattggaattgaagaagcagattccttttttaaggtgctttgtgctaaggatgaagatacaattcctcagctcttggtagacttttgggaagctcagctagtggcatgtctcccagatgtggtacttcaggaactctttttcaaactcacatcacagtacatctggagattgtctaagaggcagcctcctgacaccacaccattgcgaacatcggaggatctgataaatgcctgtagtcattatggcttaatttatccatgggttcacgtcgtaatatcatctgattctttagctgataaaaattatacagaagatctttcaaaattacagtctcttatatgtggtccttcatttgacatagcttccattattccgttcttggagccactttcagaagacactattgccggcctcagtgtccatgttctgtgtcgtacacgcttgaaagagtatgaacagtgcatagacatactgttagagagatgcccggaggcagtcattccatatgctaatcatgaactgaaagaagagaaccggactctgtggtggaaaaaactgttgcctgaactttgtcagagaataaaatgtggtggagagaagtatcaactctacctgtcatcattaaaagaaacattgtcaattgttgctgtggaactagaactgaaggatttcatgaatgttctcccagaagatggtactgcaacatttttcttgccatatcttctctattgcagtcgaaagaaaccattgacttaaaggtatcatttgaaaaataccataatggcatttgagactgaatttctaaaaattgaatgccaaagtacaagtagaggagttttttattttatatatcacacacacacacacacacacacacacacacacacacatatatgatacaaatgctttcaggctgcttaccttaccgtgtagtggtaactattcacttcttaatttatgacctcaatcaatttaattgtctagaatgtaaaaagtctttaagacataagaattcctcaaagaagccatacattttttaaggtggggattgacttttattccaaggaacaacatcagttcactgttgttggagacatgacaatcattttcatcccaagaacactttaaggaaacattttacaagtatgcttgaaagaatgtcactaactggtccagaattttatcttcttgatttttccagatttctctatgtttttgagaaagatgttaatgttttgccatggtaaaagatttcaaacctcattttttttgttccttttcttgttacttttaagaaaactcatgctctgtttctctgaatcaaatgaagtagaagtttacaaagctaactttcttcttgtctagctattaacatgatttgtcaaatgcatgtttttttcagccaaagccttgtttccatttttgttgatgtgtactcttgctcttttagctagagtgtatgtgaaaataaagaaatacatcattgtattcacaaccatgtgtcttcatttataactttttgtttaaaaaatttttagttcaagtttagttcattgatattatcctctgaatgcagttaaggctgggcagaaattctactcatgtgacatctgccacaggtctattttgaagcttttcttctaatggcaatgtttgtccttaccaggatttaatctatagaattgtctctcaactctgcttttctccagttccagataacgtccttaagaccatctgttcaggggttcacaaaactcaaatttgtgtcattctattttatttattttattttttatttccttccctcataccttgcccattccctctgaatattaggtgtgatgtcaacagcatgttagaaggatcaatgggaaggcaatgattgaaaacatttcaatgaaccttaatagtgttcctttgaggagcacccaggagaatatctggtcatagatctttttttaaatgcagttttataaaaccctaacagcggtgatatcattagactgtatgaatcagttttattacctagtgtacaagtgtcagtcatgtatc

SEQ ID NO: 55829 - DNA, 1389 bp, Homo sapiens
atggctagggtactgggagcacccgttgcactggggttgtggagcctatgctggtctctggccattgccacccctcttcctccgactagtgcccatgggaatgttgctgaaggcgagaccaagccagacccagacgtgactgaacgctgctcagatggctggagctttgatgctaccaccctggatgacaatggaaccatgctgttttttaaaggggagtttgtgtggaagagtcacaaatgggaccgggagttaatctcagagagatggaagaatttccccagccctgtggatgctgcattccgtcaaggtcacaacagtgtctttctgatcaagggggacaaagtctgggtataccctcctgaaaagaaggagaaaggatacccaaagttgctccaagatgaatttcctggaatcccatccccactggatgcagctgtggaatgtcaccgtggagaatgtcaagctgaaggcgtcctcttcttccaaggtgaccgcgagtggttctgggacttggctacgggaaccatgaaggagcgttcctggccagctgttgggaactgctcctctgccctgagatggctgggccgctactactgcttccagggtaaccaattcctgcgcttcgaccctgtcaggggagaggtgcctcccaggtacccgcgggatgtccgagactacttcatgccctgccctggcagaggccatggacacaggaatgggactggccatgggaacagtacccaccatggccctgagtatatgcgctgtagcccacatctagtcttgtctgcactgacgtctgacaaccatggtgccacctatgccttcagtgggacccactactggcgtctggacaccagccgggatggctggcatagctggcccattgctcatcagtggccccagggtccttcagcagtggatgctgccttttcctgggaagaaaaactctatctggtccagggcacccaggtatatgtcttcctgacaaagggaggctataccctagtaagcggttatccgaagcggctggagaaggaagtcgggacccctcatgggattatcctggactctgtggatgcggcctttatctgccctgggtcttctcggctccatatcatggcaggacggcggctgtggtggctggacctgaagtcaggagcccaagccacgtggacagagcttccttggccccatgagaaggtagacggagccttgtgtatggaaaagtcccttggccctaactcatgttccgccaatggtcccggcttgtacctcatccatggtcccaatttgtactgctacagtgatgtggagaaactgaatgcagccaaggcccttccgcaaccccagaatgtgaccagtctcctgggctgcactcactga

SEQ ID NO: 55830 - DNA, 1011 bp, Homo sapiens
ggcgctgctgtggttggtcagtccagtaagaagccagcagggctggtgctggggcttcttctcctgaaggggctgcaagagggaaggcttagccatgtcgtccttgatcagaagggtgatcagcaccgcgaaagccccaggggccattggaccctacagtcaagctgtattagtcgacaggaccatttacatttcaggacagataggcatggacccttcaagtggacagcttgtgtcaggaggggtagcagaagaagctaaacaagctcttaaaaacatgggtgaaattctgaaagctgcaggctgtgacttcactaacgtggtgaaaacaactgttcttctggctgacataaatgacttcaatactgtcaatgaaatctacaaacagtatttcaagagtaattttcctgctagagctgcttaccaagttgctgctttacccaaaggcagccgaattgaaattgaagcagtagctatccaaggaccactgacaacggcatcactataagtgggcccagtgctgtgtagtctggaattgttaacattttaatttttacaattgatgtaacatcttaattaaccttttaattttcacaattgatgacagtgtgagtttgatgaaaatatctgaagctattatggaaataccatgtaatagggagagttgaacatgaatattagagaaggaatccagttacttttttaaattacacctgtgtgcacctgtattactgaatataggaaagagatacccattacatagttactcagtaaacaaaagagaaataccaggtaggaaagaagagttactattcctgagaaataatcaagaacatatttaatttaaactaatgatgtgaactatttagttttgatgtccgttatgtgattctgcttttacttgagtaaaattaaagtgtttaaatttgagatcaaggagaagatagtggaacaaaatgttatatagataatatttttctaatggaaataaaataggcagatttcctttgg

SEQ ID NO: 55831 - DNA, 1405 bp, Homo sapiens
acaattcagaggctgctgcctgcttaggaggttgtagaaagctctgtaggttctctctgtgtgtcctacaggagtcttcaggccagctccctgtcggatggcttttatgaaaaaatatctcctccccattctggggctcttcatggcctactactactattctgcaaacgaggaattcagaccagagatgctccaaggaaagaaagtgattgtcacaggggccagcaaagggatcggaagagagatggcttatcatctggcgaagatgggagcccatgtggtggtgacagcgaggtcaaaagaaactctacagaaggtggtatcccactgcctggagcttggagcagcctcagcacactacattgctggcaccatggaagacatgaccttcgcagagcaatttgttgcccaagcaggaaagctcatgggaggactagacatgctcattctcaaccacatcaccaacacttctttgaatctttttcatgatgatattcaccatgtgcgcaaaagcatggaagtcaacttcctcagttacgtggtcctgactgtagctgccttgcccatgctgaagcagagcaatggaagcattgttgtcgtctcctctctggctgggaaagtggcttatccaatggttgctgcctattctgcaagcaagtttgctttggatgggttcttctcctccatcagaaaggaatattcagtgtccagggtcaatgtatcaatcactctctgtgttcttggcctcatagacacagaaacagccatgaaggcagtttctgggatagtccatatgcaagcagctccaaaggaggaatgtgccctggagatcatcaaagggggagctctgcgccaagaagaagtgtattatgacagctcactctggaccactcttctgatcagaaatccatgcaggaagatcctggaatttctctactcaacgagctataatatggacagattcataaacaagtaggaactccctgagggctgggcatgctgagggattttgggactgttctgtctcatgtttatctgagctcttatctatgaagacatcttcccagagtgtccccagagacatgcaagtcatgggtcacacctgacaaatggaaggagttcctctaacatttgcaaaatggaaatgtaataataatgaatgtcatgcaccgctgcagccagcagttgtaaaattgttagtaaacataggtataattaccagatagttatattaaatttatatcttatatataataatatgtgatgattaatacaatattaattataataaaggtcacataaactttataaattcataactggtagctataacttgagcttattcaggatggtttctttaaaaccataaactgtacaaatgaaatttttcaatatttgtttctta

SEQ ID NO: 55832 - DNA, 1415 bp, Homo sapiens
ggaggagggagagagagagaagagaagaaaaagaaaaaagaacatcaataaaaagaagtcagatttgttcgaaatcttgaggagtcttcaggccagctccctgtcggatggcttttatgaaaaaatatctcctccccattctggggctcttcatggcctactactactattctgcaaacgaggaattcagaccagagatgctccaaggaaagaaagtgattgtcacaggggccagcaaagggatcggaagagagatggcttatcatctggcgaagatgggagcccatgtggtggtgacagcgaggtcaaaagaaactctacagaaggtggtatcccactgcctggagcttggagcagcctcagcacactacattgctggcaccatggaagacatgaccttcgcagagcaatttgttgcccaagcaggaaagctcatgggaggactagacatgctcattctcaaccacatcaccaacacttctttgaatctttttcatgatgatattcaccatgtgcgcaaaagcatggaagtcaacttcctcagttacgtggtcctgactgtagctgccttgcccatgctgaagcagagcaatggaagcattgttgtcgtctcctctctggctgggaaagtggcttatccaatggttgctgcctattctgcaagcaagtttgctttggatgggttcttctcctccatcagaaaggaatattcagtgtccagggtcaatgtatcaatcactctctgtgttcttggcctcatagacacagaaacagccatgaaggcagtttctgggatagtccatatgcaagcagctccaaaggaggaatgtgccctggagatcatcaaagggggagctctgcgccaagaagaagtgtattatgacagctcactctggaccactcttctgatcagaaatccatgcaggaagatcctggaatttctctactcaacgagctataatatggacagattcataaacaagtaggaactccctgagggctgggcatgctgagggattttgggactgttctgtctcatgtttatctgagctcttatctatgaagacatcttcccagagtgtccccagagacatgcaagtcatgggtcacacctgacaaatggaaggagttcctctaacatttgcaaaatggaaatgtaataataatgaatgtcatgcaccgctgcagccagcagttgtaaaattgttagtaaacataggtataattaccagatagttatattaaatttatatcttatatataataatatgtgatgattaatacaatattaattataataaaggtcacataaactttataaattcataactggtagctataacttgagcttattcaggatggtttctttaaaaccataaactgtacaaatgaaatttttcaatatttgtttctta

SEQ ID NO: 55833 - DNA, 2377 bp, Homo sapiens
gactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgtttcatcgtatatcaatatctttctgagactacagaagtttcttcctgaacgcgcctcagcgattttaaatcgtatgcaaaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 55834 - DNA, 1512 bp, Homo sapiens
agcagttggggcaggaggaagccgactgctgcctggtctgcaaagaagtcctttcaagtctctaggactggactcttcctaagcaagtccgagaaggaagcaccctcactatgtggctctacctggcggccttcgtgggcctgtactaccttctgcactggtaccgggagaggcaggtggtgagccacctccaagacaagtatgtctttatcacgggctgtgactcgggctttgggaacctgctggccagacagctggatgcacgaggcttgagagtgctggctgcgtgtctgacggagaagggggccgagcagctgaggggccagacgtctgacaggctggagacggtgaccctggatgttaccaagatggagagcatcgctgcagctactcagtgggtgaaggagcatgtgggggacagaggactctggggactggtgaacaatgcaggcattcttacaccaattaccttatgtgagtggctgaacactgaggactctatgaatatgctcaaagtgaacctcattggtgtgatccaggtgaccttgagcatgcttcctttggtgaggagagcacggggaagaattgtcaatgtctccagcattctgggaagagttgctttctttgtaggaggctactgtgtctccaagtatggagtggaagccttttcagatattctgaggcgtgagattcaacattttggggtgaaaatcagcatagttgaacctggctacttcagaacgggaatgacaaacatgacacagtccttagagcgaatgaagcaaagttggaaagaagcccccaagcatattaaggagacctatggacagcagtattttgatgccctttacaatatcatgaaggaagggctgttgaattgtagcacaaacctgaacctggtcactgactgcatggaacatgctctgacatcggtgcatccgcgaactcgatattcagctggctgggatgctaaatttttcttcatccctctatcttatttacctacatcactggcagactacattttgactagatcttggcccaaaccagcccaggcagtctaaagaaaactgggttggtgcttcttggaatgaaggcaaaaatctgaaattgttagtgtctcagtaatcctgatttagaacccaggctttttgtaacaatgtgttttcttgcctaaattcatttatctggcatcatcagagtactaacatgtttatatttcagatatccaaagcttaccactttaggtgatgaatctttactattttagcccttttttgatgagactatttgtctaaagtgaatcatttgttcttgccttattaaacagagtagatggaaaacaatttaacctattttgaagtcatttctttatgaatatgaataattgttctatgctttaataatctattgtgaggaaactactaagaaatatgttggtgtgtttgtccttacttgaaatgggtctgtattatggtacttttaataaatatttgatttttctttctcttc

SEQ ID NO: 55835 - DNA, 8769 bp, Homo sapiens
atttagaggcggcgccagggcggccgcggagaaacgtgacacaccagccctctcggaggggtttcggaccgaagggaagaagctgcgccgtgtcgtccgtctccctgcgcgccgcgggcacttctcctgggctctccccgaactctcccgcgacctctgcgcgccctcaggccgccttccccgccctgggctcgggacaacttctggggtggggtgcaaagaaagtttgcggctcctgccgccggcctctccgcctcttggcctaggaggctcgccgcccgcgcccgctcgttcggccttgcccgggaccgcgtcctgccccgagaccgccaccatgaacaagctttacatcggcaacctcaacgagagcgtgacccccgcggacttggagaaagtgtttgcggagcacaagatctcctacagcggccagttcttggtcaaatccggctacgccttcgtggactgcccggacgagcactgggcgatgaaggccatcgaaactttctccgggaaagtagaattacaaggaaaacgcttagagattgaacattcggtgcccaaaaaacaaaggagccggaaaattcaaatccgaaatattccaccccagctccgatgggaagtactggacagcctgctggctcagtatggtacagtagagaactgtgagcaagtgaacaccgagagtgagacggcagtggtgaatgtcacctattccaaccgggagcagaccaggcaagccatcatgaagctgaatggccaccagttggagaaccatgccctgaaggtctcctacatccccgatgagcagatagcacagggacctgagaatgggcgccgagggggctttggctctcggggtcagccccgccagggctcacctgtggcagcgggggccccagccaagcagcagcaagtggacatcccccttcggctcctggtgcccacccagtatgtgggtgccattattggcaaggagggggccaccatccgcaacatcacaaaacagacccagtccaagatagacgtgcataggaaggagaacgcaggtgcagctgaaaaagccatcagtgtgcactccacccctgagggctgctcctccgcttgtaagatgatcttggagattatgcataaagaggctaaggacaccaaaacggctgacgaggttcccctgaagatcctggcccataataactttgtagggcgtctcattggcaaggaaggacggaacctgaagaaggtagagcaagataccgagacaaaaatcaccatctcctcgttgcaagaccttaccctttacaaccctgagaggaccatcactgtgaagggggccatcgagaattgttgcagggccgagcaggaaataatgaagaaagttcgggaggcctatgagaatgatgtggctgccatgagcctgcagtctcacctgatccctggcctgaacctggctgctgtaggtcttttcccagcttcatccagcgcagtcccgccgcctcccagcagcgttactggggctgctccctatagctcctttatgcaggctcccgagcaggagatggtgcaggtgtttatccccgcccaggcagtgggcgccatcatcggcaagaaggggcagcacatcaaacagctctcccggtttgccagcgcctccatcaagattgcaccacccgaaacacctgactccaaagttcgtatggttatcatcactggaccgccagaggcccaattcaaggctcagggaagaatctatggcaaactcaaggaggagaacttctttggtcccaaggaggaagtgaagctggagacccacatacgtgtgccagcatcagcagctggccgggtcattggcaaaggtggaaaaacggtgaacgagttgcagaatttgacggcagctgaggtggtagtaccaagagaccagacccctgatgagaacgaccaggtcatcgtgaaaatcatcggacatttctatgccagtcagatggctcaacggaagatccgagacatcctggcccaggttaagcagcagcatcagaagggacagagtaaccaggcccaggcacggaggaagtgaccagcccctccctgtcccttcgagtccaggacaacaacgggcagaaatcgagagtgtgctctccccggcaggcctgagaatgagtgggaatccgggacacctgggccgggctgtagatcaggtttgcccacttgattgagaaagatgttccagtgaggaaccctgatctctcagccccaaacacccacccaattggcccaacactgtctgcccctcggggtgtcagaaattctagcgcaaggcacttttaaacgtggattgtttaaagaagctctccaggccccaccaagagggtggatcacacctcagtgggaagaaaaataaaatttccttcaggttttaaaaacatgcagagaggtgttttaatcagccttaaaggatggttcatttcttgaccttaatgtttttccaatcttcttccccctacttgggtaattgattaaaatacctccatttacggcctctttctatatttacactaatttttttatctttattgctaccagaaaaaaatgcgaacgaatgcattgctttgcttacagtattgactcaagggaaaagaactgtcagtatctgtagattaattccaatcactccctaaccaataggtacaatacggaatgaagaagaggggaaaatggggagaaagatggttaaaatacataataatccacgtttaaaaggagcgcacttgtggctgatctatgccagatcaccatcttcaaattggcacaactgaaatttccccactctgttggggcttccccaccacattcatgtccctctcccgtgtaggtttcacattatgtccaggtgcacataggtggtattgaatgctcagcagggtaggggctgaccactgtccctgattcccatcgttctcaggcggattttatatttttttaaagtctattttaatgattggatatgagcactgggaaggggacgctaactccccttgataaagtctcggttccatggaggacttgagtggccccaaaggctgccacggtgccctcaccccagcccatgtgctcccataagggctggttcctagaggcaggggttgtggggcactcccagccacggcactgttaccttggtggtgggacttggaacccaaccctgagctcccgataaagctaaagtccatcatctggcaaattcagtaaattggagagtacttgcttctgtttgtatctgagaggaatttttaactgacggcttctgtctccatgaatcattatcagcatgatgaaaggtgtgtctaaaaaacaattcagaataccagcagcattgtacagcaaggggtaaataagcttaatttattaatttaccaggcttaattaagatcccatggagtgtttagcccttgtgggagacagaagccatcagttaaatgaggttaggcctctcctcctaatatactgattgacaatgcatattagccaggtaatgcactttagctaccctggacaatgctatcaagtgtgctgggaagggaggaaggcctctctacatatggaaaagcccatgcgtggagttcccctcctttcaacattgcaacaacagtaacaacaagacaaccgcaacatgtgggcgtagtcaggcaatgctgtgtgcgaagtaaactacctcaaggtatgaagttacctcagcaattattttcctttttgttccccccaaccccattaaaaaaatttttttttgatttttgtttttttgcagcttgctgatattttatataaaaaagaaaagcaaagcaaaagagaagctgatagtcttgaatattttatttttttaatgaaaagaaaaaacaagaaagttatgtttcataatttcttacaacatgagccagtaaccctttaggaactctctatggagaacaggcctggtgggaaaggctttgggggctgcccccttaggaggaggctagtgctaagagggaaggcccaggtttgagagagcccagaggggcagagcccagagccttgtttggccctgatctctgacttctagagccccagctgctggcggctgctggaatatcctacctgataggattaaaaggcctagtggagctgggggctctcagtggttaaacaatgcccaacaaccaaccagctggcccttggtctcctctctttcctcctttggttaaagagcatctcagccagcttttcccaccagtggtgctgttgagatattttaaaatattgcctccgttttatcgaggagagaaataataactaaaaaatataccctttaaaaaaacctatatttctctgtctaaaaatatgggagctgagattccgttcgtggaaaaaagacaaggccaccctctcgccctcagagaggtccacctggtttgtcattgcaatgcttttcattttttttttttgttattgtttcatttcagttccgtcttgctattcttcctaatctatatccatagatctaaggggcaaacagatactagttaactgcccccacctctgtctccctgtcttctttagatcggtctgattgattttaaaagtggacccaaacttagggaattcttgatttagggtggctggtggcaaggaggggcaggggatatggggacgtgactgggacaggttcctgccttatcattttctccctaggacattcccttgtagcccccagaattgtctggcccaaattgaatagaagcagaaaaacatttagggataacatcaggccagtagaattaagcctctccacctgtcccaaccataaaaagggtctcccagctttccatctctggctctatatgctttatcccaaaacaaagcagataacgttcagacgtcggccatttagtaatttaaagcgaatttccagcagcaagcatgctttgatatctggttcagactatcatcaggaagaaaaaaaaatcccacagtacctgaaatgtgattgttgcagtgttcagtttccttgggggcctgctcccttcacaccttgagcccaagtccttttccgttggctgattcagctcccagaagagacgaggaagtgtgtggcaagggactggaaaacttcacttgcttggattaggcaaggctccactcattgttgatatttgcccagcaggaaaatcatgtaagttataccaccagaaagcaaaaggagcatggtttggtggttaaggtttagtgggatgaaggacctgtcttggtgggccgggccctcttgtgccccgtaggctaggtcttagggcaactccttgccctcctgctcagcacctccatttccccatccttggtgagataacaagctatcgcgaaaagcacttgggagatttggatgatttgagaagagtgacttaaaaaaaatgcttctgtgctctaagatatatatgtgtgtgtgtgtgctacatatatatttttaagaaaggaccatctctttaggatatatttttaaattctttgaaacacataaccaaaatggtttgattcactgactgactttgaagctgcatctgccagttacaccccaaatggctttaatcccctctcgggtctggttgccttttgcagtttgggttgtggactcagctcctgtgaggggtctggttaggagagagccatttttaaggacagggagttttatagcccttttctactttcctcccctcctcccagtccttatcaatcttttttcctttttcctgaccccctccttctggaggcagttgggagctatccttgtttatgcctcactattggcagaaaagaccccatttaaaacccagagaacactggagggggatgctctagttggttctgtgtccattttcctctgtgccaaagacagacagacagaggctgagagaggctgttcctgaatcaaagcaatagccagctttcgacacatacctggctgtctgaggaggaaggcctcctggaaactgggagctaagggcgaggcccttcccttcagaggctcctgggggattagggtgtggtgtttgccaagccaaggggtagggagccgagaaattggtctgtcggctcctggttgcactttggggaaggagaggaagtttggggctccaggtagctccctgttgtgggactgctctgtcccctgcccctactgcagagatagcactgccgagttcccttcaggcctggcagacgggcagtgaggaggggcctcagttagctctcaagggtgccttcccctcctcccaacccagacataccctctgccaaactgggaaccagcagtgctagtaactacctcacagagccccagagggcctgcttgagccttcttgctccacaggagaagctggtgcctctaggcaaccccttcctcccacctctcatcaggggtgggggttctcctttctttcccctgaagtgtttatggggagatcctagtggctttgccattcaaaccactcgactgtttgcctgtttcttgaaaaccagtagaagggaaacagcacagcctgtcacagtaattgcaggaagattgaagaaaaatcctcatcaatgccaggggacataaaagccatttcccttccaaatactcgacaatttagatgcagaacatttctctgtattcagacttagagtaacaccagctgaaaactgcagtttctttcctttggatacataaggcttctctatcggggtacgggacagggaggaggcctcatgtctgaagggggatttaggggcgagagccccagccctgaccctcggtcctgtgcaccgctttggggcacagtctgatggcgcctttgctggcgccttagtatggttgactccggatggacaaaagaaaaaaaattttttttcttgaatgaaatagcaggaagctcctcgggagcatgtgttttgattaaccgcaggtgatggatgctacgagtataaatggattaactacctcaatccttacagtaagattggaactaagggcagggactcatgcataagggtatgaatcccagccaggacaagtgagttgaggcttgtgccacaaaaggtttgtccttggggaacaggcaggcctgccaggatcccccccatatcgattgggctgggagggctggccatgaggtccccactttctgctttccttgcccatgtgtcacccctttggcctccagcttgtccctctctcactttctatagctttgttggaccagatggtgaggaaaggaatggcctcttcccttctagagggggctggctggagtgagacctggggcttggcctggaacccaccacacagccccaaagtcaggaagcctggggaaaccagagctgagacctcttcaacagggtttctttgagatcctacacctccattgggccctttttcagtcttcaatgggggcccagttggctctagaaggagaagaggtgaagcaggatcctttgccctgggggagtctgagggcgcggtccttggactcattcaggccgtctttgtagttgggggagttccactgggcgatcccagcccctccccacccaccctctaatggacctcctcatagaagccccatttcacttttgttttatctacctcttagcaaaacaatagataaattaggtagtggcagctccacttgcttaggttagggggggaaaaagatttctttttccaaaggaaaaaaatattaccttgagaatactttccaaaaaataaaattaaaaaaaaaaaaaccaaaaaaaaaaatttttttttaaaagggagacattttccagtgaccactggattgttttaatttcccaagcttttttttcccccataaataagtttcactctttggcgattttcttcacttgtttaagataacgtgctagctattccaacaggtaacagctttcacagtctgcccctggcctgtctcaccccatcccccaccctattcctgccagtgagtccttcctgtgcttctctcccttctcccctcccagccagctgacttcagtcacccctgtcccccctcccctgccaataagctcccccaggaataaaggctttgttttggggatgcttaaatcttgactggcacttcccggctgtgggggctggggagccacttgtaacatttctgtgcagattttatgttagccactgctatgtaaaagcacgttcaaaatgaatttcagcagattatgtgttaccataatgaataaacgtcctctatcaccatttggagtctcccttttctccaggatcttgatcctggtccccaaaaccagagtgaatcaaaagagcttcctcccctgaggcaaagtggatttgtaagcagttctgaaacatcacttactcagaagagggaacgatgtattttgatgagtgcaaattgggaagagctggaggcctactgcttgggacagttttttttttttttttttttttaaatatgagtgctagcttattctgtaattgcggcaactttgaaaattgtattttactggaaatctgccagccatcaccacccgattttgattgtatccttcctcccatcctttaatctgttcattgctttgggggaggtggggcagctggctcacacgttggagtttgttctttgatggatgaacgaacactccagttttctttcccgtgaaggttgtttcagccacaaaccacttcattttgctgtttcaatttcaaaataaaaggaaacttatattgaaagacaa

SEQ ID NO: 55836 - DNA, 1660 bp, Homo sapiens
ggtgcactagcaaaacaaacttattttgaacactcagctcctagcgtgcggcgctgccaatcattaacctcctggtgcaagtggcgcggcctgtgccctttataaggtgcgcgctgtgtccagcgagcatcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaaaaaatggaaggagccctgccgaatagaactctacagagtcgtagagagtttagccaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatatattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaatactgttaaaaaaaaaaa

SEQ ID NO: 55837 - DNA, 1606 bp, Homo sapiens
ggtgcactagcaaaacaaacttattttgaacactcagctcctagcgtgcggcgctgccaatcattaacctcctggtgcaagtggcgcggcctgtgccctttataaggtgcgcgctgtgtccagcgagcatcggccaccgccatcccatccagcgagcatctgccgccgcgccgccgccaccctcccagagagcactggccaccgctccaccatcacttgcccagagtttgggccaccgcccgccgccaccagcccagagagcatcggcccctgtctgctgctcgcgcctggagatgtcagaggtccccgttgctcgcgtctggctggtactgctcctgctgactgtccaggtcggcgtgacagccggcgctccgtggcagtgcgcgccctgctccgccgagaagctcgcgctctgcccgccggtgtccgcctcgtgctcggaggtcacccggtccgccggctgcggctgttgcccgatgtgcgccctgcctctgggcgccgcgtgcggcgtggcgactgcacgctgcgcccggggactcagttgccgcgcgctgccgggggagcagcaacctctgcacgccctcacccgcggccaaggcgcctgcgtgcaggagtctgacgcctccgctccccatgctgcagaggcagggagccctgaaagcccagagagcacggagataactgaggaggagctcctggataatttccatctgatggccccttctgaagaggatcattccatcctttgggacgccatcagtacctatgatggctcgaaggctctccatgtcaccaacatcaacaaggcacaggagacatcaggagaagaaatttccaaattttacctgccaaactgcaacaagaatggattttatcacagcagacagtgtgagacatccatggatggagaggcgggactctgctggtgcgtctacccttggaatgggaagaggatccctgggtctccagagatcaggggagaccccaactgccagatatattttaatgtacaaaactgaaaccagatgaaataatgttctgtcacgtgaaatatttaagtatatagtatatttatactctagaacatgcacatttatatatatatgtatatgtatatatatatagtaactactttttatactccatacataacttgatatagaaagctgtttatttattcactgtaagtttattttttctacacagtaaaaacttgtactatgttaataacttgtcctatgtcaatttgtatatcatgaaacacttctcatcatattgtatgtaagtaattgcatttctgctcttccaaagctcctgcgtctgtttttaaagagcatggaaaaatactgcctagaaaatgcaaaatgaaataagagagagtagtttttcagctagtttgaaggaggacggttaacttgtatattccaccattcacatttgatgtacatgtgtagggaaagttaaaagtgttgattacataatcaaagctacctgtggtgatgttgccacctgttaaaatgtacactggatatgttgttaaacacgtgtctataatggaaacatttacaataaatattctgcatggaaatactgttaaaaaaaaaaa

SEQ ID NO: 55838 - DNA, 1044 bp, Homo sapiens
gaccaaagaggctgggccccgccatgggccagacggcaggcgaccttggctggcggctcagcctgttgctgcttcccttgctcctggttcaagctggtgtctggggattcccaaggcccccagggaggccccagctgagcctgcaggagctgcggagggagttcacagtcagcctgcatctcgccaggaagctgctctccgaggttcggggccaggcccaccgctttgcggaatctcacctgccaggagtgaacctgtacctcctgcccctgggagagcagctccctgatgtttccctgaccttccaggcctggcgccgcctctctgacccggagcgtctctgcttcatctccaccacgcttcagcccttccatgccctgctgggagggctggggacccagggccgctggaccaacatggagaggatgcagctgtgggccatgaggctggacctccgcgatctgcagcggcacctccgcttccaggtgctggctgcaggattcaacctcccggaggaggaggaggaggaagaggaggaggaggaggaggagaggaaggggctgctcccaggggcactgggcagcgccttacagggcccggcccaggtgtcctggccccagctcctctccacctaccgcctgctgcactccttggagctcgtcttatctcgggccgtgcgggagttgctgctgctgtccaaggctgggcactcagtctggcccttggggttcccaacattgagcccccagccctgatcggtggcttcttagccccctgccccccaccctttagaactttaggactggagtcttggcatcagggcagccttcgcatcatcagccttggacaagggagggctcttccagccccctgccccaggctctacccagtaactgaaagcccctctggtcctcgccagctatttatttcttggatatttatttattgtttagggagatgatggtttatttattgtcttggggcccgatggtcctcctcgggccaagcccccatgctgggtgcccaataaagcactctcatcca

SEQ ID NO: 55839 - DNA, 2453 bp, Homo sapiens
cagacatgagctgtgagggtcaagcacagctatccatcagatgatctactttcagccttcctgagtcccagacaatagaagacaggtggctgtacccttggccaagggtaggtgtggcagtggtgtctgctgtcactgtgccctcattggcccccagcaatcagactcaacagacggagcaactgccatccgaggctcctgaaccagggccattcaccaggagcatgcggctccctgatgtccagctctggctggtgctgctgtgggcactggtgcgagcacaggggacagggtctgtgtgtccctcctgtgggggctccaaactggcaccccaagcagaacgagctctggtgctggagctagccaagcagcaaatcctggatgggttgcacctgaccagtcgtcccagaataactcatcctccaccccaggcagcgctgaccagagccctccggagactacagccagggagtgtggctccagggaatggggaggaggtcatcagctttgctactgtcacagactccacttcagcctacagctccctgctcacttttcacctgtccactcctcggtcccaccacctgtaccatgcccgcctgtggctgcacgtgctccccacccttcctggcactctttgcttgaggatcttccgatggggaccaaggaggaggcgccaagggtcccgcactctcctggctgagcaccacatcaccaacctgggctggcataccttaactctgccctctagtggcttgaggggtgagaagtctggtgtcctgaaactgcaactagactgcagacccctagaaggcaacagcacagttactggacaaccgaggcggctcttggacacagcaggacaccagcagcccttcctagagcttaagatccgagccaatgagcctggagcaggccgggccaggaggaggacccccacctgtgagcctgcgacccccttatgttgcaggcgagaccattacgtagacttccaggaactgggatggcgggactggatactgcagcccgaggggtaccagctgaattactgcagtgggcagtgccctccccacctggctggcagcccaggcattgctgcctctttccattctgccgtcttcagcctcctcaaagccaacaatccttggcctgccagtacctcctgttgtgtccctactgcccgaaggcccctctctctcctctacctggatcataatggcaatgtggtcaagacggatgtgccagatatggtggtggaggcctgtggctgcagctagcaagaggacctggggctttggagtgaagagaccaagatgaagtttcccaggcacagggcatctgtgactggaggcatcagattcctgatccacaccccaacccaacaaccacctggcaatatgactcacttgacccctatgggacccaaatgggcactttcttgtctgagactctggcttattccaggttggctgatgtgttgggagatgggtaaagcgtttcttctaaaggggtctacccagaaagcatgatttcctgccctaagtcctgtgagaagatgtcagggactagggagggagggagggaaggcagagaaaaattacttagcctctcccaagatgagaaagtcctcaagtgaggggaggaggaagcagatagatggtccagcaggcttgaagcagggtaagcaggctggcccagggtaagggctgttgaggtaccttaagggaaggtcaagagggagatgggcaaggcgctgagggaggatgcttaggggacccccagaaacaggagtcaggaaaatgaggcactaagcctaagaagttccctggtttttcccaggggacaggacccactgggagacaagcatttatactttctttcttcttttttatttttttgagatcgagtctcgctctgtcaccaggctggagtgcagtgacacgatcttggctcactgcaacctccgtctcctgggttcaagtgattcttctgcctcagcctcccgagcagctgggattacaggcgcccactaatttttgtattcttagtagaaacgaggtttcaacatgttggccaggatggtctcaatctcttgacctcttgatccacccgacttggcctcccgaagtgatgagattataggcgtgagccaccgcgcctggcttatactttcttaataaaaaggagaaagaaaatcaacaaatgtgagtcataaagaagggttagggtgatggtccagagcaacagttcttcaagtgtactctgtaggcttctgggaggtcccttttcaggggtgtccacaaagtcaaagctattttcataataatactaacatgttatttgccttttgaattctcattatcttaaaattgtattgtggagttttccagaggccgtgtgacatgtgattacatcatctttctgacatcattgttaaaaaaaaaaaaaaaaaa

SEQ ID NO: 55840 - DNA, 2920 bp, Homo sapiens
acagggcagcaggagccttagagcatggacggtgccatggggcctcgggggctgctgttgtgcatgtacctggtatctctcctcatcctgcaggccatgcctgccctgggctcggctacaggcaggtccaagagcagcgagaagcgacaggctgtggacaccgctgtcgatggcgtgttcatccggagtttgaaagtcaactgcaaagtcacctctcgcttcgcccactatgttgtcaccagccaagtggtcaacactgccaatgaagccagggaagtggccttcgacctggaaatccccaagacagcattcatcagtgactttgccgttacagcagatggaaacgcatttatcggagacataaaggacaaggtgactgcatggaagcagtaccggaaagcagctatctcaggagagaatgccggccttgtcagggcctcggggagaactatggagcaattcaccatccacctcaccgtcaatccccagagcaaggtcacgtttcagctgacttatgaggaagtgctgaagagaaaccatatgcagtatgaaattgtcatcaaagtcaagcccaagcagctggtgcatcattttgagattgatgtggacatcttcgagccccaggggatcagcaagctggatgcccaggcctctttcctgccgaaggaactggcagcccaaactatcaagaagtccttctcaggaaaaaagggtcatgtgctgttccgtcccaccgtgagccagcagcagtcctgccccacatgctctacatccttactgaacgggcacttcaaggtgacctacgatgtcactcgagacgagatctgcgacctcctggtggccaataaccactttgcccacttctttgccccccaaaacctgacaaacatgaacaagaacgtggtttttgtgattgacatcagtggctccatgagaggccagaaagtgaagcagaccaaggaggcactccttaaaattctgggggacatgcagccaggggactactttgacctggttctttttgggactcgagtacaatcgtggaagggctcgctggtgcaagcatctgaggccaacctacaagcagctcaagactttgtgcggggcttttccctggatgaggccacaaacctgaatggaggtttgctccggggaattgagatcttgaaccaagttcaggaaagcctcccagaactcagcaaccatgcctcaatactcatcatgttgacagatggcgatcccacagagggggtgacggaccgttcccaaatcctcaagaacgtccgcaacgccatccggggcaggttcccgctctacaacctgggtttcggccacaatgtggactttaactttctggaggtcatgtccatggagaacaacggacgggcccagagaatctacgaggaccatgatgccacccagcagctgcagggtttctacagccaggtagccaaacccctgctggtggatgtggatttgcagtacccccaggatgctgtcttggccctgacccagaaccaccataaacagtactacgaaggctcagagattgtggtggccgggcgcattgctgacaacaaacagagcagcttcaaggctgatgtgcaggcccatggggagggacaagaattcagtataacctgcctagtggatgaggaggagatgaagaaactgctccgagagcgtggccacatgctggagaaccacgtcgagcgcctctgggcctacctcaccatccaggagctgctggccaagcggatgaaggtggacagggaggtgagggccaacctgtcatcccaggccctgcggatgtcgctggactatgggtttgtgaccccactgacctccatgagcatcaggggcatggcggaccaggacggcctgaagcccaccatcgacaagccctcagaggattctccgcctttggagatgctgggacccagaaggacgttcgtgctgtcagccttgcagccttctcctactcattccagctccaatacccagcggctgccagaccgagtgaccggcgtggacacagaccctcacttcatcatccacgtgccccagaaagaggacaccctgtgcttcaacatcaatgaggagcctggtgttatcctgagcctggtacaggaccccaacacaggcttctcagtgaatggacagctcattggcaacaaggccaggagccctgggcagcatgacggcacgtacttcgggcggctgggaatcgcaaaccctgccacggactttcagttggaagtgactcctcagaacattacgctgaaccccggctttggtgggcctgtgttttcctggagggaccaagctgtgctgcggcaggacggggtggtggtgaccatcaacaagaagaggaacctggtggtgtctgtggacgacggtggcacctttgaggttgttttgcaccgagtgtggaaggggagctcggtccaccaggacttcctgggcttctatgtgctggacagtcatcggatgtcagcccggacgcacgggctgctggggcaatttttccaccccatcggttttgaagtgtctgacatccacccaggctccgaccccacaaagccagatgccacgatggtggtgaggaaccgccggctcacggtcaccaggggtttgcaaaaagactacagcaaggacccgtggcatggggccgaggtgtcctgctggttcattcacaacaatggggctggactcatcgatggtgcctacactgattatatcgtccccgacatcttctgagccctctggccagcacgcctgtcctcccccggggccaaggcagaggaggaggacgacatcctgacctgctgctgaggctgtacctccttgactaagctggttccttgtgtcaaagcacctcatgccttccattaaagagaggccgtgtccaaaaaaaaaa

SEQ ID NO: 55841 - DNA, 3198 bp, Homo sapiens
gtcccaattttgaacaaagttagagagttttttcttcttttttcttctttcttaaagcgaactgtactcctctgctgttcctttgaacttggttcagtaggaagaagtgatatcctccccagaccatctgctttggggagcttggcaaaactgtccagcaaaatgaaaagactcacgtgctttttcatctgcttctttctttctgaagtatcaggcttcgaaatccccataaatggactttctgaatttgtagactatgaagatcttgtggaactggccccaggcaaatttcaattggtggcagagaaccggagatatcagagaagccttccaggagaatcggaagaaatgatggaagaggttgatcaagtaactctttatagctataaagtccagtctactattacttctcggatggccaccaccatgatccagagcaaagtggtgaacaattccccgcagcctcagaatgtcgtgtttgatgttcagatccccaaaggagcattcatttccaacttctccatgactgtggacggcaagacatttaggagctctattaaggagaaaactgtgggccgagctctttatgcacaggccagagcaaaaggcaagacggctggcttggtgaggagcagcgctcttgatatggaaaacttcagaacggaagtaaatgtcctcccaggagcaaaggtgcagttcgaacttcactaccaggaggtgaagtggaggaagctgggctcctatgagcacaggatctatctgcaacctggacggctggccaaacacttagaggtagatgtgtgggttatcgaaccacagggactgagatttcttcatgttcccgacacatttgaaggccatttcgatggtgttccggtcatttctaaaggacaacagaaggcgcacgtctccttcaagcccacggtagcacagcagagaatatgccctaactgccgggagactgcggtagatggggaactggtggtgctgtatgacgtgaaaagagaagagaaggctggtgaactggaggtgtttaatggatattttgtccacttctttgctcctgacaacctggacccaattcccaaaaacatcctctttgtcatcgatgtgagtggctccatgtggggagttaaaatgaaacaaactgtggaagcaatgaagaccatattggatgacctcagagcagaagaccatttctctgtgattgatttcaaccagaacattcgaacttggagaaatgatttaatttcagctacaaaaacacaggttgcagatgccaagaggtatattgagaaaatccagcccagtggaggcacaaacatcaacgaagcactcctacgggcaatcttcattttgaatgaagccaataacttgggactgttagaccccaactccgtctcgctgatcattttggtttctgatggagatccaacagtgggcgaactaaaactgtcaaaaattcagaaaaacgttaaggagaacatccaagacaatatctccttgttcagtttgggcatgggatttgatgtggactatgattttttgaagagactgtccaatgaaaaccatggaattgcacaaaggatttatggaaaccaggacacgtcttcccagcttaagaaattctacaaccaggtctccactccattgctccggaatgttcagttcaactatccccatacatcagtcacggacgtcactcaaaacaatttccataactactttggaggctcagagattgtggtggcaggaaaatttgaccctgctaaattggatcaaatagagagcgttatcacggcgacttcggctaacacgcagttagtcttggagaccctggcccagatggacgacttgcaggattttctatcgaaagacaagcatgcagatcccgatttcaccaggaaactgtgggcctatctaaccatcaaccaactgctagctgaacgaagcctggctcctacagctgccgccaagagaagaattacaagatcgatcctgcagatgtctctagaccaccacattgtgactccgctgacctcgctggtgatcgagaacgaggctggggatgagcgcatgctggcggatgccccaccgcaggatccctcctgctgctcaggggccctgtattacggcagcaaagtggttccagattccaccccgtcttgggccaatccttcaccaacgcccgtgatctccatgctggcacaaggatctcaggtgctagagtccacgccacccccacatgtgatgagagttgaaaatgacccacatttcatcatttatctaccaaaaagccaaaagaacatttgtttcaatattgactcagaacctggaaaaatcctcaacctggtttctgacccagaatcaggaattgtagtcaacggtcagcttgttggtgccaagaagcccaacaatggaaaactaagcacctattttggaaaactgggattttatttccaaagtgaagacataaaaatagaaatcagcactgagaccatcaccctgagccatggttctagcacattctccttgtcctggtccgacacggctcaagtcacgaatcagagggtgcagatctcagtgaagaaagaaaaagtggtaactatcaccctggataaagagatgtccttttctgttttacttcatcgtgtttggaagaagcatcccgtcaatgttgactttctgggaatctacataccccctacaaacaagttctcacctaaagcccacggactaataggccagttcatgcaggaaccaaagatacacatcttcaatgagagaccaggaaaggaccctgagaagccagaggccagcatggaagtgaaggggcagaagctgatcatcaccaggggcttacagaaagactacagaacggatctagtgtttggaacggacgttacctgctggtttgtgcacaacagtggaaaaggattcattgacgggcattacaaggattacttcgtgcctcagctctacagctttctcaaacggccttaaaggtttatagtttgggaaattatatatattaatatacatctttcccctgtcacttttgcagatattcttcggtttgaataattaaaatgaaccagatatcagggtggttaattaaaatgaaccagatatcagggtggtttataaagcctgtaaacacacctaagaaaataaacattttacaaatgaaaaaaaaaa

SEQ ID NO: 55842 - DNA, 2809 bp, Homo sapiens
tcagcgatggcatttgcatggtggccctgtctcatcttggctctgctctccagcttggcagcctctggcttcccgagaagcccctttcggctgcttgggaaacggagcctcccggaaggggtggccaatggcatcgaggtctacagtaccaaaatcaactccaaggtgacctcccgttttgctcacaatgttgtcaccatgagagccgtcaaccgtgcagacacggccaaggaggtttcctttgatgtggagctgcccaagacggccttcatcaccaacttcaccttgaccatcgacggtgttacctaccctgggaatgtcaaggagaaggaagttgccaagaagcagtatgaaaaggctgtgtcccagggcaagacggccggcttggtcaaggcctctgggaggaagttggagaagttcacagtctcggtcaacgtggctgcaggcagcaaagtcaccttcgagctaacctacgaggagctgctgaagaggcacaagggcaagtacgagatgtacctcaaggtccagcctaagcaactggtcaaacactttgagatcgaggtagacatcttcgagcctcagggaatcagcatgctggatgctgaggcctctttcatcaccaacgacctcctgggaagcgccctcaccaagtccttctcagggaaaaagggccatgtgtccttcaagcccagcttagaccaacagcgttcatgcccaacctgtacagactccctcctcaatggagatttcactatcacctatgacgtgaacagagaatctcctggcaacgtgcagatagtcaatggctacttcgtgcacttctttgcacctcaaggccttccagtggtgcctaagaacgtggcctttgtgattgacatcagcggctccatggctggtcggaaattagagcagacaaaggaggcccttctcagaatcctggaagatatgaaagaggaagactatctgaatttcatcctgttcagtggagatgtgtccacatggaaagagcacttagtccaggccacgcccgagaacctccaggaggccaggacgtttgtgaagagcatggaggataaaggaatgaccaacatcaatgacgggctgctgaggggcatcagtatgctgaacaaggcccgagaggagcacagaatcccagagaggagcacctccattgtcatcatgctgactgatggggatgccaatgttggtgagagcagacccgaaaaaatccaagagaatgtgcggaatgccatcgggggcaagttccccttgtataacctgggctttggcaacaatctgaattataacttcctggagaacatggccctggagaaccatgggtttgcccggcgcatttatgaggactctgatgccgatttgcagttgcagggcttctatgaggaggtggccaacccactgctgacgggtgtggagatggagtaccccgagaacgctatcctggacctcacccagaacacttaccagcacttctacgatggctctgagatcgtggtggccgggcgcctggtggacgaggacatgaacagctttaaggcagatgtgaagggccatggggccaccaacgacctgaccttcacagaggaggtggacatgaaggagatggagaaggccctgcaggagcgggactacatcttcgggaattacattgagcggctctgggcctacctcaccattgagcagctgctggagaagcgcaagaacgcccatggcgaggagaaggagaacctcacggcccgggccctggacctgtccctcaagtatcactttgtgactccactgacctcaatggtggtgaccaagcctgaggacaacgaggatgagagggccattgccgacaagcctggggaagatgcagaagccacaccggtgagccccgccatgtcctacctgaccagctaccagcctcctcaaaacccctactactatgtggacggggatccccacttcatcatccaaattccggagaaagacgatgccctctgcttcaacatcgatgaagccccaggcacagtgctgcgccttattcaggatgcagtcacaggcctcacagttaatgggcagatcactggcgacaagagaggcagccctgactccaagaccagaaagacttactttggaaaactgggcatcgccaatgctcagatggacttccaggtggaggtgacaacggagaagatcaccctgtggaacagggccgtgccgagcactttcagctggctggacacagtcacagtcacgcaggatgggctgtccatgatgatcaacaggaagaacatggtggtctcctttggagatggggttaccttcgtggtcgtcctacaccaggtgtggaagaaacatcctgtccaccgtgactttctaggcttctacgtggtggacagtcaccggatgtcagcacagacgcatgggctgctggggcaattcttccaaccctttgactttaaagtgtctgacatccggccaggctctgaccccacaaagccagatgccacattggtggtgaagaaccatcagctgattgtcaccaggggctcccagaaagactacagaaaggatgccagcatcggcacgaaggttgtctgctggttcgtccacaacaacggagaagggctgattgatggtgtccacactgactacattgtccccaacctgttttgagtagacacaccagctcctgttgggatggatggcccggattttatggcatctggaacatgggcacagagaggggcctgtgggaggggctgggaaaataaagtccaaggtcgagaccagaaaaaaaaaaaaa

SEQ ID NO: 55843 - DNA, 3260 bp, Homo sapiens
gagttcagaagcctcctggcagacactggagccacgatgaagcccccaaggcctgtccgtacctgcagcaaagttctcgtcctgctttcactgctggccatccaccagactactactgccgaaaagaatggcatcgacatctacagcctcaccgtggactccagggtctcatcccgatttgcccacacggtcgtcaccagccgagtggtcaatagggccaatactgtgcaggaggccaccttccagatggagctgcccaagaaagccttcatcaccaacttctccatgatcatcgatggcatgacctacccagggatcatcaaggagaaggctgaagcccaggcacagtacagcgcagcagtggccaagggaaagagcgctggcctcgtcaaggccaccgggagaaacatggagcagttccaggtgtcggtcagtgtggctcccaatgccaagatcacctttgagctggtctatgaggagctgctcaagcggcgtttgggggtgtacgagctgctgctgaaagtgcggccccagcagctggtcaagcacctgcagatggacattcacatcttcgagccccagggcatcagctttctggagacagagagcaccttcatgaccaaccagctggtagacgccctcaccacctggcagaataagaccaaggctcacatccggttcaagccaacactttcccagcagcaaaagtccccagagcagcaagaaacagtcctggacggcaacctcattatccgctatgatgtggaccgggccatctccgggggctccattcagatcgagaacggctactttgtacactactttgcccccgagggcctaaccacaatgcccaagaatgtggtctttgtcattgacaagagcggctccatgagtggcaggaaaatccagcagacccgggaagccctaatcaagatcctggatgacctcagccccagagaccagttcaacctcatcgtcttcagtacagaagcaactcagtggaggccatcactggtgccagcctcagccgagaacgtgaacaaggccaggagctttgctgcgggcatccaggccctgggagggaccaacatcaatgatgcaatgctgatggctgtgcagttgctggacagcagcaaccaggaggagcggctgcccgaagggagtgtctcactcatcatcctgctcaccgatggcgaccccactgtgggggagactaaccccaggagcatccagaataacgtgcgggaagctgtaagtggccggtacagcctcttctgcctgggcttcggtttcgacgtcagctatgccttcctggagaagctggcactggacaatggcggcctggcccggcgcatccatgaggactcagactctgccctgcagctccaggacttctaccaggaagtggccaacccactgctgacagcagtgaccttcgagtacccaagcaatgccgtggaggaggtcactcagaacaacttccggctcctcttcaagggctcagagatggtggtggctgggaagctccaggaccgggggcctgatgtgctcacagccacagtcagtgggaagctgcctacacagaacatcactttccaaacggagtccagtgtggcagagcaggaggcggagttccagagccccaagtatatcttccacaacttcatggagaggctctgggcatacctgactatccagcagctgctggagcaaactgtctccgcatccgatgctgatcagcaggccctccggaaccaagcgctgaatttatcacttgcctacagctttgtcacgcctctcacatctatggtagtcaccaaacccgatgaccaagagcagtctcaagttgctgagaagcccatggaaggcgaaagtagaaacaggaatgtccactcaggttccactttcttcaaatattatctccagggagcaaaaataccaaaaccagaggcttccttttctccaagaagaggatggaatagacaagctggagctgctggctcccggatgaatttcagacctggggttctcagctccaggcaacttggactcccaggacctcctgatgttcctgaccatgctgcttaccaccccttccgccgtctggccatcttgcctgcttcagcaccaccagccacctcaaatcctgatccagctgtgtctcgtgtcatgaatatgaaaatcgaagaaacaaccatgacaacccaaaccccagcccccatacaggctccctctgccatcctgccactgcctgggcagagtgtggagcggctctgtgtggaccccagacaccgccaggggccagtgaacctgctctcagaccctgagcaaggggttgaggtgactggccagtatgagagggagaaggctgggttctcatggatcgaagtgaccttcaagaaccccctggtatgggttcacgcatcccctgaacacgtggtggtgactcggaaccgaagaagctctgcgtacaagtggaaggagacgctattctcagtgatgcccggcctgaagatgaccatggacaagacgggtctcctgctgctcagtgacccagacaaagtgaccatcggcctgttgttctgggatggccgtggggaggggctccggctccttctgcgtgacactgaccgcttctccagccacgttggagggacccttggccagttttaccaggaggtgctctggggatctccagcagcatcagatgacggcagacgcacgctgagggttcagggcaatgaccactctgccaccagagagcgcaggctggattaccaggaggggcccccgggagtggagatttcctgctggtctgtggagctgtagttctgatggaaggagctgtgcccaccctgtacacttggcttccccctgcaactgcagggccgcttctggggcctggaccaccatggggaggaagagtcccactcattacaaataaagaaaggtggtgtgagcctgggaagtgggtgtctccagttccatgtggccaaatcctagggcctcaacctcgcatcctgaaccttagcatcgtggaacacagaagcttccactgtcagctctcaagagcccatggccaggaaggcccatgctgagctttcagtccagccccttcattttacaaacaaggaaactgagctcgaaccacccatttgagatgtcactgtggcccccagctagaggcccagggctgggagcattctccaggagcagaggttcagtctgcttcatggtctcttggaccagttttgactaca

SEQ ID NO: 55844 - DNA, 1618 bp, Homo sapiens
tcagagttcacgaggcagccgaggaagaggaggcttgaggcccagggtgggcaccagccagccatggccacagccgagaccgccttgccctccatcagcacactgaccgccctgggccccttcccggacacacaggatgacttcctcaagtggtggcgctccgaagaggcgcaggacatgggcccgggtcctcctgaccccacggagccgcccctccacgtgaagtctgaggaccagcccggggaggaagaggacgatgagaggggcgcggacgccacctgggacctggatctcctcctcaccaacttctcgggcccggagcccggtggcgcgccccagacctgcgctctggcgcccagcgaggcctccggggcgcaatatccgccgccgcccgagactctgggcgcatatgctggcggcccggggctggtggctgggcttttgggttcggaggatcactcgggttgggtgcgccctgccctgcgagcccgggctcccgacgccttcgtgggcccagccctggctccagccccggcccccgagcccaaggcgctggcgctgcaaccggtgtacccggggcccggcgccggctcctcgggtggctacttcccgcggaccgggctttcagtgcctgcggcgtcgggcgccccctacgggctactgtccgggtaccccgcgatgtacccggcgcctcagtaccaagggcacttccagctcttccgcgggctccagggacccgcgcccggtcccgccacgtccccctccttcctgagttgtttgggacccgggacggtgggcactggactcggggggactgcagaggatccaggtgtgatagccgagaccgcgccatccaagcgaggccgacgttcgtgggcgcgcaagaggcaggcagcgcacacgtgcgcgcacccgggttgcggcaagagctacaccaagagctcccacctgaaggcgcatctgcgcacgcacacaggggagaagccatacgcctgcacgtgggaaggctgcggctggagattcgcgcgctcggacgagctgacccgccactaccggaaacacacggggcagcgccccttccgctgccagctctgcccacgtgctttttcgcgctctgaccacctggccttgcacatgaagcgccacctttgagccctgccctggcacttggactctcctagtgactggggatgggacaagaagcctgtttggtggtctcttcacacggacgcgcgtgacacaatgctgggtggttttcccacgaatggaccctctcctggactcgcgttcccaaagatccacccaaatatcaaacacggacccatagacagccctgggggagcctcttacggaaaatccgacaagccttcagccacagggagccacacagagatgtccaaactgtcgtgcaaacccagtgagacagaccgccaaataaacggactcagtggacactcagaccagctcccagatggccctggacagcaggagagggtgtgggatgaggcttcccagagaccctgggtctagaaagcggctcctgaaggtcccttattgtggctgatattaactgtcaatggttatgggtcctataaaaatgcccctcccagataaaaaa

SEQ ID NO: 55845 - DNA, 2252 bp, Homo sapiens
agaacagcttgaagaccgttcatttttaagtgacaagagactcacctccaagaagcaattgtgttttcagaatgattttattcaagcaagcaacttatttcatttccttgtttgctacagtttcctgtggatgtctgactcaactctatgaaaacgccttcttcagaggtggggatgtagcttccatgtacaccccaaatgcccaatactgccagatgaggtgcacattccacccaaggtgtttgctattcagttttcttccagcaagttcaatcaatgacatggagaaaaggtttggttgcttcttgaaagatagtgttacaggaaccctgccaaaagtacatcgaacaggtgcagtttctggacattccttgaagcaatgtggtcatcaaataagtgcttgccatcgagacatttataaaggagttgatatgagaggagtcaattttaatgtgtctaaggttagcagtgttgaagaatgccaaaaaaggtgcaccagtaacattcgctgccagtttttttcatatgccacgcaaacatttcacaaggcagagtaccggaacaattgcctattaaagtacagtcccggaggaacacctaccgctataaaggtgctgagtaacgtggaatctggattctcactgaagccctgtgccctttcagaaattggttgccacatgaacatcttccagcatcttgcgttctcagatgtggatgttgccagggttctcactccagatgcttttgtgtgtcggaccatctgcacctatcaccccaactgcctcttctttacattctatacaaatgtatggaaaatcgagtcacaaagaaatgtttgtcttcttaaaacatctgaaagtggcacaccaagttcctctactcctcaagaaaacaccatatctggatatagccttttaacctgcaaaagaactttacctgaaccctgccattctaaaatttacccgggagttgactttggaggagaagaattgaatgtgacttttgttaaaggagtgaatgtttgccaagagacttgcacaaagatgattcgctgtcagtttttcacttattctttactcccagaagactgtaaggaagagaagtgtaagtgtttcttaagattatctatggatggttctccaactaggattgcgtatgggacacaagggagctctggttactctttgagattgtgtaacactggggacaactctgtctgcacaacaaaaacaagcacacgcattgttggaggaacaaactcttcttggggagagtggccctggcaggtgagcctgcaggtgaagctgacagctcagaggcacctgtgtggagggtcactcataggacaccagtgggtcctcactgctgcccactgctttgatgggcttcccctgcaggatgtttggcgcatctatagtggcattttaaatctgtcagacattacaaaagatacacctttctcacaaataaaagagattattattcaccaaaactataaagtctcagaagggaatcatgatatcgccttgataaaactccaggctcctttgaattacactgaattccaaaaaccaatatgcctaccttccaaaggtgacacaagcacaatttataccaactgttgggtaaccggatggggcttctcgaaggagaaaggtgaaatccaaaatattctacaaaaggtaaatattcctttggtaacaaatgaagaatgccagaaaagatatcaagattataaaataacccaacggatggtctgtgctggctataaagaagggggaaaagatgcttgtaagggagattcaggtggtcccttagtttgcaaacacaatggaatgtggcgtttggtgggcatcaccagctggggtgaaggctgtgcccgcagggagcaacctggtgtctacaccaaagtcgctgagtacatggactggattttagagaaaacacagagcagtgatggaaaagctcagatgcagtcaccagcatgagaagcagtccagagtctaggcaatttttacaacctgagttcaagtcaaattctgagcctggggggtcctcatctgcaaagcatggagagtggcatcttctttgcatcctaaggacgaaaaacacagtgcactcagagctgctgaggacaatgtctggctgaagcccgctttcagcacgccgtaaccaggggctgacaatgcgaggtcgcaactgagatctccatgactgtgtgttgtgaaataaaatggtgaaagatcaaaaaa

SEQ ID NO: 55846 - DNA, 4992 bp, Homo sapiens
cagaagcaacaataattgtgaaaaatacttcagcagttatggactcatctgtcattcaaaggaaaaaagtagctgtcattggtggtggcttggttggctcattacaagcatgctttcttgcaaagaggaatttccagattgatgtatatgaagctagggaagatactcgagtggctaccttcacacgtggaagaagcattaacttagccctttctcatagaggacgacaagccttgaaagctgttggcctggaagatcagattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcactttaaccacaggctgttgaaatgtaatccagaggaaggaatgatcacagtgcttggatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatgaacaaatcattcacatgtactttgttcatgccctttgaagagtttgaaaaacttctaaccagtaatgatgtggtagatttcttccagaaatactttccggatgccatccctctaattggagagaaactcctagtgcaagatttcttcctgttgcctgcccagcccatgatatctgtaaagtgctcttcatttcactttaaatctcactgtgtactgctgggagatgcagctcatgctatagtgccgttttttgggcaaggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagagatgcgagcacatgtcaactcaagctggttcatttttcagaagaacatggagagatttcttcatgcgattatgccatcgacctttatccctctctatacaatggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctctgcttgagaagaccatggaactggatagctcacttccggaatacaacatgtttccccgcaaaggccgtggactccctagaacaaatttccaatctcattagcaggtgatagaaaggttttgtggtagcaaatgcatgatttctctgtgaccaaaattaagcatgaaaaaaatgtttccattgccatatttgattcactagtggaagatagtgttctgcttataattaaactgaatgtagagtatctctgtatgttaattgcaattactggttggggggtgcattttaaaagatgaaacatgcagcttccctacattacacacactcaggttgagtcattctaactataaaagtgcaatgactaagatccttcacttctctgaaagtaaggccctagatgcctcagggaagacagtaatcatgccttttctttaaaagacacaataggactcgcaacagcattgactcaacacctaggactaaaaatcacaacttaactagcatgttaactgcacttttcattacgtgaatggaacttacctaaccacagggctcagacttactagataaaaccagaaatggaaataaggaattcaggggagttccagagacttacaaaatgaactcattttattttcccaccttcaaatataagtattatcatctatctgtttatcgtctatctatctatcatctatctatctatctatcatctatctatctatctatctatctatctatctatctatctatctatctatctctatttatttatgtatttagagatcaggtctcactctgttgaccaggctggagtgcagtggtgagatctgggttcactgcaacctctgcctcctgggctcaagcaatcctcccacttcagcctcccaaatagctggggctaccatggtatttttcagtagagaccgggtcttgccatgctgcccaggccagtctcaaactcctggcctcatgtgatctgcccacctcagcctcccaaagtacagggattagagttgtgagccaccgctgccagcccagagttaccctctaaagataagaaaaaggctattaatatcatactaagtgaaggacaggaaagggttttattcataaattaaatgtctacatgtgccagaatggaaaggaaacaaggggagacaacttttatagaaatacaaagccattactttattcaatttcagaccctcagaagcaatttactaatttattcttcgactacatactgcagcagaaccagcaatacacttgatttttaaaagcacatttagtgaaatgttttctttggttcatccttctttaacaggctgctgagtcactcagaaatccttcaaacatgattaattatgaagatgaaacactagagtcatataagaaataaaaattgggcaataaaataaaatgattcagtgtttcttttctatattgtcaatgaaaaccttgagttctaataatccatgttcagtttgtagggaaagaaaaaataatttttccttctacccactttaggttccttggctggggcccctataacaaaagacagattgacaagagaaaaacaaacataaatttattagcgggtatatgtaatatatatgtgggaaatacaggggaatgagcaaatctcaaagagctggcgtcttagaactccctggcttatatagcatcgacaaagaacagtaaatttttagagaaacaacaaaacaaagaaaaagagctttgagtctgtaggggcagcaatttgggggaagcaaatatatgggagtttgccttgtagattcctctggtggtggtctccaggctgacaaggattcaaagttgtctctgaaactcctctttgtcatactgcacatataaaacgtcttttgtttccaacaagaggatttctttttcattctagaattatctccttgataacttgatcagatataggacatgacactgaatagagtccaacagtacaaaaaaaattcagtatgttctagctacttcacacatgtgtacgcgacagttatttttacagtaaggtattttcgagaaaaatgcattacgtgttttggaaaatagagtaatttaaaaaatatatttgaaatgaaaatctccaacacattagaagatgatgatgttagatgcccatcgtgtgccacaagtggttttttcattatgtaaagcacccgttgaattaaaagaatttgtttttgttcaacctcttcctgaggcccaagagcatatgggcaattcggatttcctgctggaccacaaggttctgttgatattacatagaaacgggtattccagacacttcttatgatgaaagtccaaaagtggcatccaatttaaggccccatctttcgttgccattcttcattcctacaaaggacgaacttggattacatcaactttggacccattggttttgtcgctgtcgtcaactgacagtgattcaccactggtgatgataaaaatgatggaagaagagttgaaagtcacttttttctttggcctgtccccatctttctgtgacatcacaatgggtctgatctgcatttcacttccagctgctggtaggtctttagcaggcctctggcacctcagcagtcggaggcacagaagctgcaaaagggatcttcgaaactgggcagagaaaaaataaagtggaatattaagtaaaagttgggcactaatctggattaacattcgaggaaatcagttgagctgatttaagttgttttttgtttgttagcaggtgtggatgtggggttatgtggtcatgctcagatctacctaaatcaccccagagctttatgtcttttattcattctaaatcttattaaccggaatatgtaggaccatttcaataccttgtaatcctccaagcttcaatctgcacacactttctatgagggcaggtacaactattaagagattttgaacattaagttagtccacaaatattcagtgggcatctactaggtgacagccactgtgctataattagagactttttactataagcatcaaaaacagataaggctcttcctggcagagtttacagcctggtgtacttgctaatgtctctttaattaggtgaagaattttttttttctatcgaaattactaatcagttggggaaaaaaatactatagcagacagcactaatgtcatcaacaaacattgttcttctccgtgtcctgggtacaacatcgaataatatttcttggcctcctttccgcttctcctctctgctgttcctctctacaagaacctgggaggccaacgcctaaagatcataatatcacaatggaaggaacctagattcctaaatgactgcataggacagatcccatctcctccacccaatacattattagactgaactgtgacctgaaatgagcaataaactctgtattaattcactgaaatgttggggttgcttgttatagtagtcggtccatcatgaccagtaaaacataaatcaaaagttaatgtaattgttatcccattatttagagcgaaataaatgttgaatatatggactttctcagattaggaaataccaattaaaaatataataaatagct

SEQ ID NO: 55847 - DNA, 1823 bp, Homo sapiens
gggacagtcctggcccactgcactgggaatctaggatgggggccttggccagagccctgccgtccatactgctggcattgctgcttacgtccaccccagaggctctgggtgccaaccccggcttggtcgccaggatcaccgacaagggactgcagtatgcggcccaggaggggctattggctctgcagagtgagctgctcaggatcacgctgcctgacttcaccggggacttgaggatcccccacgtcggccgtgggcgctatgagttccacagcctgaacatccacagctgtgagctgcttcactctgcgctgaggcctgtccctggccagggcctgagtctcagcatctccgactcctccatccgggtccagggcaggtggaaggtgcgcaagtcattcttcaaactacagggctcctttgatgtcagtgtcaagggcatcagcatttcggtcaacctcctgttgggcagcgagtcctccgggaggcccacagttactgcctccagctgcagcagtgacatcgctgacgtggaggtggacatgtcgggagacttggggtggctgttgaacctcttccacaaccagattgagtccaagttccagaaagtactggagagcaggatttgcgaaatgatccagaaatcggtgtcctccgatctacagccttatctccaaactctgccagttacaacagagattgacagtttcgccgacattgattatagcttagtggaagcccctcgggcaacagcccagatgctggaggtgatgtttaagggtgaaatctttcatcgtaaccaccgttctccagttaccctccttgctgcagtcatgagccttcctgaggaacacaacaaaatggtctactttgccatctcggattatgtcttcaacacggccagcctggtttatcatgaggaaggatatctgaacttctccatcacagatgacatgataccgcctgactctaatatccgactgaccaccaagtccttccgacccttcgtcccacggttagccaggctctaccccaacatgaacctggaactccagggatcagtgccctctgctccgctcctgaacttcagccctgggaatctgtctgtggacccctatatggagatagatgcctttgtgctcctgcccagctccagcaaggagcctgtcttccggctcagtgtggccactaatgtgtccgccaccttgaccttcaataccagcaagatcactgggttcctgaagccaggaaaggtaaaagtggaactgaaagaatccaaagttggactattcaatgcagagctgttggaagcgctcctcaactattacatccttaacaccttctaccccaagttcaatgataagttggccgaaggcttcccccttcctctgctgaagcgtgttcagctctacgaccttgggctgcagatccataaggacttcctgttcttgggtgccaatgtccaatacatgagagtttgaggacaagaaagatgaagcttggaggtcacagctggatctgcttgttgcatttccagctgtgcagcacgtctcagagattcttgaagaatgaagacatttctgctctcagctccgggggtgaggtgtgcctggcctctgcctccaccctcctcctcttcaccaggtgcatgcatgccctctctgagtctggactttgcttcccctccaggagggaccaccctccctgactggcctgggatatctttacaagcaggcactgtatttttttattcgccatctgatccccatgcctagcagagtgctggcacttagtaggtcctcaataaatatttattaaatgat

SEQ ID NO: 55848 - DNA, 1856 bp, Homo sapiens
aggactagaatcaggacagtcagatctgtggtcacatcctgcccaattccagctctgaggtccatcaaaccatctgcttctcccttggcaagaagctccctctgtctgactggcagcagggtcagtggccatccttttctaccttcagctgttgcgcatctcctccacgttttcctggagtaaaggaacaagcaggttcttatccaaatacccaacctgtgaagatgagacggcccttgggaagaggtattagccaagttttcagtatgatgcccggcagaaagaatttgttgtctttgtcttaagcttattatcctcccaggtcataggaagatctaaagtccaatcaatctccttactcagaattcacagctttcccctcaaacttaaaatgcccatgtcatttcacgagtacccataactacccatcgtttagatacatgtcctcccttggactagaaatctgcagcagttcctacttaaactgatggatgctttgggctttggaggtatctcatccctatgcctgttgccctgaagctgccggaaggaaaggccccactcaactactgggaagaaagcccataattcaaggcttttaatacagtcactacacaagctctccctctgatttaggagatcttgttacctcctcatctacatgtgcttaaaaacaaaaagaaacctataattattcaattcacctgtggtccaaataagtctcacatccagccattcccctgagagggcaggaggccagactttgaactttccacagctgggtcttcattttactagtgagataaagaggtgcagattagggtgacagtccatctaagcaagtggacgatctggggaactgtaggccttgctgaagcatcctcccacagaaaggagataagggccttatccaattggctgtacacaatagatcagtgcttctttcctagacaaggctgaaaggggccaacattatttctgaagacttcattattggaattctatgggagtgatctcactgagctattttggaatagaaatgtggctagttgcctgacctccctcaatggtttcacgtggctttcaaagggaaggaagggcagtgctgacttttggtaaaatgggcgaaagggtccatgccagcaacacaatcactcaaagtccagatgagggatcagtaaatacaacgtgcctgaaaggtggcccttgagcacattcctccggtagacattaacttattaaattgattctgattacaaatataaactttgcccccatctcacccagtaacaatgcaagagttgatgtcagtctataaaaggaagtaggaactgtccctggctttcaggctccaacatcctccccctgtcaagatgtggcacctcaaactttgtgcagtcctcatgatcttcctgttgctgttgggccagatagatggctccccaataccagaagtgagttcggcaaagagaaggccacggagaatgaccccattttggagaggggtttccctcaggcctattggagcctcctgccgggatgattctgagtgtatcacaaggctatgcagaaaaagacgctgttccttaagtgtggcccaggaatgatgtacataccagggaaagaaaggacagcagtcacctccgacaatgctccgttctatggaatattgattaactgcattttggctggagacacccaagtgaagcaatcttgtatttttaatatttaaaggcagatgtacgctttaaattggtctccatttcttcttagaatgttgatatatggataagcataactaaacttgtcaatttagagtttatttttctatggatactattaaatgtctcaaattg

SEQ ID NO: 55849 - DNA, 1743 bp, Homo sapiens
gtaatttcgacctgtcctttcccgggagttagcgatccctcaacccctgcactgcgctagtcctaaagaggaaatgtctctacgctgcggggatgcagcccgcaccctggggccccgggtatttgggagatatttttgcagcccagtcagaccgttaagctccttgccagataaaaaaaaggaactcctacagaatggaccagaccttcaagattttgtatctggtgatcttgcagacaggagcacctgggatgaatataaaggaaacctaaaacgccagaaaggagaaaggttaagactacctccatggctaaagacagagattcccatggggaaaaattacaataaactgaaaaatactttgcggaatttaaatctccatacagtatgtgaggaagctcgatgtcccaatattggagagtgttggggaggtggagaatatgccaccgccacagccacgatcatgttgatgggtgacacatgtacaagaggttgcagattttgttctgttaagactgcaagaaatcctcctccactggatgccagtgagccctacaatactgcaaaggcaattgcagaatggggtctggattatgttgtcctgacatctgtggatcgagatgatatgcctgatgggggagctgaacacattgcaaagaccgtatcatatttaaaggaaaggaatccaaaaatccttgtggagtgtcttactcctgattttcgaggtgatctcaaagcaatagaaaaagttgctctgtcaggattagatgtgtatgcacataatgtagaaacagtcccggaattacagagtaaggttcgtgatcctcgggccaattttgatcagtccctacgtgtactgaaacatgccaagaaggttcagcctgatgttatttctaaaacatctataatgttgggtttaggcgagaatgatgagcaagtatatgcaacaatgaaagcacttcgtgaggcagatgtagactgcttgactttaggacaatatatgcagccaacaaggcgtcaccttaaggttgaagaatatattactcctgaaaaattcaaatactgggaaaaagtaggaaatgaacttggatttcattatactgcaagtggccctttggtgcgttcttcatataaagcaggtgaatttttcctgaaaaatctagtggctaaaagaaaaacaaaagacctctaaaacttcaacaagaccttcaagatcacagaaatttttaaaatttgattccagttaataacagaggtggtgccagaatgcctggactgcagtggatgtgccccacctctttgcttaaaaaaaaaaatgtcaatagccaggcatagtggctcacgcctgtaatcccagcactttaggaggccaaggcgggtggatcacctgaggtcaggagttcgagaccagcctggccaacatggtgaaatcctgtctccactaaaaacacaaaaattagtcaggcgtggtagtgggtgcctgtaatcccagctactcgggaggctaaggcaggagaatcacttgaacctgggagggggaggttgcagtgagccaagatcgctccattgccctccagcctgggtgacaagagcaaaactccatctcaaataaataaaaaggaaaaaaaagtcaataaactgtacaaatttaattacagtaattcatttggcttttagtgtatcttctttgtcccaattaaacagttgcttgctgtgatgtaatcttaaaaaaaaaaaaaaaaa

SEQ ID NO: 55850 - DNA, 1631 bp, Homo sapiens
gtaatttcgacctgtcctttcccgggagttagcgatccctcaacccctgcactgcgctagtcctaaagaggaaatgtctctacgctgcggggatgcagcccgcaccctggggccccgggtatttgggagatatttttgcagcccagtcagaccgttaagctccttgccagataaaaaaaaggaactcctacagaatggaccagaccttcaagattttgtatctggtgatcttgcagacaggagcacctgggatgaatataaaggaaacctaaaacgccagaaaggagaaaggttaagactacctccatggctaaagacagagattcccatggggaaaaattacaataaactgaaaaatactttgcggaatttaaatctccatacagtatgtgaggaagctcgatgtcccaatattggagagtgttggggaggtggagaatatgccaccgccacagccacgatcatgttgatgggtgacacatgtacaagaggttgcagattttgttctgttaagactgcaagaaatcctcctccactggatgccagtgagccctacaatactgcaaaggcaattgcagaatggggtctggattatgttgtcctgacatctgtggatcgagatgatatgcctgatgggggagctgaacacattgcaaagaccgtatcatatttaaaggaaaggaatccaaaaatccttgtggagtgtcttactcctgattttcgaggtgatctcaaagcaatagaaaaagttgctctgtcaggattagatgtgtatgcacataatgtagaaacagtcccggaattacagagtaaggttcgtgatcctcgggccaattttgatcagtccctacgtgtactgaaacatgccaagaaggttcagcctgatgttatttctaaaacatctataatgttgggtttaggcgagaatgatgagcaagtatatgcaacaatgaaagcacttcgtgaggcagatgtagactgcttgactttaggacaatatatgcagccaacaaggcgtcaccttaaggtgaatttttcctgaaaaatctagtggctaaaagaaaaacaaaagacctctaaaacttcaacaagaccttcaagatcacagaaatttttaaaatttgattccagttaataacagaggtggtgccagaatgcctggactgcagtggatgtgccccacctctttgcttaaaaaaaaaaatgtcaatagccaggcatagtggctcacgcctgtaatcccagcactttaggaggccaaggcgggtggatcacctgaggtcaggagttcgagaccagcctggccaacatggtgaaatcctgtctccactaaaaacacaaaaattagtcaggcgtggtagtgggtgcctgtaatcccagctactcgggaggctaaggcaggagaatcacttgaacctgggagggggaggttgcagtgagccaagatcgctccattgccctccagcctgggtgacaagagcaaaactccatctcaaataaataaaaaggaaaaaaaagtcaataaactgtacaaatttaattacagtaattcatttggcttttagtgtatcttctttgtcccaattaaacagttgcttgctgtgatgtaatcttaaaaaaaaaaaaaaaaa

SEQ ID NO: 55851 - DNA, 673 bp, Homo sapiens
atggggactccaaatgatcaggcagtgctgcaggccatcttcaaccctgacaccccatttggagacattgttggattggacctcggagaggaagcagaaaaggaagaacgagaagaagatgaagttttccctcaagcacagctggaacagtccaaggccctggagctgcagggggtgatggcagcagaggctggggacctcagcacagccctggagaggtttggccaagccatctgcctgctgcctgagagggcttcagcctacaacaaccgtgcccaggcccggcgactccagggagacgtggcaggcgccctggaggatctggaacgcgcggtggagctgagcggcggccggggccgcgccgcccgccagagctttgtgcagcgcggactcctggcgcggctgcagggccgagacgacgacgcccgcagggacttcgagagggcggcacggctgggcagccccttcgcgcggcgccagctggtgctgctcaacccctacgccgcgctgtgcaaccgcatgctggccgacatgatggggcagctgcgccgcccccgtgacagccgctgagcgccgcggacccgggcgtccgcgggcgaggggacgggactgggccctgaaccaataaagccgtcgggcctcaccgactccgcctgctcctgcgtcctgcccg

SEQ ID NO: 55852 - DNA, 929 bp, Homo sapiens
atacatggagataaccaaagaatgatgaaaggcaatcagtccaggatacaggggagagagaaggtgttctaaagaaagcaatggaaaagagaaaacggccctcaaaaggaaaacaatgagaaactgtcttgattgtacttgtaagaaatgattgtgcggttaatattattttttgaaccctgacattcagagtcagtcacctggcacatagtggatgcttaataacaggtgtggaataaattggctgctacttgcccgggcagtgggccagactcataaacatagtggccattcagaatcctgcaacgttcatgttttcgtgtattagcggtggaaaataataggaacaaggcgagacctggacttcagtcccagctctgccactaagtggcttggctgtagagcttaactcttccacagtcttcatctgtgtaatgggaataacgatccgtacctctagcaggtgcgaggcgggttgtaaatggccacgcccgggagccgcaagaaccacggcgccctggaggatctggaacgcgcggtggagctgagcggcggccggggccgcgccgcccgccagagctttgtgcagcgcggactcctggcgcggctgcagggccgagacgacgacgcccgcagggacttcgagagggcggcacggctgggcagccccttcgcgcggcgccagctggtgctgctcaacccctacgccgcgctgtgcaaccgcatgctggccgacatgatggggcagctgcgccgcccccgtgacagccgctgagcgccgcggacccgggcgtccgcgggcgaggggacgggactgggccctgaaccaataaagccgtcgggcctcaccgactccgcctgctcctgcgtcctgcccgcgcccggagagaagggcactcgggggtactcggcgcgggctggggaccagc

SEQ ID NO: 55853 - DNA, 673 bp, Homo sapiens; identical to SEQ ID NO: 55851

SEQ ID NO: 55854 - DNA, 929 bp, Homo sapiens; identical to SEQ ID NO: 55852

SEQ ID NO: 55855 - DNA, 1832 bp, Homo sapiens
ggccctgcgtccccgctgcacacccccgtccactcccgtggtccccggtccggcatggcgcgcgcggtggggcccgagcggaggctgctggccgtctacaccggcggcaccattggcatgcggagtgagctcggcgtgcttgtgcccgggacgggcctggctgccatcctgaggacactgcccatgttccatgacgaggagcacgcccgagcccgcggcctctctgaggacaccctggtgctacccccggccagccgcaaccagaggattctctacaccgtgctggagtgccagcccctcttcgactccagtgacatgaccatcgctgagtgggtttgccttgcccagaccatcaagaggcactacgagcagtaccacggctttgtggtcatccacggcaccgacaccatggcctttgctgcctcgatgctgtccttcatgctggagaacctgcagaagactgtcatcctcactggggcccaggtgcccatccatgccctgtggagcgacggccgtgagaacctgctgggggcactgctcatggctggccagtatgtgatcccagaggtctgccttttcttccagaatcagctgtttcggggcaaccgggcaaccaaggtagacgctcggaggttcgcagctttctgctccccgaacctgctgcctctggccacagtgggtgctgacatcacaatcaacagggagctggtgcggaaggtggacgggaaggctgggctggtggtgcacagcagcatggagcaggacgtgggcctgctgcgcctctaccctgggatccctgccgccctggttcgggccttcttgcagcctcccctgaagggcgtggtcatggagaccttcggttcagggaacggacccaccaagcccgacctgctgcaggagctgcgggtggccaccgagcgcggcctggtcatcgtcaactgtacccactgcctccagggggctgtgaccacagactatgcagctggcatggccatggcgggagccggcgtcatctcaggcttcgacatgacatcggaggccgccctggccaagctatcgtatgtgctgggccagccagggctgagcctggatgtcaggaaggagctgctgaccaaggaccttcggggggagatgacgccaccctcggtggaagagcgccggccctcactgcagggcaacacgctgggcggtggggtctcctggctcctcagtctgagcggcagccaggaggcagatgccctgcggaatgccctggtgcccagcctggcctgtgctgctgcccacgccggtgacgtggaggcgctgcaggcgcttgtggagctgggcagtgacctgggcctggtggactttaacggccaaaccccactgcacgcggccgcccggggaggccacacagaggcagtcaccatgctgctgcagagaggtgtggacgtgaacacccgggacacggatggcttcagcccgctgctgctggccgtgcggggcaggcatccgggtgtcattgggttgctgcgggaagccggggcctccctgtccacccaggagctggaggaagcagggacggagctgtgcaggctggcatacagggccgacctcgaaggcctgcaggtgtggtggcaggcaggggctgacctggggcagccgggctatgacgggcacagcgccctgcacgtcgcagaggcagccgggaacctggcagtggtggcctttctacagagcctggagggtgcggttggtgcccaggccccatgcccagagccctcatgttttcaggaagtgctgcctggtgtctaacctgaaggcgtcctgctgcagtataagccattccttcc

SEQ ID NO: 55856 - DNA, 1935 bp, Homo sapiens
ggccctgcgtccccgctgcacacccccgtccactcccgtggtccccggtccggcatggcgcgcgcggtggggcccgagcggaggctgctggccgtctacaccggcggcaccattggcatgcggagtgagctcggcgtgcttgtgcccgggacgggcctggctgccatcctgaggacactgcccatgttccatgacgaggagcacgcccgagcccgcggcctctctgaggacaccctggtgctacccccggccagccgcaaccagaggattctctacaccgtgctggagtgccagcccctcttcgactccagtgacatgaccatcgctgagtgggtttgccttgcccagaccatcaagaggcactacgagcagtaccacggctttgtggtcatccacggcaccgacaccatggcctttgctgcctcgatgctgtccttcatgctggagaacctgcagaagactgtcatcctcactggggcccaggtgcccatccatgccctgtggagcgacggccgtgagaacctgctgggggcactgctcatggctggccagtatgtgatcccagaggtctgccttttcttccagaatcagctgtttcggggcaaccgggcaaccaaggtagacgctcggaggttcgcagctttctgctccccgaacctgctgcctctggccacagtgggtgctgacatcacaatcaacagggagctggtgcggaaggtggacgggaaggctgggctggtggtgcacagcagcatggagcaggacgtgggcctgctgcgcctctaccctgggatccctgccgccctggttcgggccttcttgcagcctcccctgaagggcgtggtcatggagaccttcggttcagggaacggacccaccaagcccgacctgctgcaggagctgcgggtggccaccgagcgcggcctggtcatcgtcaactgtacccactgcctccagggggctgtgaccacagactatgcagctggcatggccatggcgggagccggcgtcatctcaggcttcgacatgacatcggaggccgccctggccaagctatcgtatgtgctgggccagccagggctgagcctggatgtcaggaaggagctgctgaccaaggaccttcggggggagatgacgccaccctcggtggaagagcgccggccctcactgcagggcaacacgctgggcggtggggtctcctggctcctcagtctgagcggcagccaggaggcagatgccctgcggaatgccctggtgcccagcctggcctgtgctgctgcccacgccggtgacgtggaggcgctgcaggcgcttgtggagctgggcagtgacctgggcctggtggactttaacggccaaaccccactgcacgcggccgcccggggaggccacacagaggcagtcaccatgctgctgcagagaggtgtggacgtgaacacccgggacacggatggcttcagcccgctgctgctggccgtgcggggcaggcatccgggtgtcattgggttgctgcgggaagccggggcctccctgtccacccaggagctggaggaagcagggacggagctgtgcaggctggcatacagggccgacctcgaaggcctgcaggtgtggtggcaggcaggggctgacctggggcagccgggctatgacgggcacagcgccctgcacgtcgcagaggcagccgggaacctggcagtggtggcctttctacagagcctggagggtgcggttggtgcccaggccccatgcccagaagtgctgcctggtgtctaacctgaaggcgtcctgctgcagtataagccattccttcctcccatgacctgctggaggggtctcaggcatgaccccactgctggggctgcttcccagcctgctctcatgtaaagcctgaaggcctttgttgggcaggacggcaataaagtctctgacatc

SEQ ID NO: 55857 - DNA, 2608 bp, Homo sapiens
ctccgcgcagtccctgagtcccgcaggccctgcgtccccgctgcacacccccgtccactcccgtggtccccggtccggcatggcgcgcgcggtggggcccgagcggaggctgctggccgtctacaccggcggcaccattggcatgcggagtgagctcggcgtgcttgtgcccgggacgggcctggctgccatcctgaggacactgcccatgttccatgacgaggagcacgcccgagcccgcggcctctctgaggacaccctggtgctaccgtgagtgtgggctcctcccagtcccggacagggcatggctgctgaggggcaccgatcctgaggctgggcactgctggccaggcccacgtgagccatttgctcacccctgtctctaacatcccctcagcttacagggctttaggactgaccagcagtcgccttccaccagagcctgaacctctgagggtgccccgtgcctggtcccaccttccctccccaccctcctcccacacccccagccaggctgcttcggcaagtgtgatgagggcgccccgtctagggatcctgtatatcaggagccagctggcccaggtggccttgcccccagcatagaggtccttccatttctcagctctgggcccagctccctgatgtcccccacagctgggggtgagctgggagttgccctcgtggtggctgaccaccacagccgccacaggcgagcctcctgcaagcatcctctcctgcctggggatggctggtcccagcccccctcttcgagctggtgtgggaagaagactgctgggagtggcccatcctgacctacgtccttgcctctgtggggagctccaggtggaaggggggccgggccccgtacctgggatgctgagaacttgctatgtgcggagcccttggcgtaggggccccagctctgccagaggggaacagagcgggtcagggcatttagagcaggaggaggtgcagagcgggagcctgctgttccgcctcctgctgtttctgtcccgcagcccggccagccgcaaccagaggattctctacaccgtgctggagtgccagcccctcttcgactccagtgacatgaccatcgctgagtgggtttgccttgcccagaccatcaagaggcactacgagcagtaccacggctttgtggtcatccacggcaccgacaccatggcctttgctgcctcgatgctgtccttcatgctggagaacctgcagaagactgtcatcctcactggggcccaggtgcccatccatgccctgtggagcgacggccgtgagaacctgctgggggcactgctcatggctggccagtatgtgatcccagaggtctgccttttcttccagaatcagctgtttcggggcaaccgggcaaccaaggtagacgctcggaggttcgcagctttctgctccccgaacctgctgcctctggccacagtgggtgctgacatcacaatcaacagggagctggtgcggaaggtggacgggaaggctgggctggtggtgcacagcagcatggagcaggacgtgggcctgctgcgcctctaccctgggatccctgccgccctggttcgggccttcttgcagcctcccctgaagggcgtggtcatggagaccttcggttcagggaacggacccaccaagcccgacctgctgcaggagctgcgggtggccaccgagcgcggcctggtcatcgtcaactgtacccactgcctccagggggctgtgaccacagactatgcagctggcatggccatggcgggagccggcgtcatctcaggcttcgacatgacatcggaggccgccctggccaagctatcgtatgtgctgggccagccagggctgagcctggatgtcaggaaggagctgctgaccaaggaccttcggggggagatgacgccaccctcggtggaagagcgccggccctcactgcagggcaacacgctgggcggtggggtctcctggctcctcagtctgagcggcagccaggaggcagatgccctgcggaatgccctggtgcccagcctggcctgtgctgctgcccacgccggtgacgtggaggcgctgcaggcgcttgtggagctgggcagtgacctgggcctggtggactttaacggccaaaccccactgcacgcggccgcccggggaggccacacagaggcagtcaccatgctgctgcagagaggtgtggacgtgaacacccgggacacggatggcttcagcccgctgctgctggccgtgcggggcaggcatccgggtgtcattgggttgctgcgggaagccggggcctccctgtccacccaggagctggaggaagcagggacggagctgtgcaggcagaggcagccgggaacctggcagtggtggcctttctacagagcctggagggtgcggttggtgcccaggccccatgcccagaagtgctgcctggtgtctaacctgaaggcgtcctgctgcagtataagccattccttcctcccatgacctgctggaggggtctcaggcatgaccccactgctggggctgcttcccagcctgctctcatgtaaagcctgaaggcctttgttgggcaggacggcaataaagtctctgacat

SEQ ID NO: 55858 - DNA, 1935 bp, Homo sapiens; identical to SEQ ID NO: 55856

SEQ ID NO: 55859 - DNA, 2608 bp, Homo sapiens; identical to SEQ ID NO: 55857

SEQ ID NO: 55860 - DNA, 1832 bp, Homo sapiens; identical to SEQ ID NO: 55855

SEQ ID NO: 55861 - DNA, 1040 bp, Homo sapiens
tacctcctgatagcaaaagaactgaggaagctctttccactacggctgtattgcactggtgagtccgggcccatggatgagaaattgatgcgaggatcaatacaagcttaatttgaattaataaaaggaaatattttctccctttgaacttatctccgtaaagccattgtgcctcctcttgggggtcacgtgttcacaatcaatggcctttgaggagctcttgagtcaagttggaggccttgggagatttcagatgcttcatctggtttttattcttccctctctcatgttattaatccctcatatactgctagagaactttgctgcagccattcctggtcatcgttgctgggtccacatgctggacaataatactggatctggtaatgaaactggaatcctcagtgaagatgccctcttgagaatctctatcccactagactcaaatctgaggccagagaagtgtcgtcgctttgtccatccccagtggcagcttcttcacctgaatgggactatccacagcacaagtgaggcagacacagaaccctgtgtggatggctgggtatatgatcaaagctacttcccttcgaccattgtgactaagtgggacctggtatgtgattatcagtcactgaaatcagtggttcaattcctacttctgactggaatgctggtgggaggcatcataggtggccatgtctcagacaggtggctggtggaatctgctcggtggttgataatcaccaataaactagatgagggcttaaaggcacttagaaaagttgcacgcacaaatggaataaagaatgctgaagaaaccctgaacatagaggttgtaagatccaccatgcaggaggagctggatgcagcacagaccaaaactactgtgtgtgacttgttccgcaaccccagtatgcgtaaaaggatctgtatcctggtatttttgagaaaaaaaaatctcaaggaaaaggcataaaaatgattgctacacaaaagtgaccaaattttaagaagccttcatgagctgattggtggggaaa

SEQ ID NO: 55862 - DNA, 1804 bp, Homo sapiens
tacctcctgatagcaaaagaactgaggaagctctttccactacggctgtattgcactggtgagtccgggcccatggatgagaaattgatgcgaggatcaatacaagcttaatttgaattaataaaaggaaatattttctccctttgaacttatctccgtaaagccattgtgcctcctcttgggggtcacgtgttcacaatcaatggcctttgaggagctcttgagtcaagttggaggccttgggagatttcagatgcttcatctggtttttattcttccctctctcatgttattaatccctcatatactgctagagaactttgctgcagccattcctggtcatcgttgctgggtccacatgctggacaataatactggatctggtaatgaaactggaatcctcagtgaagatgccctcttgagaatctctatcccactagactcaaatctgaggccagagaagtgtcgtcgctttgtccatccccagtggcagcttcttcacctgaatgggactatccacagcacaagtgaggcagacacagaaccctgtgtggatggctgggtatatgatcaaagctacttcccttcgaccattgtgactaagtgggacctggtatgtgattatcagtcactgaaatcagtggttcaattcctacttctgactggaatgctggtgggaggcatcataggtggccatgtctcagacaggtttgggcgaagatttattctcagatggtgtttgctccagcttgccattactgacacctgcgctgccttcgctcccaccttccctgtttactgtgtactacgcttcttggcaggtttttcttccatgatcattatatcaaataattctttgcccattactgagtggataaggcccaactctaaagccctggtagtaatattgtcatctggtgcccttagtattggacagataatcctgggaggcttggcttatgtcttccgagactggcaaaccctgcacgtggtggcgtctgtacctttctttgtcttctttcttctttcaaggtggctggtggaatctgctcggtggttgataatcaccaataaactagatgagggcttaaaggcacttagaaaagttgcacgcacaaatggaataaagaatgctgaagaaaccctgaacatagaggttgtaagatccaccatgcaggaggagctggatgcagcacagaccaaaactactgtgtgtgacttgttccgcaaccccagtatgcgtaaaaggatctgtatcctggtatttttgagatttgcaaacacaatacctttttatggtaccatggtcaatcttcagcatgtggggagcaacattttcctgttgcaggtactttatggagctgtcgctctcatagttcgatgtcttgctcttttgacactaaatcatatgggccgtcgaataagccagatattgttcatgttcctggtgggcctttccattttggccaacacgtttgtgcccaaagaaatgcagaccctgcgtgtggctttggcatgtctgggaatcggctgttctgctgctactttttccagtgttgctgttcacttcattgaactcatccccactgttctcagggcaagagcttcaggaatagatttaacggctagtaggattggagcagcactggctcccctcttgatgaccttaacggtattttttaccactttgccatggatcatttatggaatcttccccatcattggtggccttattgtcttcctcctaccagaaaccaagaatctgcctttgcctgacaccatcaaggatgtggaaaatcagtga

SEQ ID NO: 55863 - DNA, 2180 bp, Homo sapiens
aaaataacatctacctcctgatagcaaaagaactgaggaagctctttccactacggctgtattgcactgagaactttgctgcagccattcctggtcatcgttgctgggtccacatgctggacaataatactggatctggtaatgaaactggaatcctcagtgaagatgccctcttgagaatctctatcccactagactcaaatctgaggccagagaagtgtcgtcgctttgtccatccccagtggcagcttcttcacctgaatgggactatccacagcacaagtgaggcagacacagaaccctgtgtggatggctgggtatatgatcaaagctacttcccttcgaccattgtgactaagtgggacctggtatgtgattatcagtcactgaaatcagtggttcaattcctacttctgactggaatgctggtgggaggcatcataggtggccatgtctcagacaggtttgggcgaagatttattctcagatggtgtttgctccagcttgccattactgacacctgcgctgccttcgctcccaccttccctgtttactgtgtactacgcttcttggcaggtttttcttccatgatcattatatcaaataattctttgcccattactgagtggataaggcccaactctaaagccctggtagtaatattgtcatctggtgcccttagtattggacagataatcctgggaggcttggcttatgtcttccgagactggcaaaccctgcacgtggtggcgtctgtacctttctttgtcttctttcttctttcaaggtggctggtggaatctgctcggtggttgataatcaccaataaactagatgagggcttaaaggcacttagaaaagttgcacgcacaaatggaataaagaatgctgaagaaaccctgaacatagaggttgtaagatccaccatgcaggaggagctggatgcagcacagaccaaaactactgtgtgtgacttgttccgcaaccccagtatgcgtaaaaggatctgtatcctggtatttttgagatttgcaaacacaatacctttttatggtaccatggtcaatcttcagcatgtggggagcaacattttcctgttgcagaaatgcagaccctgcgtgtggctttggcatgtctgggaatcggctgttctgctgctactttttccagtgttgctgttcacttcattgaactcatccccactgttctcagggcaagagcttcaggaatagatttaacggctagtaggattggagcagcactggctcccctcttgatgaccttaacggtattttttaccactttgccatggatcatttatggaatcttccccatcattggtggccttattgtcttcctcctaccagaaaccaagaatctgcctttgcctgacaccatcaaggatgtggaaaatcaaaaaaaaaatctcaaggaaaaggcataaaaatgattgctacacaaaagtgaccaaattttaagaagccttcatgagctgattggtggggaaattcagaaaaaaaaatacaggaaaagaacacaccagaagggtttttttccctacaaccagcaagaacatatattagatacatgaatctcaattataattatggcattaatttgcattttatttcaaaattaacttgtggggacatgtaatctcttgagcaatctgatatttttgggaagtcctttaaaaagttacaaatttatcaataaattactagtagataagatgattcagaaacaaaagaaaatcacagaattaggatgtggctggctggtgtatgaagcaccatgtgatgaattcataaagttgcaaaagtcaaaacaatactgtacatgcaaccagaaatcaaaataaatccagaaatagagacctatataaatgcatttaatacatgatacttttgacataataagccattggaaaacggaaagattagatactaaataacattgactatctctttgtaaatacagtcactaaatgatgttagttacttttccatggtggaattttaattactttttctttgtaatttttctctctgtatattttaaacaaatagctggtatagtttacaatattataaagatattgttcaaattgaagggcaaaggccaggttcagcaattttcaaactgtatgtacatttaataaaataactataaattaaaaa

SEQ ID NO: 55864 - DNA, 1477 bp, Homo sapiens
tacctcctgatagcaaaagaactgaggaagctctttccactacggctgtattgcactggtgagtccgggcccatggatgagaaattgatgcgaggatcaatacaagcttaatttgaattaataaaaggaaatattttctccctttgaacttatctccgtaaagccattgtgcctcctcttgggggtcacgtgttcacaatcaatggcctttgaggagctcttgagtcaagttggaggccttgggagatttcagatgcttcatctggtttttattcttccctctctcatgttattaatccctcatatactgctagagaactttgctgcagccattcctggtcatcgttgctgggtccacatgctggacaataatactggatctggtaatgaaactggaatcctcagtgaagatgccctcttgagaatctctatcccactagactcaaatctgaggccagagaagtgtcgtcgctttgtccatccccagtggcagcttcttcacctgaatgggactatccacagcacaagtgaggcagacacagaaccctgtgtggatggctgggtatatgatcaaagctacttcccttcgaccattgtgactaagtgggacctggtatgtgattatcagtcactgaaatcagtggttcaattcctacttctgactggaatgctggtgggaggcatcataggtggccatgtctcagacaggtttgggcgaagatttattctcagatggtgtttgctccagcttgccattactgacacctgcgctgccttcgctcccaccttccctgtttactgtgtactacgcttcttggcaggtttttcttccatgatcattatatcaaataattctttgcccattactgagtggataaggcccaactctaaagccctggtagtaatattgtcatctggtgcccttagtattggacagataatcctgggaggcttggcttatgtcttccgagactggcaaaccctgcacgtggtggcgtctgtacctttctttgtcttctttcttctttcaaggtggctggtggaatctgctcggtggttgataatcaccaataaactagatgagggcttaaaggcacttagaaaagttgcacgcacaaatggaataaagaatgctgaagaaaccctgaacatagaggttgtaagatccaccatgcaggaggagctggatgcagcacagaccaaaactactgtgtgtgacttgttccgcaaccccagtatgcgtaaaaggatctgtatcctggtatttttgagatttgcaaacacaatacctttttatggtaccatggtcaatcttcagcatgtggggagcaacattttcctgttgcagaaatgcagaccctgcgtgtggctttggcatgtctgggaatcggctgttctgctgctactttttccagtgttgctgttcacttcattgaactcatccccactgttctcagggcaagagcttcaggaatag

SEQ ID NO: 55865 - DNA, 3526 bp, Homo sapiens
ttcgggtcttcatctcaaatcctgatgggtccccagcttccagagtccttgtccactcccaagaccaaaaagtgtacacctcagctgaggggttggccactctgaccatcaacacagatgcaaatctggacaagctccccatcgaggtgaaaactgaggaatctcttcagccagaggagcaggcttcagccaagatgacagcttggccttacttgactcaggatgggtcaggaaacttcctacacatcgaagtaaagacattgggcacagaggttggcagcagcatccagctgagcctcaacacaaggcatcaggaccctaaaaccaaggacaagattactcacttcaccatcctggtcctgagtaagggccagaccgtgagtgccaaacatcagtcaaaaagccaggggagtgtctacacatcagccattattgatgtgacttcagcgatgctgccctccttccgcattctggccttttatttacttcccagaggagcaagccaagaccctgagttggtggctgattccatatggattgatgtgaatgacagatgcatagggatgctgaaagttggcttgaagaatgatagattcttccagtctttggagcccaacagccaagtcgaactgaaggtgacaggtgatgcagaagccacagtggggctggtggctgtggacaaggctgtctatgtcttgaacagcaaacacaagctcactcagaagaagactagccctgcccccaggaccctcctcccagccgccatcgccgctccctgaagaggctggagacaaaaaggaatgcagtgaacaagtttaagacagagctggagcaaaagtgctgtgaggctgggctccgggagagcccagtggggctgtcttgtgaggagaggacctggcatgtccgccatggtccagcctgtgtggctgctttcctggactgctgccatctgtctgagaccctgactcgggaggctcgagaggatcaattgcatctgtggacaacggatgaagaagaggacttcgatgacctcttcttggatgacatgcctgtgcggaccttgttccccgagagttggctctggaggaagttcactctgccaaagagtaaatcgggcatctcccattaccccatctctgtgaaggtgccagattccatcaccacgtggcagtttgtggtggtcagcctcaaggctggacaaggtctctgtgtctcggacccctttgagctgacagttatgaaatcgttctttgtggaccttaagttgccctcctccgtgatcaggaatgagcaggtccagatccaagccatgttgtacaatttcagggatcgccaggccaaggtccgagtggagttcccccacaaggagacactgtgcagtgcgtcaaagccaggagcaccatcccaccaggcaggggttcagatccagcaaacgtcctatagcatcgtcctggaaccccaaggtcagacccagacaaaactggtgccaagacaggagttcttgaacatggtacccgacacggaggcggaagtgtttatcagtgttcaaggctacactcagatgctgacccaccggagttcagacggcacctaccacacctccaaggggaacccaggaagcacttggctcacaagctatgtgttccgcgtctttgccctggcctactctatgatgacgacccaagtgcttagcctgtcctctctctgtgacatggccaactggatcatcatcgacaggcaggcagaggatgggcacttcctggagaagggccctgtggtcatgacatccatgcaggatggctaccaaggctccgaggaggatgtatccctcacagctcttgtcctaatagccctgaatgagggaaaggagttgtgcagacagaagaatttgatggccagcatcgagagagcccgtggcttcctggagagaaaacttcccgacattcagacaacctttgccgtagccatagcctcctatgcactggcccttgccaacagctcccaagccaacgactgcctggacagctttgccagccctagtgggtgtgggatgcttcttaatcaacctcagtcatggagtggggagggggtgatctcaaatccagcaatgtgttattcatcacttagtgtttcctgagcatccactgtgtatcacctcctgagctcagaccctgtgagaccaagacaaaacccactggccagtggatgagcagaatctgggctccctgtacaccattgaggccacagcctatgggctcatgcagaagctggagctgggccggtacaatgagacacacgccatagccaagtggctactagagaagcaggagctgggaggaggcttcaggtccacccagaccacggtggtggcccttgaagctctgacccgcttccgcgaagctgtccccttcaagggcatccaggatctccacgtccagatcagagcccccaagacagccctgaatgtgaattggtacattgatcacagcaatgcctaccaacagcggtcagcaaagttccttgcccaggacgacctagagatcaaagccagtggcaacgggagaggcaccatctcgatcctgacaatgtatcacaagtccccagagtcccgggaggacaactgcaacctgtaccacctgaatgcgactctccacagtgccctagaagaaaataaaaagggaggtgagacttttcggctccggatggaaacaaggttccagaacaattgagaggccacaatgactatcatggaggtctccctgctcacgggcttctaccccaaccaggatgacctcaaacagctcacgaatgatgtggagaggtacgcctttcagtacaaaaccaagacaagtaccagcgacagcactgttgtcctctacctggaaaagctctcccatgagaagaacacggtgctgggctttcgggttcacaggatgctgcaggcggagttcctgcaggccgccctggtcaccatctacgactactacgagccttgacagtgcccatccctgcagaagcccagtggccaattgaggcaggaggagctccagacaacagcatgtgaggcaggcgtggattttgtgtacaagacaaagctggaatctgtggaggtctctgcctccaacccttacgtctattacaacacgcagctcgaagacatcattaagagtggtacggaccctgccacacccctggccatgaagaaattcgtctcccatgccacttgccatgactccctggggttgcaagaacaggaatcgtacctcatcatgggccagacgtcagacctgtggagaatcaaatctgattacagctatgttctgggcaaggagacgttcctcatcctttggccagcagatggagatgccagcaagaaagaattgcgggaccaactggaggaatttttggaatatatgcgcacccacggctgccagtcctgagcctcttctgctttcagggaggtgtcatcaggcagctctgggccactgggtttaaccccaaataaagagcacaggatatgacaccc

SEQ ID NO: 55866 - DNA, 3933 bp, Homo sapiens
atggagcgcgagctggaggcgctggcggcccggcttgcgcgccctgccgagccgcccttccaggcgttggtggaagcggcggggggccgcgggcaggtgctgctggtgggcgagctgtgggagcgcgaacagagccgcgcgctgctgcgggacttcgcacgggcggtgttcccgccggagccagaggacgcggtggcgccggggctgcggctgctggaggcgctgttgcgcgccgtgttcggccgccaggcgggggggcccgtgcaggcggccgcctactgccccggcctcccggcctcctgcctggccgtccaggcggccgcctgcagggccctgcaagccgccggagccgggcaaccagtggaaggagcctgggagaggccaggcctccccggactgctagcctgcttttcctggggtccctggagccggaggaagaaccaggatgttgctgcctgcagaagctcagctcaggaagacttccaggaacctgaggaggagctgccactaacagccatatttcccaatggagactgtgatgaccttggaagggggtcaaaagcctgtgatggagtcgtacacactcctgctgagcccaccggagactcaagatgaaggctggacccttgcgctgtccctggctctaacctacagactggggcctggctccgtcttactggcccccaggtctccatggagactgcagaaacccccgcctgctggaggcctgccacactcacagttaccagctagacagtggggcttactaagacaagcaggacctaaaacagtgtctcccctgggaacctactccccacccagcatttgctaagtctgatcacagggaggttattttgtctctctgtctcggtttctctgagccactgagacagatggctgtccgctttgaggctctgcagagctgtggcaccccatggtgtgtctgcagtgttctgggcacatgcatgggcacccatcgttgagagtgcagctgggaagaactctgaaccagaagtcatcagagctgaggcatggccttgaacatgtcactcagtctctggggcttctgtttcacaaatgcatgagggggccaccagcccagtggctttaaaccaggggcaggttgtccctccaggcagcattggaaatgtgtgtgtgttgagggggtcacagtgactgtgggggcacccctggcatctagtgggcatcccacaatgtgcagaacagtctctgacagcaaagaattggtccattcaatgccaattgtagtacctttgagacattctggctgagccaatgccttctccctgtcagagtcccccagagcagagagggtcaggcttccctggaccttggctcccagagcaagccaaaataaagactacactgttgccttgggggcttgtcgggccagggccaagacggtctgcgtgctgcagggccaggacagaaatagccacacatgccggtgagaacaaagagcctctttctttctcatgttgacatcgactttctgtgccaagtcctttgggtataaggatgctagggaattcctataggcaccaaacagaaggaaagctaggggcttggactactgggtataggacttgctctagctctcaggtcctagcccaagctcaatgcaaacacagcccctccgggctctctgtttctgtgaggttctggaatcccttcctctgtgtccgtgagtctgacagaatcgatgatgttcccttagagctgggaaatccatgtgtttattcacggagggaactcaccattacctcccttgtcttctttgcctgccttggagaaatccagagtcttcggaatggcaaaggcagctcctggatttccctggaggggaggcactagctgagggaagtagctcccttcattcatgatgcacagtttacgcagcagacacacaactgcgcctactatttgctcggtgccctgcaaggtgctgcctaactttgatttgttatttcagctctctccaggatagtgccaaatggtgcaatgggaaacctgttttgctggggggctctagatcactggctccagaactcccggctgccagggtagcccctacccccagccccttgctcctggacagcagtgggtctcacctttagcctctgcccccagttctggtctgacccaacagaggggctctatgatattaagaaggggcccttcctgctctgtgcctcaacctattctccataatagggagtctaatcctattccttccctgcctgatgaggatggtgtgaggatgaggaggacggcatctcatttggggctttttggcagtgggcctcattttaatcctgcagggctgcctgccagtggatctatccagctgcttccttgtagccaagaatgagttcaatgaattgtgattcactgattttattgattttgttttaaaacagggagactggtatttttgaagctgctatcattttctatttctttattaatttctttgtaatcatcttattaaagttttcttatttagtgggagagggagctttgtttaagtttggaatttgcctaaggcagaagttataaggcttcataaccttttgtatgtattgccaatatttgaaacttgggagattacgtataaaaaatacctagttttctgggtggaggatggggcatgctgtcatctcaagtctgctgcggctcacccccaccacctttaccccctcccccgcccttcccatcccccactgcacttcactcatgtaagacgtctgcccggtgctggtccaggcgggcatgtgagtttgtagcctctgctccaaaggatggtttacacattattttttcattaccttcagtattcctgtgaatggttcaagagagaaagtcttcatttactaagatttgggttctgcctcccaagtgacaatacggggctgagatccctctcagcttctttgagatgtggccaccataagcatcatcgttgtagggacagtctcattgctgtcttctagcagacagaagagttaggtgccagaaaggacaatcttgatggtgggtcccctccctgaaggactttaagaaggcataaaggggttggggtggagggtggcgtgtgaaggaggaggcccttgattaggtcagtggtccctgggagccatcggcgagaggcctccagccgggtgacagtctgggctctcgggtactaatctttctaatatggcagtggttgtggcacttctgacttgaattgataattctcatatctaataaaaccaagaagtacctcgttgatatcttatagaaaacaaaatggatcttcttcattctcctaaggggctccttgcagagagaccctggagagcagggaagcttggcaaatggtggaaatctgtggcctgaaagcctcccagcctctgccctgggtgacatctcccctgccgtaccagctgggattaaaaaacctgtagcgagaaagcataagtatatatttaaaaaatgatttttaaatttttgtagagacagggtctcactatgttgctcgggctggtttcaaactcctgggctcaagtgatcctcccacctcggcctcccaaagtgttgaggtgacaggcatgagccaatggccagatttttgaaaagacagcattcagcttaggatacaatggtgtgtgtgtgagcgtgtgagcacgcacatgcatgtttaaccagagctaaaataaccttaactgagtctcagagaattctttctactatttgggtcacactttttctcctctcctagtgtttgtctccaaaccttagtgcacaagagtccctgggttgtcaaacccaaaacttaaggcaaccctgcaaaggggccaggagctgagtccccaaacctttgaactgaacgagccccccttaccctagcagagaactgtggattcagcc

SEQ ID NO: 55867 - DNA, 3933 bp, Homo sapiens; identical to SEQ ID NO: 55866

SEQ ID NO: 55868 - DNA, 1574 bp, Homo sapiens
gacgttccagggctccacaggccactgtcttctggaggggaacggatcgactgccggtgcgcccagccaaattcaactcctgagtcctcagtctctagtcccgggaaggtttcaccgagctgccctactccttgtaccccttctagctggccttagcatagctacgtcagcagctattggcacgactgccctgattcaaggagaaactggactaatatcactatctcaacaggatcgaggccatcaagctacagatggtcttacaaatggaaccccaagtgaactcaactaacaacttccaccaaggacccctggaccaacccgttggccctttgactggcctaaagagttcccttctgaaggacactacaagtgcagggccccttcttcgcccctatccagcatctcttctcggcaaagtgaaagaagcggtgaaggtggccattgatgcagaatatcgccacattgactgtgcctatttctatgagaatcaacatgaggtgggagaagccatccaagagaagatccaagagaaggctgtgatgcgggaggacctgttcatcgtcagcaaggtgtggcccactttctttgagagaccccttgtgaggaaagcctttgagaagaccctcaaggacctgaagctgagctatctggacgtctatcttattcactggccacagggattcaagactggggatgactttttccccaaagatgataaaggtaatatgatcagtggaaaaggaacgttcttggatgcctgggaggccatggaggagctggtggacgaggggctggtgaaagcccttggggtctcaaatttcaaccacttccagatcgagaggctcttgaacaaacctggactgaaatataaaccagtgactaaccaggttgagtgtcacccatacctcacgcaggagaaactgatccagtactgccactccaagggcatcaccgttacggcctacagccccctgggctctccggatagaccttgggccaaacctgaggacccttccctgctggaggatcccaagattaaggagattgctgcaaagcacaaaaaaaccacagcccaggttctgatccgtttccatatccagaggaatgtgacagtgatccccaagtctatgacaccagcacacattgttgagaacattcaggtctttgactttaaattgagtgatgaggagatggcaaccatactcagcttcaacagaaactggagggcctttgacttcaaggaattctctcatttggaggactttcccttcgatgcagaatattgaggttgaatctcctggtgagattacacaggggattctctttcttcgctgaagtgtgactgtctccactcaagaactattttagccaagcttatctgagatcacagtgaactttgtcctgttgtagaccagaatggaggtgctgttttagacatgtatttctgtatgttcaactaggataagaatatcacagaaaagcatggcctgaataagcaaatgacaattttttccacttatctgatctgatcaaatgtctgttaagcaccagaaactctgccaacactgagg

SEQ ID NO: 55869 - DNA, 1574 bp, Homo sapiens; identical to SEQ ID NO: 55868

SEQ ID NO: 55870 - DNA, 1278 bp, Homo sapiens
gagacttctacctgctcactcagaatcatttccgcaccaaccatggccacgtttgtggagctcagtacaaaagccaagatgcccattgtgggcctgggcacttggaggtctcttctcggcaaagtgaaagaagcggtgaaggtggccattgatgcagaatatcgccacattgactgtgcctatttctatgagaatcaacatgaggtgggagaagccatccaagagaagatccaagagaaggctgtgatgcgggaggacctgttcatcgtcagcaaggtgtggcccactttctttgagagaccccttgtgaggaaagcctttgagaagaccctcaaggacctgaagctgagctatctggacgtctatcttattcactggccacagggattcaagactggggatgactttttccccaaagatgataaaggtaatatgatcagtggaaaaggaacgttcttggatgcctgggaggccatggaggagctggtggacgaggggctggtgaaagcccttggggtctcaaatttcaaccacttccagatcgagaggctcttgaacaaacctggactgaaatataaaccagtgactaaccaggttgagtgtcacccatacctcacgcaggagaaactgatccagtactgccactccaagggcatcaccgttacggcctacagccccctgggctctccggatagaccttgggccaaacctgaggacccttccctgctggaggatcccaagattaaggagattgctgcaaagcacaaaaaaaccacagcccaggttctgatccgtttccatatccagaggaatgtgacagtgatccccaagtctatgacaccagcacacattgttgagaacattcaggtctttgactttaaattgagtgatgaggagatggcaaccatactcagcttcaacagaaactggagggcctttgacttcaaggaattctctcatttggaggactttcccttcgatgcagaatattgaggttgaatctcctggtgagattacacaggggattctctttcttcgctgaagtgtgactgtctccactcaagaactattttagccaagcttatctgagatcacagtgaactttgtcctgttgtagaccagaatggaggtgctgttttagacatgtatttctgtatgttcaactaggataagaatatcacagaaaagcatggcctgaataagcaaatgacaattttttccacttatctgatctgatcaaatgtctgttaagcaccagaaactctgccaacactgagg

SEQ ID NO: 55871 - DNA, 1278 bp, Homo sapiens; identical to SEQ ID NO: 55870

SEQ ID NO: 55872 - DNA, 1278 bp, Homo sapiens; identical to SEQ ID NO: 55870

SEQ ID NO: 55873 - DNA, 1574 bp, Homo sapiens; identical to SEQ ID NO: 55868

SEQ ID NO: 55874 - DNA, 2298 bp, Homo sapiens
attacacaggcggcatgaagcaaaaatatactgtgaaccaatgcaggtggcagtctgaggattccaccttctacctgggagagaggacatactatatcgcagcagtggaagtggaatgggattattccccacaaagggagtgggaaaaggagctgcatcatttacaagagcagaatgtttcaaatgcatttttagataagggagagttttacataggctcaaagtacaagaaagttgtgtatcggcagtatactgattgcacgttccgtattccagtggagagaaaagctgaagaagaacatctgggaattctaggtctacaacttcatgcagatgttggagacaaagtcaaaattatctttaaaaacatgaccacaaggccctactcaatacatgcccatggggtacaaacggagagttctacatttattccagcattaccaggtgaaactctcacttacctatggaaaatcccagaaagatctggagctggaacagaggattctgcttgtattccatgggcttactattcaactgtggatcaagttaaggatctctacagtggattaattggccccctgattgtttgtcgaagacattacttgaaagtattcaatcccagaaagaaactggaatttacccttctgtttctagtttttgatgagaatgaatcttggtatttagatgacaacatcaaaacaaactctgatcaccccaagaaagtaaacaaagatgatgaggaattcatagaaagcaataaaatgcatgctgttaatggaagaatgtttggaaacccacaaggcctcacaatgcacatgggagatgaagccaatgggcgatgaaatagacttacacactgtacattttcacggccatagcttctaatacaagcacaggggtgtttatagttctgatgtctttgacattttccctggaacataccaaaccctagaaatgtttccaagaacacctggaatttggttactccactgccatgtgactgaccacattcatgctggaatggaaaccacttacattgttctacaaaatgaagacaccaagtctggctgaatgaaatacattggtgataagtggaaaaaagagaaaaaccaatgattcataacaatgtatgtgaaagtgtaaaatagaatgttactttggaatgactataaacattgaaagaagactggaaacatacaactttgtgcatttgtgggggaaaactattaattttttgcaaatggaaacatcaacagactatataatgatacatgactgacacttgtacactaggtaataaaattgattcctacagtctaatcatatcaccactattagggttttataaaactgcatttaaaaaaagatctatgaccagatattctcctgtgtgctcctcaaaggaacactattaaggttcattgaaatgttttcaatcattgccttcccattgatccttctaacatgctgttgacatcacacctaatattcagagggaatgggcaaggtatgagggaaggaaataaaacataaaataaataaaatagaatgacacaaatctgagttttgtgaacccctgaagggatggtctaaaggacgttatctggaactggagaaaagcagagttgagatacaattctatagattaaatcctggtaaggataaacattgccattagaagaaaagcttcaaaatagacctgtggcagatgtcacataagtagaatttctgccaagccttaactgcattcagaggataatatcaatgaactaaacttgaactaaaaattttttaaacaaaaagttataaatgaagacacatggttgtgaatacaatgacatatttctttattttcacatacactctagctgaaagagcaagagtacacatcaacaaaaaaatgggaacaaggctttggctgaaaaaaacatgcatttgacaaatcatgttaatagctagacaagaagaaagttagctttgtaaactacttcatttgattcagagaaatagagcatgagttttcttaaagtaaaaagaaaaggaacaaagaaaatgaggtttgaaattttttaccatggcaaaatattaacatctttctcaaaaacatagagaaatctggaaaaatcaagaagataaaattctggaccagttagtgacattctttcaagcatacttgtaaaatgtttccttagagtgttcttgggatgaaaatgattgtcatgtctccaacaacagtgaactgatgttgttccttggaataaaagtcaatccccaccttaaaaaaaacaaaacaacaac

SEQ ID NO: 55875 - DNA, 2298 bp, Homo sapiens; identical to SEQ ID NO: 55874

SEQ ID NO: 55876 - DNA, 859 bp, Homo sapiens
gctgccgcagcctgcgccatttccgatgccaggcaccctcaaggcacagaggctggggctcatgttgggggcacttggcctctccaggcctcgaaggcttctcctgggctgatgcgagctggggaacgggagggacggacgtgggagcgagaacgtcacactggaggcagctggtggcacgatgggggacagagtgaaaggtagcaagtcaaggcgccctgatctggttgtggaagtggcccatcccaaaataatccatgaatctggggcacaaatcctgcgccatgccaatctcctgagccttcgtgtcaccatggccacacaccccgatggcttccggcttgagggacccctggctgcagcccacagccctgggccttgcactgtgctctacgaaggccctgtccgtgggctctgcccctttgccccgcgaaattccaacaccatggcggcggctgccctggctgcccccagcctgggcttcgatggggtgattggggtgctcgtggctgataccagcctcacggacatgcacgtggtggatgtagagctgagcggaccccggggccccacgggccgaagctttgctgtgcacacccgcagagagaaccctgccgagccaggcgcggtcaccggctccgccaccgtcacggccttctggcggagcctcctggcctgctgccagctcccctccaggccggggatccatctctgctgagaagcctcctccctcccgagacaagatcatctgcctggcctctcaccaccaccatcccacccctgccctgccccacttccccagggtctcccttctgactcagtaaagatcaccgctgcctccaccaaaaaaaaaaaaaaa

SEQ ID NO: 55877 - DNA, 1939 bp, Homo sapiens
ttcctttccccgatagcttcaaattctctgccttttgaaataagcctacttttaactggaataaataattggtcaatctctacctcaggtgaagaggaaccaagcctctggaaacacttaggaacaaactgtaaaaaccaaaggcaattgtgtaaccggttaaataagcttgctggactttgtccctgtgtatgagttagacaattctttcagctagtttgagtgacgcactgaccagtgaagcgcagtgaagcagtgggaaccggaatatccaaagagtggtttgaaggagaaagaagcattgtggctttatatcctctgggcctgggtttcctgaagtcaccacacatagaggagagagaaaatggctgagttaaagtacatttctggatttgggaatgagtgttcttcagaggatcctcgctgcccaggttccctgccagaaggacagaataatcctcaggtctgcccctacaatctctatgctgagcagctctcaggatcggctttcacttgtccacggagcaccaataagagaagctggctgtataggattctaccttcagtttctcacaagccctttgaatccattgacgaaggccaagtcactcacaactgggatgaagttgatcctgatcctaaccagcttagatggaaaccatttgagattccaaaagcatctcagaagaaagtagactttgtgagtggcctgcataccttgtgtggagctggagacataaagtctaacaatgggcttgctatccacattttcctctgcaatacctccatggagaacagatgcttttacaattcagatggggacttcttgattgttccgcagaaagggaaccttctcatttacaccgagtttggcaagatgcttgtacagcccaatgagatctgcgtcattcagagaggaatgcggttcagcatagatgtctttgaggagaccaggggctacatcttggaggtctatggtgtccactttgagttacctgaccttggaccaattgattccttgggtcttcctaaaaggtaccagactggaaatgcagtgaatctttgagcaatgaaagcaatttgtggagtagctcttgacatgaaagaaagcctttctcttcatgcaaccatgggcatctttcctatgttttggaagtttctaaaagacttttgggttactgttttctaggggccaatggcttggccaatcctcgtgatttcttgatacccattgcctggtatgaggatcgccaagtaccaggtggttacacggtcattaataaataccagggcaagctgtttgctgccaaacaggtaaagtaaaagggttggcaggcaagggaggaaatgaagagtgattgagcacttactgattgccaaggcgagtgttacaaactttacatatatcctttcgttgttatcataccactacggcactacaaataaagcaaatagttctagtagtcaattatactttcatagtcatggaaaaggccagtaatgataaataatttacaaatttcacagtaagtggcagaaccagaatttgaacccatatctgtctgactccaaaggttgtgccctttctactcaccaagcaatgaaaatattagcaatatgtaggtttctataagtggtatggaaaacataatatatgggcagcataatatgttctgaaaagtaaatgagttaacagatcagccaagatttatagtctccaataccaccctatttcaaatacaagcaattctacaaaacaagtagaattcagttaattagcttggcttggtttgtaccaccaggctggcaattcaggacacaagcaaaggcacagatattaataaataataataacaacaatgtaatatggactctataacataatatattactaaatgtactgaatatatattagaataaaataatcatataataagaa

SEQ ID NO: 55878 - DNA, 597 bp, Homo sapiens
acttctcaggaaacccaagtttgaaggatggtgacacaggggagccaaggagagggcaggcctttcctgagtgctgagtctgcaggccctgcccaggaacagcccaatgggtacagatgctcgcacgactcagagtgccagagcagctgctgcgtccgcaacaacagcccgcaggagttgtgcacgccccaaagcgtcttcctgcagtgtgtgccctggcgcaagcccaacggcgacttctgcagcagccatcaggagtgtcacagccagtgctgcatccagctgagggagtacagccccttccgctgcattccccggaccgggatcctggcccagtgcctgcccctgtgatgtgagctcgaacctgggcgcgagggaccggcctgggccctgggatgttcacgcaggaccgcgttgcgcgggggctggttccagcggaagcttcccttacggtttgtgctgctgtttctggggctctgaaaatctgtgggaactgaaaggctgtgaccagcctggtggcgcgaagtgtctgtgagaacaaatcccaggcactggggtgtagcctgattgttaaacatcaataaaggctcctggccg

SEQ ID NO: 55879 - DNA, 975 bp, Homo sapiens
ggtgtccgaggagttttgtgtgcgactcgtcctgctacatttcttggttacaaaaacctcttccttctttaatccggtgtccgaggagttttgtctgcgactcgtcctgctacatttcttggttacaaaaacctcttccttctttaatccggtgtctgaggagttttgtttgcgactcgtcctgctacatttcttggttccgtgaccgggaagcgaggtgattgaaggacggtcgaggcagccccttaggctgcttaggcctgccctgtggagcgtccctgcaagggactctggccagcttgagcgacgggcatcctgagagcgctcccgggtaggcaattgccctggtggaacacctcgtcagagcagtgtgtggcaggcccccgcggaggatcaacgtggtggctgaacaccgggaaggaactggcactagaagtctggacgtctgaaacttgatcccctgcctgcagcacgtgctgatctccaagggtgaggctggatgaagccaggggctatggaaagggagactgtttcagaggacttgacaccatcttcagtaatttctctggttcttggcagctccatttggctgcgtccctaccctgcataaccctcccagctagtctactccagggcagcatccagctggtgacctgagagggcagtggcgcaccagtctccatgaaggttgagctccgatggccaacagccatttccaccttgtggtctacaactcttcatcccgactgcatggaggttggtctctctcttcagctggatttaggccaccatctgagcccccggggtacgttttgtctgaccctggcgccattcgaacggttcttctacagcatcagttctctttcctgccaccatgtgaagaaggacatgtttgcttccccttctgccatgaatgaaaaacatggccagcaaagcaggtgaggcaaagatcaggaaggacattaaacgccaaac

SEQ ID NO: 55880 - DNA, 597 bp, Homo sapiens; identical to SEQ ID NO: 55878

SEQ ID NO: 55881 - DNA, 2077 bp, Homo sapiens
atgggggaagaactgtgggatgagctgtctggtggcaagaaaacagtttgtttatggagttgtcaatttgagagtcttcttagaaatctccatctccttgttaaaagtggagatgttgagtgggcatttggatacacatgtctgaagttaatgagaaagattcatgctgaacttatcagtgtaaagatggtatttcataccatgagatgggatgagatcagcaaagtacggtgggtggccttgaccgaatctgacatcttctggaacacgactgacactggctgggtgaaggcagcctggactctcttctctgcctggcctaatggatcttgcatttttgtgcatgagctgccccgagttgatgccaaagttatcctgaatgttgtcatctgtgccaatccaaaaggcatgaaaatcaagtctggatccatggggaaggcgtccccaccctacgatgtgcagattgtggatgatgagggcaacgtcctgcctcctggagaagaggggaatgttgccgtccgtatcagacccactcggcccttctgtttcttcaattgctatttggctggcaagcgactcccaagcccagccctgtggtgggtgaatgggaaggggaagaaattaatgtggaatttcagagaactgagtgaaaacagccagcaggcagccaacgtcctctcgggagcctgtggcctgcagcgtggggatcgtgtggcagtggtgctgccccgagtgcctgagtggtggctggtgatcctgggctgcattcgagcaggtctcatctttatgcctggaaccatccagatgaaatccactgacatactgtataggttgcagatgtctaaggccaaggctattgttgctggggatgaagtcatccaagaagtggacacagtggcatctgaatgtccttctctgagaattaagctactggtgtctgagaaaagctgtgatgggtggctgaacttcaagaaactactaaatgaggcatccaccactcatcactgtgtggagactggaagccaggaagcatctgccatctacttcactagtgggaccagtggtcttcccaagatggcagaacattcctactcgagcctgggcctcaaggccaagatggatgctggttggacaggcctgcaagcctctgatataatgtggaccatatcagacacaggttggatactgaacatcttgtgctcacttatggaaccttgggcattaggagcatgcacatttgttcatctcttgccaaagtttgacccactggttattctaaagacactctccagttatccaatcaagagtatgatgggtgcccccattgtttaccggatgttgctacagcaggatctttccagttacaagttcccccatctacagaactgcgtcactgtaggggagtcccttcttccagaaactctggagaactggagggcccagacaggactggacatccgagaatcctatggccagacagaaacgggattgacttgcatggtttccaagacaatgaaaatcaaaccaggatacatgggaacggctgcttcctgttatgatgtacagatcatagatgataagggcaacgtcctgccccccggcacagaaggagacattggcatcagggtcaaacccatcaggcctataggcatcttctctggctatgtggtatcatccccatgctctatgccattgatcttctttagagccatgccaggcactttacagtaagacttcaccatctagttggaggaatccctatcttcagatcttgggaaggtaaagacagataatccttgaatctggccacctcacttgacaggtgaggatggtggagccagagattacaagacttgctcaagctcacaaccattagaaagtggacagagaagaccccaagggcatgccttctgatccctgagagaattgattaataaactaaataaacaataaatcaaataataatagtttctaccatttattgaatgcatatcatgaggcaagcattgtcctataaacacatttaatctttaaactttaaactcatttaaactttaaactcgtttaatcctcccag

SEQ ID NO: 55882 - DNA, 288 bp, Homo sapiens
atgttggaagatgaagaaagagcaggcacaacaaagggcaagatgaggagcaaaacagagagtgagaaggctggcaagcgactcccaagcccagccctgtggtgggtgaatgggaaggggaaggaattaatgtggaatttcagagaactgagtgaaaacagccagcaggcagccaacgtcctctcgggagcctgtggcctgcagcgtggggatcgtgtggcagtgatgctgccccgagtgcctgagtggtggctggtgatcctgggctgcattcgagcaggttggtaa

SEQ ID NO: 55883 - DNA, 929 bp, Homo sapiens
gaataaaaaacctcttccttctttaatccggtgtccgaggagttttgtgtgcgactcgtcctgctacatttcttggttacaaaaacctcttccttctttaatccggtgtctgaggagttttgtttgcgactcgtcctgctacatttcttggttccgtgaccgggaagcgaggtgattgaaggacggtcgaggcagccccttaggctgcttaggcctgccctgtggagcgtccctgcaagggactctggccagcttgagcgacgggcatcctgagagcgctcccgggtaggcaattgccctggtggaacacctcgtcagagcagtgtgtggcaggcccccgcggaggatcaacgtggtggctgaacaccgggaaggaactggcactagaagtctggacgtctgaaacttgatcccctgcctgcagcacgtgctgatctccaagggtgaggctggatgaagccaggggctatggaaagggagactgtttcagaggacttgacaccatcttcagtaatttctctggttcttggcagctccatttggctgcgtccctaccctgcataaccctcccagctagtctactccagggcagcgtccagctggtgacctgagagggcagtggcgcaccagtctccatgaaggttgagctccgatggccaacggccatttccaccttgtggtctacaactcttcatcccgactgcatggaggttggtctctctcttcagctggatttaggccaccatctgagcccccggggtacgttttgtctgaccctggcgccattcgaacggttcttctacagcatcagttctctttcctgccaccatgtgaagaaggacatgtttgcttccccttctgccatgaatgaaaaacatggccagcaaagcaggtgaggcaaagatcaggaaggacattaaacgccaaac

SEQ ID NO: 55884 - DNA, 543 bp, Homo sapiens
atggcctcatgggatgaaaaagacctgactatccgccagcccaacacccgtaaagggattgatatgtatatagaaggtatggcagatttgaatgaaatgatccttcttctgcccatatgtcaacctgaggaaaaagatgtcaaacttgccttgatcgaagagagaatgaaaaattgctatttccctacctttgagaaagccctgaaaaccagaatcagcaacctccccacagtgaagaagtttctgcagcctggcagccagaggaggcctcccgtagatgtgaaagctttagaagaagcaaggaagactttcaagctggagaagagagaaccagtagtggctcagtctgagtctgaaagcctcacaccagggaagccaacagtgcagccttcagtctgtggccaaaagcccgagagctcccagcaagccgctggtgcaagccccagagtccaaaggccaaagaacctggagtctaatgacaagggcaagaggagcgggaggaagaatccagcacgggagaaagaaggcagccagaggacttag

SEQ ID NO: 55885 - DNA, 3729 bp, Homo sapiens
atgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgagaacccggaaggcatcccggtcaagcaggactccttgtcttctcagaaccagcttggcgtcttgcccttgtcttgggacattccggaactcgtcaacatgggccagtggaagatccgagcctactatgaaaactcaccacagcaggtcttctccactgagtttgaggtgaaggagtacgtgctgcccagtttcgaggtcatagtggagcctacagagaaattctactacatctataacgagaagggcctggaggtcaccatcaccgccaggttcctctacgggaagaaagtggagggaactgcctttgtcatcttcgggatccaggatggcgaacagaggatttccctgcctgaatccctcaagcgcattccgattgaggatggctcgggggaggttgtgctgagccggaaggtactgctggacggggtgcagaacctccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggagatggcgtggccaaactcagcatcaacacacaccccagccagaagcccttgagcatcacggtgcgcacgaagaagcaggagctctcggaggcagagcaggctaccaggaccatgcaggctctgccctacagcaccgtgggcaactccaacaattacctgcatctctcagtgctacgtacagagctcagacccggggagaccctcaacgtcaacttcctcctgcgaatggaccgcgcccacgaggccaagatccgctactacacctacctgatcatgaacaagggcaggctgttgaaggcgggacgccaggtgcgagagcccggccaggacctggtggtgctgcccctgtccatcaccaccgacttcatcccttccttccgcctggtggcgtactacacgctgatcggtgccagcggccagagggaggtggtggccgactccgtgtgggtggacgtcaaggactcctgcgtgggctcgctggtggtaaaaagcggccagtcagaagaccggcagcctgtacctgggcagcagatgaccctgaagatagagggtgaccacggggcccgggtggtactggtggccgtggacaagggcgtgttcgtgctgaataagaagaacaaactgacgcagagtaagatctgggacgtggtggagaaggcagacatcggctgcaccccgggcagtgggaaggattacgccggtgtcttctccgacgcagggctgaccttcacgagcagcagtggccagcagaccgcccagagggcagaacttcagtgcccgcagccagccgcccgccgacgccgttccgtgcagctcacggagaagcgaatggacaaagtcggcaagtaccccaaggagctgcgcaagtgctgcgaggacggcatgcgggagaaccccatgaggttctcgtgccagcgccggacccgtttcatctccctgggcgaggcgtgcaagaaggtcttcctggactgctgcaactacatcacagagctgcggcggcagcacgcgcgggccagccacctgggcctggccaggagtaacctggatgaggacatcattgcagaagagaacatcgtttcccgaagtgagttcccagagagctggctgtggaacgttgaggacttgaaagagccaccgaaaaatggaatctctacgaagctcatgaatatatttttgaaagactccatcaccacgtgggagattctggctgtcagcatgtcggacaagaaagggatctgtgtggcagaccccttcgaggtcacagtaatgcaggacttcttcatcgacctgcggctaccctactctgttgttcgaaacgagcaggtggaaatccgagccgttctctacaattaccggcagaaccaagagctcaaggtgagggtggaactactccacaatccagccttctgcagcctggccaccaccaagaggcgtcaccagcagaccgtaaccatcccccccaagtcctcgttgtccgttccatatgtcatcgtgccgctaaagaccggcctgcaggaagtggaagtcaaggctgccgtctaccatcatttcatcagtgacggtgtcaggaagtccctgaaggtcgtgccggaaggaatcagaatgaacaaaactgtggctgttcgcaccctggatccagaacgcctgggccgtgaaggagtgcagaaagaggacatcccacctgcagacctcagtgaccaagtcccggacaccgagtctgagaccagaattctcctgcaagggaccccagtggcccagatgacagaggatgccgtcgacgcggaacggctgaagcacctcattgtgaccccctcgggctgcggggaacagaacatgatcggcatgacgcccacggtcatcgctgtgcattacctggatgaaacggagcagtgggagaagttcggcctagagaagcggcagggggccttggagctcatcaagaaggggtacacccagcagctggccttcagacaacccagctctgcctttgcggccttcgtgaaacgggcacccagcacctggctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcccttggctcaataccaaaaggacgcccctgaccaccaggaactga

SEQ ID NO: 55886 - DNA, 555 bp, Homo sapiens
atggctgctcagaacgcaccagcgcctctgggcatctcactgtgcatgcttaggcgccttgcggctctgttgtttttcagaatgctttttttcttcttccccacagagggtgcctcagaagaggagatcagacttagcaagatggtgatgaaattctgggccaactttgctcgcaatggaaaccccaatggggaagggctgccccactggccagagtacaaccagaaggaagggtatctgcagattggtgccaacacccaggcggcccagaagctgaaggacaaagaagtagctttctggaccaacctctttgccaagaaggcagtggagaagccaccccagacagaacacatagagctgtgaatgaagatccagccggccttgggagcctggaggagcaaagactggggtcttttgcgaaagggattgcaggttcagaaggcatcttaccatggctggggaattgtctggtggtggggggcaggggacagaggccatgaaggagcaagttttgtatttgtgacctcagctttgggaataaaggatcttttgaag

SEQ ID NO: 55887 - DNA, 2126 bp, Homo sapiens
caactggaaaagaagcattgcataagaccaggatgtctctgaaatggacgtcagtctttctgctgatacagctcagttgttactttagctctggaagctgtggaaaggtgctagtgtggcccacagaatacagccattggataaatatgaagacaatcctggaagagcttgttcagaggggtcatgaggtgactgtgttgacatcttcggcttctactcttgtcaatgccagtaaatcatctgctattaaattagaagtttatcctacatctttaactaaaaattatttggaagattctcttctgaaaattctcgatagatggatatatggtgtttcaaaaaatacattttggtcatatttttcacaattacaagaattgtgttgggaatattatgactacagtaacaagctctgtaaagatgcagttttgaataagaaacttatgatgaaactacaagagtcaaagtttgatgtcattctggcagatgcccttaatccctgtggtgagctactggctgaactatttaacataccctttctgtacagtcttcgattctctgttggctacacatttgagaagaatggtggaggatttctgttccctccttcctatgtacctgttgttatgtcagaattaagtgatcaaatgattttcatggagaggataaaaaatatgatacatatgctttattttgacttttggtttcaaatttatgatctgaagaagtgggaccagttttatagtgaagttctaggaagacccactacattatttgagacaatggggaaagctgaaatgtggctcattcgaacctattgggattttgaatttcctcgcccattcttaccaaatgttgattttgttggaggacttcactgtaaaccagccaaacccctgcctaaggaaatggaagagtttgtgcagagctctggagaaaatggtattgtggtgttttctctggggtcgatgatcagtaacatgtcagaagaaagtgccaacatgattgcatcagcccttgcccagatcccacaaaaggttctatggagatttgatggcaagaagccaaatactttaggttccaatactcgactgtacaagtggttaccccagaatgaccttcttggtcatcccaaaaccaaagcttttataactcatggtggaaccaatggcatctatgaggcgatctaccatgggatccctatggtgggcattcccttgtttgcggatcaacatgataacattgctcacatgaaagccaagggagcagccctcagtgtggacatcaggaccatgtcaagtagagatttgctcaatgcattgaagtcagtcattaatgaccctgtctataaagagaatgtcatgaaattatcaagaattcatcatgaccaaccaatgaagcccctggatcgagcagtcttctggattgagtttgtcatgcgccacaaaggagccaagcaccttcgagtcgcagctcacaacctcacctggatccagtaccactctttggatgtgatagcattcctgctggcctgcgtggcaactgtgatatttatcatcacaaaattttgcctgttttgtttccgaaagcttgccaaaaaaggaaagaagaagaaaagagattagttatatcaaaagcctgaagtggaatgactgaaagatgggactcctcctttatttcagcatggagggttttaaatggaggatttcctttttcctgtgacaaaacatcttttcacaacttaccttgttaagacaaaatttattttccagggatttaatacgtactttagctgaattattctatgtcaatgatttttaagctatgaaaaatacaatggggggaaggatagcatttggagatatacctaatgttaaatgacgagttactggatgcagcacgccaacatggcacatgtatacatatgtagctaacctgcacgttgtgcacatgtaccctaaaacttaaagtataatttaaaaaaagcaaaaaaaaaaaatacaactcttttttttaaaccaggaaggaaaatgtgaacatggaaacaacttctagtattggatctgaaaataaagtgtcatccaagccataaaaaaaaaagaaaagaaaaataaaaataatataaa

SEQ ID NO: 55888 - DNA, 2059 bp, Homo sapiens
aacaacaactggaaaagaagcattgcataagaccaggatgtctctgaaatggacgtcagtctttctgctgatacagctcagttgttactttagctctggaagctgtggaaaggtgctagtgtggcccacagaatacagccattggataaatatgaagacaatcctggaagagcttgttcagaggggtcatgaggtgactgtgttgacatcttcggcttctactcttgtcaatgccagtaaatcatctgctattaaattagaagtttatcctacatctttaactaaaaattatttggaagattctcttctgaaaattctcgatagatggatatatggtgtttcaaaaaatacattttggtcatatttttcacaattacaagaattgtgttgggaatattatgactacagtaacaagctctgtaaagatgcagttttgaataagaaacttatgatgaaactacaagagtcaaagtttgatgtcattctggcagatgcccttaatccctgtggtgagctactggctgaactatttaacataccctttctgtacagtcttcgattctctgttggctacacatttgagaagaatggtggaggatttctgttccctccttcctatgtacctgttgttatgtcagaattaagtgatcaaatgattttcatggagaggataaaaaatatgatacatatgctttattttgacttttggtttcaaatttatgatctgaagaagtgggaccagttttatagtgaagttctaggaagacccactacattatttgagacaatggggaaagctgaaatgtggctcattcgaacctattgggattttgaatttcctcgcccattcttaccaaatgttgattttgttggaggacttcactgtaaaccagccaaacccctgcctaaggaaatggaagagtttgtgcagagctctggagaaaatggtattgtggtgttttctctggggtcgatgatcagtaacatgtcagaagaaagtgccaacatgattgcatcagcccttgcccagatcccacaaaaggttctatggagatttgatggcaagaagccaaatactttaggttccaatactcgactgtacaagtggttaccccagaatgaccttcttggtcatcccaaaaccaaagcttttataactcatggtggaaccaatggcatctatgaggcgatctaccatgggatccctatggtgggcattcccttgtttgcggatcaacatgataacattgctcacatgaaagccaagggagcagccctcagtgtggacatcaggaccatgtcaagtagagatttgctcaatgcattgaagtcagtcattaatgaccctgtctataaagagaatgtcatgaaattatcaagaattcatcatgaccaaccaatgaagcccctggatcgagcagtcttctggattgagtttgtcatgcgccacaaaggagccaagcaccttcgagtcgcagctcacaacctcacctggatccagtaccactctttggatgtgatagcattcctgctggcctgcgtggcaactgtgatatttatcatcacaaaattttgcctgttttgtttccgaaagcttgccaaaaaaggaaagaagaagaaaagagattagttatatcaaaagcctgaagtggaatgactgaaagatgggactcctcctttatttcagcatggagggttttaaatggaggatttcctttttcctgtgacaaaacatcttttcacaacttaccttgttaagacaaaatttattttccagggatttaatacgtactttagctgaattattctatgtcaatgatttttaagctatgaaaaataataatataaaaccttatgggcttatattgatatttattattctaatccaaaagttacacacgaaagttactgagcttcattatgtttcacacattgtatttgaacacaacaacattaagaactccactcatagtatcaacattgttttgcaaatactcaaaatattttggcttcattttgagcagaatttttgttttactttagccaatgaaatcttcaa

SEQ ID NO: 55889 - DNA, 7156 bp, Homo sapiens
ggcgcgatgagttgcagcaaggcctacggggagcggtacgtcgcctcggtgcagggctccgccccgtcgcctcgaaagaagtcaacgagaggattctattttgcaaagctgtattatgaagctaaagaatatgatcttgctaaaaaatacatatgtacttacattaatgtgcgagagatggatcccagagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcagaatactgggtggaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcgaaatcttctttgggtggaaatgatgaactgtcagctactttcttagaaatgaaaggacatttctacatgcatgctggttctctgctcttgaagatgggtcagcatggtaataatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagtggttgttgaaacttttgccaacaaaagcgggcagtctgcattatatgatgctctgttttctagtcagtcacctaaggatacatcttttcttggtagcgatgatattggaaacattgatgtacaagaaccagagcttgaagatttggctagatacgatgttggtgctattcgagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaactcagcaaaattgagacttctagttcagcatgaaataaacactctaagagcccaggaaaaacatggccttcaacctgctctgcttgtacattgggcaaaatgccttcagaaaatgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacgtaacttttgctatattggatgcagtaaatggaaatatagaagatgctatgactgcttttgaatctataaaaagtgttgtttcttattggaatcttgcactgatttttcacaggaaggcagaagacattgcaaatgatgccctttctcctgaagaacaagaagaatgcaaaaattatctgagaaagaccaggggctacctaataaagattttagatgacagtgattcaaatctttcagtggtcaagaaattgcctgtgcccctggagtctgtaaaagagatgcttaagtcagtcatgcaggaactcgaaaactatagtgaaggaggtcctctctataaaaatggttctttgcgaaatgcggattcagaaataaaacattctacaccatctcctaccaaatattcactatcaccaagtaaaagttacaagtattctcccaaaacaccacctcgatgggcagaagatcagaattctttactgaaaatgattcgccaagaagtaaaggccattaaggaagaaatgcaggagttgaaactaaatagcagtaagtcagcatcccatcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagtgaaaagcctcttgaaaatgatactggcttacaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaagtcagtggaaagaaaggggcttggggaacttaaaaattctcaaaaacgaggtcaatggcaaagtaagaatgctgatgcaaagagaacaagtactaaaagtgtgtgctaatcattggataacgactacaatgaacctgaagcccctctctggatcagatagagcatggatgtggtcagccagtgatttctctgatggtgatgccaaactagagcgattggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcgctgaggaagaaaataagggttcaggtacaggtgcggccggtgcctcagacacaacaataaaacccaatgctgaaaacactgggcccacattagaatgggataactatgatttaagggaagatgctttggatgatagtgtcagtagtagctcagtacatgcttctccattggcaagtagccctgtgagaaaaaatcttttccactttgatgagtcaacaacaggatctaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaattctacagatatgataaagatgttggtcaatggaaagaaaggggcattggtgatataaagattttacagaattatgataataagcacgttcgtatactgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaaaccatttgcatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggtatgctgaatttactaaagaagaattggttcagaagctcagttccaccacaaaaagtgcagatcacttaaacggcctgcttcgggaaatagaggcaaccaatgcagtccttatggagcaaattaagcttctcaaaagtgaaataagaagattggaaaggaatcaagagcaagaggtgtctgcagctaacgtggaacacttgaagaacgtcttgctgcagttcattttcttgaagccaggtagtgaaagagagagacttcttcctgttataaatacgatgttgcagctcagccttgaagaaaagggaaaacttgctgcggttgctcaaggtcttcaagaaacctccatacccaagaaaaaatagaaagcaacgatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagcataacaacgattacatagcatttacattatattagggattgcacaagagaaggtatgtaggttatatgcaaatactgcaccattttacataagggacttgagaagcatggattttggtagccacaggggtcctggaaccaatccctcacagacacagagggacaactttacagtagatgaacacaaagatgaaagggaaagtcttacctaggtctgcggggagaagtggaactccatttttgacaggtgatgccattttttgttttggacatcgtccctctgtagttctttccattcccagtcttgcactctgaaagatacactgaaggaaagtccacacagcggtcaaagtctttcacaagacaccacgtgaaggtctgcacagcatagtcacgttgagaaaaagatctcatgcaccagaccccctgtttctgctttctaaaagatcatcttttgcatctgcaaaaaggctgcagtaaactgggccattccatactttgattcatgtattcaaatgctacttatgagctctctgtgtattgagccccaccaggatgctggggacacacggggcacagtgcagccagaggcttggccgtcatagagctcacattctagtggaatcaggcaggggggttacaggaaatattcaaggaaacaatataaaatgagatcacttaatgatgatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacagggctataaaattgtggtctactgtaaatggtttgcagtaaaagttctcaaccagcttccactcaaccaactcaccagttagacaatgggccctctcctgtgtttaaaacagtctggtgcccacctgggtccacatgcagctggcaggtgtttgctagtgtgcccacccatgtctgttccccccacgtgagttatgtgcttacaacgagtcatttctttgcattttccaactttcttacatttatatttaattaaagatgatctaaactgagaaatgaatgtgaaaaggaacaaagctcttttttgtttggtttttaactaaattaaatgtttttaacaagttgaaacgtgaatcatttaaaaaattgctatcagatccacagagggcaatccactcatatagttgactgtaaagcttgaggaggaattcataaaaatctaaaggttttacacatgcagattgattaataaatgtcgagatatggtccacttcaaaaataaggaaagtaattattgtagatgttgcactagagcatagtttatgcaggaaatgcaccagagaccttctactggtgaccccatattcgaagaaaaaaagcctctgctctacatcaaaaggtgtcaagtacacttgtgttttcaatgaaaatataaaatgtttaaggtatatttgcaccatcatttaaggttacccactttagccatttttaaattcactgatcaatcacatggggaaagtactcctaacatacctgcagcaaactaa

SEQ ID NO: 55890 - DNA, 7138 bp, Homo sapiens
ggcgcgatgagttgcagcaaggcctacggggagcggtacgtcgcctcggtgcagggctccgccccgtcgcctcgaaagaagtcaacgagaggattctattttgcaaagctgtattatgaagctaaagaatatgatcttgctaaaaaatacatatgtacttacattaatgtgcgagagatggatcccagagctcacagatttctgggtcttctttatgaattggaagaaaacacagagaaagccgttgaatgttacaggcgttcagtggaattaaacccaacacaaaaagatcttgtgttgaagattgcagaattgctttgtaaaaatgatgttactgatggaagagcagaatactgggtggaaagagcagcaaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggagttgtatcgctcaactaaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcgaaatcttctttgggtggaaatgatgaactgtcagctactttcttagaaatgaaaggacatttctacatgcatgctggttctctgctcttgaagatgggtcagcatggtaataatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagtggttgttgaaacttttgccaacaaaagcgggcagtctgcattatatgatgctctgttttctagtcagtcacctaaggatacatcttttcttggtagcgatgatattggaaacattgatgtacaagaaccagagcttgaagatttggctagatacgatgttggtgctattcgagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaactcagcaaaattgagacttctagttcagcatgaaataaacactctaagagcccaggaaaaacatggccttcaacctgctctgcttgtacattgggcaaaatgccttcagaaaatgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacgtaacttttgctatattggatgcagtaaatggaaatatagaagatgctatgactgcttttgaatctataaaaagtgttgtttcttattggaatcttgcactgatttttcacaggaaggcagaagacattgcaaatgatgccctttctcctgaagaacaagaagaatgcaaaaattatctgagaaagaccaggggctacctaataaagattttagatgacagtgattcaaatctttcagtggtcaagaaattgcctgtgcccctggagtctgtaaaagagatgcttaagtcagtcatgcaggaactcgaaaactatagtgaaggaggtcctctctataaaaatggttctttgcgaaatgcggattcagaaataaaacattctacaccatctcctaccaaatattcactatcaccaagtaaaagttacaagtattctcccaaaacaccacctcgatgggcagaagatcagaattctttactgaaaatgattcgccaagaagtaaaggccattatgaaactaaatagcagtaagtcagcatcccatcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatccctgtgtctgctgatggatttaaatttggcatttcggaaccaggaaatcaagaaaagaaaagtgaaaagcctcttgaaaatgatactggcttacaggctcaggatattagtggccggaagaagggccgtggtgtgatttttggccaaacaagtagcacttttacatttgcagatgttgcaaaatcaacttcaggagaaggatttcagtttggcaaaaaagacctcaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcctgaaaaagtagaacttgtaacaggagaagaaggtgaaaaagttctgtattcacagggggtaaaactatttagatttgatgctgaggtaagtcagtggaaagaaaggggcttggggaacttaaaaattctcaaaaacgaggtcaatggcaaagtaagaatgctgatgcaaagagaacaagtactaaaagtgtgtgctaatcattggataacgactacaatgaacctgaagcccctctctggatcagatagagcatggatgtggtcagccagtgatttctctgatggtgatgccaaactagagcgattggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcgctgaggaagaaaataagggttcaggtacaggtgcggccggtgcctcagacacaacaataaaacccaatgctgaaaacactgggcccacattagaatgggataactatgatttaagggaagatgctttggatgatagtgtcagtagtagctcagtacatgcttctccattggcaagtagccctgtgagaaaaaatcttttccactttgatgagtcaacaacaggatctaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaattctacagatatgataaagatgttggtcaatggaaagaaaggggcattggtgatataaagattttacagaattatgataataagcacgttcgtatactgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaaaccatttgcatttggcaacagttctgccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaacggaagaatcttcaatcaactacacatttaaaacaccagaaaaggagcctccattatggtatgctgaatttactaaagaagaattggttcagaagctcagttccaccacaaaaagtgcagatcacttaaacggcctgcttcgggaaatagaggcaaccaatgcagtccttatggagcaaattaagcttctcaaaagtgaaataagaagattggaaaggaatcaagagcaagaggtgtctgcagctaacgtggaacacttgaagaacgtcttgctgcagttcattttcttgaagccaggtagtgaaagagagagacttcttcctgttataaatacgatgttgcagctcagccttgaagaaaagggaaaacttgctgcggttgctcaaggtcttcaagaaacctccatacccaagaaaaaatagaaagcaacgatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagcataacaacgattacatagcatttacattatattagggattgcacaagagaaggtatgtaggttatatgcaaatactgcaccattttacataagggacttgagaagcatggattttggtagccacaggggtcctggaaccaatccctcacagacacagagggacaactttacagtagatgaacacaaagatgaaagggaaagtcttacctaggtctgcggggagaagtggaactccatttttgacaggtgatgccattttttgttttggacatcgtccctctgtagttctttccattcccagtcttgcactctgaaagatacactgaaggaaagtccacacagcggtcaaagtctttcacaagacaccacgtgaaggtctgcacagcatagtcacgttgagaaaaagatctcatgcaccagaccccctgtttctgctttctaaaagatcatcttttgcatctgcaaaaaggctgcagtaaactgggccattccatactttgattcatgtattcaaatgctacttatgagctctctgtgtattgagccccaccaggatgctggggacacacggggcacagtgcagccagaggcttggccgtcatagagctcacattctagtggaatcaggcaggggggttacaggaaatattcaaggaaacaatataaaatgagatcacttaatgatgatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacagggctataaaattgtggtctactgtaaatggtttgcagtaaaagttctcaaccagcttccactcaaccaactcaccagttagacaatgggccctctcctgtgtttaaaacagtctggtgcccacctgggtccacatgcagctggcaggtgtttgctagtgtgcccacccatgtctgttccccccacgtgagttatgtgcttacaacgagtcatttctttgcattttccaactttcttacatttatatttaattaaagatgatctaaactgagaaatgaatgtgaaaaggaacaaagctcttttttgtttggtttttaactaaattaaatgtttttaacaagttgaaacgtgaatcatttaaaaaattgctatcagatccacagagggcaatccactcatatagttgactgtaaagcttgaggaggaattcataaaaatctaaaggttttacacatgcagattgattaataaatgtcgagatatggtccacttcaaaaataaggaaagtaattattgtagatgttgcactagagcatagtttatgcaggaaatgcaccagagaccttctactggtgaccccatattcgaagaaaaaaagcctctgctctacatcaaaaggtgtcaagtacacttgtgttttcaatgaaaatataaaatgtttaaggtatatttgcaccatcatttaaggttacccactttagccatttttaaattcactgatcaatcacatggggaaagtactcctaacatacctgcagcaaactaa

SEQ ID NO: 55891 - DNA, 529 bp, Homo sapiens
tgggacagaggactgctgtctgccctctctggtcaccctgcctagctagaggatctgagactactcaccccataacctcaaaaacctcttcatgaggatggtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggcctgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatcccaaataaatgccttgttacaagatttctgtgttt

SEQ ID NO: 55892 - DNA, 785 bp, Homo sapiens
ttggtcatctatgacaccacaccagcacagtaggacctcagaaaagtacccaaatgctgacttgatcatgaactactgcaggaatccagatcctgtggaaggcccttggtgttacacgatggatcccaaagtcagatgggagtactgcaacctgacacgatgctcagacacagaagggactgcagtcgtgcctctgactgttatcccggttccaagcctagaggatccttccaaaccagcaccaacagagccaaggccttgggagcagcagtgctaccacggtaatggacagagttatcgaggcacatacttcaccactgtcacaggaagaacctgccaagcttggtcatctatgacgccacatcagcacagtaggaccccagaaaatggcctgaccaggaactactgcaggaatccagattctgggaaacaaccctggtgttacacaactgatccgtgtgtgaggtgggagtactgcaacctgacacaatgctcagaaacagaatcagtgtcctagagactcccactgttgttccagttccaagcatggaggctcattctgaagcagcaccaactgagcaaacccctgtggtccggcagtgctaccatggtaatggacagagttatcaaggcacattctccaccactgtcacaggaaggacatgtcaatcttggtcatccatgacaccacaccggcatcagaggaccccagaaaactacccaaatgaactctatgtttgggaatgggaaaggataccggggcaagaaggcaaccactgttactg

SEQ ID NO: 55893 - DNA, 675 bp, Homo sapiens
atgcagaagctggagctgggccggtacaatgagacacacgccatagccaagtggctactagagaagcaggagctgggaggaggcttcaggtccacccagaccacggtggtggcccttgaagctctgacccgcttccgcgaagctgtccccttcaagggcatccaggatctccacgtccagatcagagcccccaagacagccctgaatgtgaattggtacattgatcacagcaatgcctaccaacagcggtcagcaaagttccttgcccaggacgacctagagatcaaagccagtggcaacgggagaggcaccatctcgatcctgacaatgtatcacaagtccccagagtcccgggaggacaactgcaacctgtaccacctgaatgcgactctccacagtgccctagaagaaaataaaaagggaggtgagacttttcggctccggatggaaacaaggttccagaacaattgagaggccacaatgactatcatggaggtctccctgctcacgggcttctaccccaaccaggatgacctcaaacagctcacgagtgatgtggagaggtacgcctttcagtacaaaaccaagacaagtaccagcgacagcactgttgtcctctacctggaaaagctctcccatgagaagaacacggtgctgggctttcgggttcacagg

SEQ ID NO: 55894 - DNA, 887 bp, Homo sapiens
atggaggtctccctgctcacgggcttctaccccaaccaggatgacctcaaacagctcacgagtgatgtggagaggtacgcctttcagtacaaaaccaagacaagtaccagcgacagcactgttgtcctctacctggaaaagacaggactctgttctctccagctctcccatgagaagaacacggtgctgggctttcgggttcacaggatgctgcaggcggagttcctgcaggccgccctggtcaccatctacgactactacgagccttcccggaggtgcagcactttctacaacctgcccacagagcaatcttccctgagaaagatctgccacaaagacatctgcagatgtgcagagggacagtgcccatccctgcagaagcccagtggccaattgaggcaggaggagctccagacaacagcatgtgaggcaggcgtggattttgtgtacaagacaaagctggaatctgtggaggtctctgcctccaacccttacgtctattacaacacgcagctcgaagacatcattaagagtggtacggaccctgccacacccctggccatgaagaaattcgtctcccatgccacttgccatgactccctggggttgcaagaacaggaatcgtacctcatcatgggccagacgtcagacctgtggagaatcaaatctgattacagctatgttctgggcaaggagacgttcctcatcctttggccagcagatggagatgccagcaagaaagaattgcgggaccaactggaggaatttttggaatatatgcgcacccacggctgccagtcctgagcctcttctgctttcagggaggtgtcatcaggcagctctgggccactgggtttaaccccaaataaagagcacaggatatgaca

SEQ ID NO: 55895 - DNA, 1446 bp, Homo sapiens
atgattgaagaaaatattattttaacaatagataaagcttacttgactttcaaatggagagatgatgaaaacccactcattcactctttcagaacaaaaagacagtcatctgataagagtatgacatggatgaaatgccctacaggggccttggacatctttaatttctgcgattatgtgaaagaggtggactttacagataatggagcagaagccaacattagtaaaaggaatcccaacttcttcccatagaattagaaacatgtgaaagtacaataaacttcttgttcaaattaccagcatcagagagcttcccatttgcatctagaccttgaatttatatttattgatcaagttctaatttgtatgtatattttgtgcatattcaccaataacagttaaaattaattatgtgttatagttaatatatgcacctaccttcttccgttagtgcatcagtaaatgtgttattttgtcatttttccaaagagagtgttgtaggttttccctgtagttcttcctttatagcttttcttctgataaccatgacttcaggagctttaaaactatctatcttgcatttgtgtctggcggagaactagccatcagcctcctgaagcctgccatcattgttaatttgaggactgggctgtcttggggctcagaagataaagaactatttgagcagatgtgtgtgggtggcactggattccacccaactgccaagttagtattgttagagatttcattttacaacacaaaaataagcctgtgtcaaagattttaaaatcatggaaagttaaaatctagaaagaccttagagaaccagccaaccaactctctcattttaaaagtgaaggattcatagcacagattacttgcctaagatcatccaggaacgaagacaagaatccaaatgtacttggggacaagaattagtccccaaattcagtgttcttcctagtattaaacattgcccctttcgacaaattttggatttcattcttgttatatttcagtactcttgctgatttattttaggtttaactggtaaagaatgaacatttcagaagtgttaggattagtcagtgtcatcgcttatgtatatgaatcacttgccaaagacactggctctcctcagctgtaaccagcatgtcaaatgtgaagattattgtgtgggatcctttggtttcattgttatgatgtattttataaatgtactagttatatccttgtttatgtatttttgctgatctttcataaagcagaatggtatgtatcggattgttttaatgttatatattggattgtattcgatgttacaaaaccaatattctatggagaatgaaaaaaataaaggactaaattaactggagatttttggtactcttataaagcaaaattgtttgttatacatacagatgaaataagaaaataatgtaatct

SEQ ID NO: 55896 - DNA, 675 bp, Homo sapiens; identical to SEQ ID NO: 55893

SEQ ID NO: 55897 - DNA, 887 bp, Homo sapiens; identical to SEQ ID NO: 55894

SEQ ID NO: 55898 - DNA, 785 bp, Homo sapiens; identical to SEQ ID NO: 55892

SEQ ID NO: 55899 - DNA, 1446 bp, Homo sapiens
atgattgaagaaaatattattttaacaatagataaagcttacttgactttcaaatggagagatgatgaaaacccactcattcagtctttcagaacaaaaagacagtcatctgataagagtatgacatggatgaaatgccctacaggggccttggacatctttaatttctgcgattatgtgaaagaggtggactttacagataatggagcagaagccaacattagtaaaaggaatcccaacttcttcccatagaattagaaacatgtgaaagtacaataaacttcttgttcaaattaccagcatcagagagcttcccatttgcatctagaccttgaatttatatttattgatcaagttctaatttgtatgtatattttgtgcatattcaccaataacagttaaaattaattatgtgttatagttaatatatgcacctaccttcttccgttagtgcatcagtaaatgtgttattttgtcatttttccaaagagagtgttgtaggttttccctgtagttcttcctttatagcttttcttctgataaccatgacttcaggagctttaaaactatctatcttgcatttgtgtctggcggagaactagccatcagcctcctgaagcctgccatcattgttaatttgaggactgggctgtcttggggctcagaaggtaaagaactatttgagcagatgtgtgtgggtggcactggattccacccaactgccaagttagtattgttagagatttcattttacaacacaaaaataagcctgtgtcaaagattttaaaatcatggaaagttaaaatctagaaagaccttagagaaccagccaaccaactctctcattttaaaagtgaaggattcatagcacagattacttgcctaagatcatccaggaacgaagacaagaatccaaatgtacttggggacaagaattagtccccaaattcagtgttcttcctagtattaaacattgcccctttcgacaaattttggatttcattcttgttatatttcagtactcttgctgatttattttaggtttaactggtaaagaatgaacatttcagaagtgttaggattagtcagtgtcatcgcttatgtatatgaatcacttgccaaagacactggctctcctcagctgtaaccagcatgtcaaatgtgaagattattgtgtgggatcctttggtttcattgttatgatgtattttataaatgtactagttatatccttgtttatgtatttttgctgatctttcataaagcagaatggtacgtatcggattgttttaatgttatatattggattgtattcgttgttacaaaaccaatattctatggagaatgaaaaaaataaaggactaaattaactggagatttttggtactcttataaagcaaaattgtttgttatacatacagatgaaataagaaaataatgtaatct

SEQ ID NO: 55900 - DNA, 13938 bp, Homo sapiens
ctgggattgggacacactttctggacactgctggccagtcccaaaatggaacataaggaagtggttcttctacttcttttatttctgaaatcagcagcacctgagcaaagccatgtggtccaggattgctaccatggtgatggacagagttatcgaggcacgtactccaccactgtcacaggaaggacctgccaagcttggtcatctatgacaccacatcaacataataggaccacagaaaactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatcctgtggcagccccttattgttatacgagggatcccagtgtcaggtgggagtactgcaacctgacacaatgctcagacgcagaagggactgccgtcgcgcctccaactattaccccgattccaagcctagaggctccttctgaacaagcaccaactgagcaaaggcctggggtgcaggagtgctaccacggaaatggacagagttatcaaggcacatacttcattactgtcacaggaagaacctgccaagcttggtcatctatgacaccacactcgcatagtcggaccccagcatactacccaaatgctggcttgatcaagaactactgccgaaatccagatcctgtggcagccccttggtgttatacaacagatcccagtgtcaggtgggagtactgcaacctgacacgatgctcagatgcagaatggactgccttcgtccctccgaatgttattctggctccaagcctagaggctttttttgaacaagcactgactgaggaaacccccggggtacaggactgctactaccattatggacagagttaccgaggcacatactccaccactgtcacaggaagaacttgccaagcttggtcatctatgacaccacaccagcatagtcggaccccagaaaactacccaaatgctggcctgaccaggaactactgcaggaatccagatgctgagattcgcccttggtgttacaccatggatcccagtgtcaggtgggagtactgcaacctgacacaatgcctggtgacagaatcaagtgtccttgcaactctcacggtggtcccagatccaagcacagaggcttcttctgaagaagcaccaacggagcaaagccccggggtccaggattgctaccatggtgatggacagagttatcgaggctcattctctaccactgtcacaggaaggacatgtcagtcttggtcctctatgacaccacactggcatcagaggacaacagaatattatccaaatggtggcctgaccaggaactactgcaggaatccagatgctgagattagtccttggtgttataccatggatcccaatgtcagatgggagtactgcaacctgacacaatgtccagtgacagaatcaagtgtccttgcgacgtccacggctgtttctgaacaagcaccaacggagcaaagccccacagtccaggactgctaccatggtgatggacagagttatcgaggctcattctccaccactgttacaggaaggacatgtcagtcttggtcctctatgacaccacactggcatcagagaaccacagaatactacccaaatggtggcctgaccaggaactactgcaggaatccagatgctgagattcgcccttggtgttataccatggatcccagtgtcagatgggagtactgcaacctgacgcaatgtccagtgatggaatcaactctcctcacaactcccacggtggtcccagttccaagcacagagcttccttctgaagaagcaccaactgaaaacagcactggggtccaggactgctaccgaggtgatggacagagttatcgaggcacactctccaccactatcacaggaagaacatgtcagtcttggtcgtctatgacaccacattggcatcggaggatcccattatactatccaaatgctggcctgaccaggaactactgcaggaatccagatgctgagattcgcccttggtgttacaccatggatcccagtgtcaggtgggagtactgcaacctgacacgatgtccagtgacagaatcgagtgtcctcacaactcccacagtggccccggttccaagcacagaggctccttctgaacaagcaccacctgagaaaagccctgtggtccaggattgctaccatggtgatggacggagttatcgaggcatatcctccaccactgtcacaggaaggacctgtcaatcttggtcatctatgataccacactggcatcagaggaccccagaaaactacccaaatgctggcctgaccgagaactactgcaggaatccagattctgggaaacaaccctggtgttacacaaccgatccgtgtgtgaggtgggagtactgcaatctgacacaatgctcagaaacagaatcaggtgtcctagagactcccactgttgttccagttccaagcatggaggctcattctgaagcagcaccaactgagcaaacccctgtggtccggcagtgctaccatggtaatggccagagttatcgaggcacattctccaccactgtcacaggaaggacatgtcaatcttggtcatccatgacaccacaccggcatcagaggaccccagaaaactacccaaatgatggcctgacaatgaactactgcaggaatccagatgccgatacaggcccttggtgttttaccatggaccccagcatcaggtgggagtactgcaacctgacgcgatgctcagacacagaagggactgtggtcgctcctccgactgtcatccaggttccaagcctagggcctccttctgaacaagactgtatgtttgggaatgggaaaggataccggggcaagaaggcaaccactgttactgggacgccatgccaggaatgggctgcccaggagccccatagacacagcacgttcattccagggacaaataaatgggcaggtctggaaaaaaattactgccgtaaccctgatggtgacatcaatggtccctggtgctacacaatgaatccaagaaaactttttgactactgtgatatccctctctgtgcatcctcttcatttgattgtgggaagcctcaagtggagccgaagaaatgtcctggaagcattgtaggggggtgtgtggcccacccacattcctggccctggcaagtcagtctcagaacaaggtttggaaagcacttctgtggaggcaccttaatatccccagagtgggtgctgactgctgctcactgcttgaagaagtcctcaaggccttcatcctacaaggtcatcctgggtgcacaccaagaagtgaacctcgaatctcatgttcaggaaatagaagtgtctaggctgttcttggagcccacacaagcagatattgccttgctaaagctaagcaggcctgccgtcatcactgacaaagtaatgccagcttgtctgccatccccagactacatggtcaccgccaggactgaatgttacatcactggctggggagaaacccaaggtacctttgggactggccttctcaaggaagcccagctccttgttattgagaatgaagtgtgcaatcactataagtatatttgtgctgagcatttggccagaggcactgacagttgccagggtgacagtggagggcctctggtttgcttcgagaaggacaaatacattttacaaggagtcacttcttggggtcttggctgtgcacgccccaataagcctggtgtctatgctcgtgtttcaaggtttgttacttggattgagggaatgatgagaaataattaattggacgggagacagagtgaagcatcaacctacttagaagctgaaacgtgggtaaggatttagcatgctggaaataatagacagcaatcaaacgaagacactgttcccagctaccagctatgccaaaccttggcatttttggtatttttgtgtataagcttttaaggtctgactgacaaattctgtattaaggtgtcatagctatgacatttgttaaaaataaactctgcacttattttgatttga

SEQ ID NO: 55901 - DNA, 2042 bp, Homo sapiens
tgagagaatcattaacttaatttgactatctggtttgtggatgcgtttactctcatgtaagtcaacaacatcctgggattgggacacactttctgggcactgctggccagtcccaaaatggaacataaggaagtggttcttctacttctgttatttctgaaatcagcaccgactgagacagggccttctgtgcaggagtgctaccacagtaatggacagagttatcgaggcacatacttcaccactgtcacaggaagaacctgccaagcttggtcatctatgacgccacaccagcacagtagaaccccagaaaagtacccaaatgatggcttgatctcgaactactgcaggaatccggattgttcggcaggcccttggtgttatacgacggatcccaatgtcaggtgggagtactgcaacctgacacggtgctcagacgatgaagggactgtgttcgtgcctctgactgttatcccagttccaagcctagaggattcattcatacaagtggcttgatctccaactactgcaggaatccggattgttcggcaggcccttggtgttatacaacggatcccaaagtcaggtgggagtactgcaacctgacaggatgctcagacaagaatagggctgtggccgcgcctctgactattatcccggttccaagacgagaggatacttccaaacaagcactgattgatccaaggccttcaatgtaggagtgctaccatggaaatggacagagttatcgaggcacatacttcaccaccgtcacaggaagcacttgccaagcttggtcatctatgacaccacaccagcacagtaggacctcagaaaagtacccaaatgctgacttgatcatgaactactgcaggaatccagatcctgtggaaggcccttggtgttacacgatggatcccaaagtcagatgggagtactgcaacctgacacgatgctcagacacagaagggactgcagtcgtgcctctgactgttatcccggttccaagcctagaggatccttccaaaccagcaccaacagagccaaggccttgggagcagcagtgctaccacggtaatggacagagttatcgaggcacatacttcaccactgtcacaggaagaacctgccaagcttggtcatctatgacgccacatcagcacatggcctgaccaggaactactgcaggaatccagattctgggaaacaaccctggtgttacacaactgatccgtgtgtgaggtgggagtactgcaacctgacacaatgctcagaaacagaatcagtgtcctagagactcccactgttgttccagttccaagcatggaggctcattctgaagcagcaccaactgagcaaacccctgtggtccggcagtgctaccatggtaatggacagagttatcaaggcacattctccaccactgtcacaggaaggacatgtcaatcttggtcatccatgacaccacaccggcatcagaggaccccagaaaactacccaaatgatggcctgacaatgaactactgcaggaatccagatgccgatacaggcccttggtgttttaccacagaccccagcgtcaggtgggagtactgcaacctgacgcgatgctcagacagaagggactgtggtcgctcctccgactgttatccaggttccaagcctagaggctccttccgaacaagtaaaaagtctgtatccagacatctatgtgcttggacaacgggatgaaaagacatgaaaaaccacactgatgcagaagcctttagtgctgcacgggagctcgagtgttggttgagggtctgccatgaccaaggaagcctcaatgccgtccctgggaaagccagagctgtgatttttggcacaacttgcgagtgtagtgactttaggactggcgcaaaacctccagggtgctcaacttaaccactcaccttgttctaaaataggttatttcagtgtcccagtcaaattcctattctaacatgctgtcaactatgtgattctttccaagccaataaacatttccagtaatttcttaaaaa

SEQ ID NO: 55902 - DNA, 1713 bp, Homo sapiens
tgagagaatcattaacttaatttgactatctggtttgtggatgcgtttactctcatgtaagtcaacaacatcctgggattgggacacactttctgggcactgctggccagtcccaaaatggaacataaggaagtggttcttctacttctgttatttctgaaatcagcaccgactgagacagggccttctgtgcaggagtgctaccacagtaatggacagagttatcgaggcacatacttcaccactgtcacaggaagaacctgccaagcttggtcatctatgacgccacaccagcacagtagaaccccagaaaagtacccaaatgatggcttgatctcgaactactgcaggaatccggattgttcggcaggcccttggtgttatacgacggatcccaatgtcaggtgggagtactgcaacctgacacggtgctcagacgatgaagggactgtgttcgtgcctctgactgttatcccagttccaagcctagaggattcattcatacaagtggcttgatctccaactactgcaggaatccggattgttcggcaggcccttggtgttatacaacggatcccaaagtcaggtgggagtactgcaacctgacaggatgctcagacaagaatagggctgtggccgcgcctctgactattatcccggttccaagacgagaggatacttccaaacaagcactgattgatccaaggccttcaatgtaggagtgctaccatggaaatggacagagttatcgaggcacatacttcaccaccgtcacaggaagcacttgccaagcttggtcatctatgacaccacaccagcacagtaggacctcagaaaagtacccaaatgctgacttgatcatgaactactgcaggaatccagatcctgtggaaggcccttggtgttacacgatggatcccaaagtcagatgggagtactgcaacctgacacgatgctcagacacagaagggactgcagtcgtgcctctgactgttatcccggttccaagcctagaggatccttccaaaccagcaccaacagagccaaggccttgggagcagcagtgctaccacggtaatggacagagttatcgaggcacatacttcaccactgtcacaggaagaacctgccaagcttggtcatctatgacgccacatcagcacatggcctgaccaggaactactgcaggaatccagattctgggaaacaaccctggtgttacacaactgatccgtgtgtgaggtgggagtactgcaacctgacacaatgctcagaaacagaatcagtgtcctagagactcccactgttgttccagttccaagcatggaggctcattctgaagcagcaccaactgagcaaacccctgtggtccggcagtgctaccatggtaatggacagagttatcaaggcacattctccaccactgtcacaggaaggacatgtcaatcttggtcatccatgacaccacaccggcatcagaggaccccagaaaactacccaaatgactctatgtttgggaatgggaaaggataccggggcaagaaggcaaccactgttactgggacgccacgccaagaatggactgcccaagagccccatagacacagcaggttcactccagggacaagtccacgggcaggtctggaaaaaaatgtagggacatggatgaagctggaaaccatcatcctcagcaaactatcgcaaggacaaaaa

SEQ ID NO: 55903 - DNA, 1780 bp, Homo sapiens
gcagagctaccatgtcctcttggagcagacagcgaccaaaaagcccagggggcattcaaccccatgtttctagaactctgttcctgctgctgctgttggcagcctcagcctggggggtcaccctgagccccaaagactgccaggtgttccgctcagaccatggcagctccatctcctgtcaaccacctgccgaaatccccggctacctgccagccgacaccgtgcacctggccgtggaattcttcaacctgacccacctgccagccaacctcctccagggcgcctctaagctccaagaattgcacctctccagcaatgggctggaaagcctctcgcccgaattcctgcggccagtgccgcagctgagggtgctggatctaacccgaaacgccctgaccgggctgcccccgggcctcttccaggcctcagccaccctggacaccctggtattgaaagaaaaccagctggaggtcctggaggtctcgtggctacacggcctgaaagctctggggcatctggacctgtctgggaaccgcctccggaaactgccccccgggctgctggccaacttcaccctcctgcgcacccttgaccttggggagaaccagttggagaccttgccacctgacctcctgaggggtccgctgcaattagaacggctacatctagaaggcaacaaattgcaagtactgggaaaagatctcctcttgccgcagccggacctgcgctacctcttcctgaacggcaacaagctggccagggtggcagccggtgccttccagggcctgcggcagctggacatgctggacctctccaataactcactggccagcgtgcccgaggggctctgggcatccctagggcagccaaactgggacatgcgggatggcttcgacatctccggcaacccctggatctgtgaccagaacctgagcgacctctatcgttggcttcaggcccaaaaagacaagatgttttcccagaatgacacgcgctgtgctgggcctgaagccgtgaagggccagacgctcctggcagtggccaagtcccagtgagaccaggggcttgggttgagggtggggggtctggtagaacactgcaacccgcttaacaaataatcctgcctttggccgggtgcgggggctcacgcctgtaatcccagcactttgggaggcccaggtgggcggatcacgaggtcaggagatcgagaccatcttggctaacatggtgaaaccctgtctctactaaaaatataaaaaattagccaggcgtggtggtgggcacctgtagtcccagcaactcgggaggctgaggcaggagaatggcgtgaacttgggaggcggagcttgcggtgagccaagatcgtgccactgcactctagcctgggcgacagagcaagactgtctcaaaaaaattaaaattaaaattaaaaacaaataatcctgccttttacaggtgaaactcggggctgtccatagcggctgggaccccgtttcatccatccatgcttcctagaacacacgatgggctttccttacccatgcccaaggtgtgccctccgtctggaatgccgttccctgtttcccagatctcttgaactctgggttctcccagccccttgtccttccttccagctgagccctggccacactggggctgcctttctctgactctgtcttccccaagtcagggggctctctgagtgcagggtctgatgctgagtcccacttagcttggggtcagaaccaaggggtttaataaataacccttgaaaactgga

SEQ ID NO: 55904 - DNA, 1257 bp, Homo sapiens
gtcccgacgcctcccgcccccgcagttccttggagagcttggagccgcgcgccggagggaataggaaagcttggttacaacccgggacacccggagcttcaggatggttcgtactaagacatggaccctgaagaagcactttgttggctatcctactaatagtgactttgagttgaagacatctgagctcccacccttaaaaaatggagaggtcctgcttgaagctttgttcctcaccgtggatccctacatgagagtggcagccaaaagattgaaggaaggtgatacaatgatggggcagcaagtggccaaagttgtggaaagtaaaaatgtagccctaccaaaaggaactattgtactggcttctccaggctggacaacgcactccatttctgatgggaaagatctggaaaagctgctgacagagtggccagacacaataccactgtctttggctctggggacagttggcatgccaggcctgactgcctactttggcctacttgaaatctgtggtgtgaagggtggagaaacagtgatggttaatgcagcagctggagctgtgggctcagtcgtggggcagattgcaaagctcaagggctgcaaagttgttggagcagtagggtctgatgaaaaggttgcctaccttcaaaagcttggatttgatgtcgtctttaactacaagacggtagagtctttggaagaaaccttgaagaaagcgtctcctgatggttatgattgttattttgataatgtaggtggagagttttcaaacactgttatcggccagatgaagaaatttggaaggattgccatatgtggagccatctctacatataacagaaccggcccacttcccccaggcccacccccagagattgttatctatcaggagcttcgcatggaagcttttgtcgtctaccgctggcaaggagatgcccgccaaaaagctctgaaggacttgctgaaatgggtcttagagggtaaaatccagtacaaggaatatatcattgaaggatttgaaaacatgccagccgcatttatgggaatgctgaaaggagataatttggggaagacaatagtgaaagcatgaaaaagaggacacatggaatctggaggccatttagatgattagttaatttgtttttcaccatttagcaaaaatgtatactaccttaaatgtcttaagaaatagtactcataatgagtttgagctacttaataaaatacatttaagtggtaaaaaaaaaaaaaaaa

SEQ ID NO: 55905 - DNA, 2460 bp, Homo sapiens
ggccagctggacgggcacaccatgaggctgctgaccctcctgggccttctgtgtggctcggtggccacccccttgggcccgaagtggcctgaacctgtgttcgggcgcctggcatcccccggctttccaggggagtatgccaatgaccaggagcggcgctggaccctgactgcaccccccggctaccgcctgcgcctctacttcacccacttcgacctggagctctcccacctctgcgagtacgacttcgtcaagctgagctcgggggccaaggtgctggccacgctgtgcgggcaggagagcacagacacggagcgggcccctggcaaggacactttctactcgctgggctccagcctggacattaccttccgctccgactactccaacgagaagccgttcacggggttcgaggccttctatgcagccgaggacattgacgagtgccaggtggccccgggagaggcgcccacctgcgaccaccactgccacaaccacctgggcggtttctactgctcctgccgcgcaggctacgtcctgcaccgtaacaagcgcacctgctcagccctgtgctccggccaggtcttcacccagaggtctggggagctcagcagccctgaatacccacggccgtatcccaaactctccagttgcacttacagcatcagcctggaggaggggttcagtgtcattctggactttgtggagtccttcgatgtggagacacaccctgaaaccctgtgtccctacgactttctcaagattcaaacagacagagaagaacatggcccattctgtgggaagacattgccccacaggattgaaacaaaaagcaacacggtgaccatcacctttgtcacagatgaatcaggagaccacacaggctggaagatccactacacgagcacagcgcagccttgcccttatccgatggcgccacctaatggccacgtttcacctgtgcaagccaaatacatcctgaaagacagcttctccatcttttgcgagactggctatgagcttctgcaaggtcacttgcccctgaaatcctttactgcagtttgtcagaaagatggatcttgggaccggccaatgcccgcgtgcagcattgttgactgtggccctcctgatgatctacccagtggccgagtggagtacatcacaggtcctggagtgaccacctacaaagctgtgattcagtacagctgtgaagagaccttctacacaatgaaagtgaatgatggtaaatatgtgtgtgaggctgatggattctggacgagctccaaaggagaaaaatcactcccagtctgtgagcctgtttgtggactatcagcccgcacaacaggagggcgtatatatggagggcaaaaggcaaaacctggtgattttccttggcaagtcctgatattaggtggaaccacagcagcaggtgcacttttatatgacaactgggtcctaacagctgctcatgccgtctatgagcaaaaacatgatgcatccgccctggacattcgaatgggcaccctgaaaagactatcacctcattatacacaagcctggtctgaagctgtttttatacatgaaggttatactcatgatgctggctttgacaatgacatagcactgattaaattgaataacaaagttgtaatcaatagcaacatcacgcctatttgtctgccaagaaaagaagctgaatcctttatgaggacagatgacattggaactgcatctggatggggattaacccaaaggggttttcttgctagaaatctaatgtatgtcgacataccgattgttgaccatcaaaaatgtactgctgcatatgaaaagccaccctatccaaggggaagtgtaactgctaacatgctttgtgctggcttagaaagtgggggcaaggacagctgcagaggtgacagcggaggggcactggtgtttctagatagtgaaacagagaggtggtttgtgggaggaatagtgtcctggggttccatgaattgtggggaagcaggtcagtatggagtctacacaaaagttattaactatattccctggatcgagaacataattagtgatttttaacttgcgtgtctgcagtcaaggattcttcatttttagaaatgcctgtgaagaccttggcagcgacgtggctcgagaagcattcatcattactgtggacatggcagttgttgctccacccaaaaaaacagactccaggtgaggctgctgtcatttctccacttgccagtttaattccagccttacccattgactcaaggggacataaaccacgagagtgacagtcatctttgcccacccagtgtaatgtcactgctcaaattacatttcattaccttaaaaagccagtctcttttcatactggctgttggcatttctgtaaactgcctgtccatgctctttgtttttaaacttgttcttattgaaaaaaaaaaaaaaaaa

SEQ ID NO: 55906 - DNA, 3419 bp, Homo sapiens
gagtcgctcaggagcaagctgtggcaagctggagggagggacacatcccgtgttccatccactccctcccttctcagcagtcctcgcctgttctcacgtgctcacaggcagttaggcagaagtgatccccgtggctctgccaaagacaagcctgttgggttgaaagaagaagaagaagaagaaaaaaaaactcaggcaaagtcacagcctcaaaattgttcactgaaagaagcgtgagtggagaagtgtgagaagatgaatggaccggtggatggcttgtgtgaccactctctaagtgaaggagtcttcatgttcacatcggagtctgtgggagagggacacccggataagatctgtgaccagatcagtgatgcagtgctggatgcccatctcaagcaagaccccaatgccaaggtggcctgtgagacagtgtgcaagaccggcatggtgctgctgtgtggtgagatcacctcaatggccatggtggactaccagcgggtggtgagggacaccatcaagcacatcggctacgatgactcagccaagggctttgacttcaagacttgcaacgtgctggtggctttggagcagcaatccccagatattgcccagtgcgtccatctggacagaaatgaggaggatgtgggggcaggagatcagggtttgatgttcggctatgctaccgacgagacagaggagtgcatgcccctcaccatcatccttgctcacaagctcaacgcccggatggcagacctcaggcgctccggcctcctcccctggctgcggcctgactctaagactcaggtgacagttcagtacatgcaggacaatggcgcagtcatccctgtgcgcatccacaccatcgtcatctctgtgcagcacaacgaagacatcacgctggaggagatgcgcagggccctgaaggagcaagtcatcagggccgtggtgccggccaagtacctggacgaagacaccgtctaccacctgcagcccagtgggcggtttgtcatcggaggtccccagggggatgcgggtgtcactggccgtaagattattgtggacacctatggcggctggggggctcatggtggtggggccttctctgggaaggactacaccaaggtagaccgctcagctgcatatgctgcccgctgggtggccaagtctctggtgaaagcagggctctgccggagagtgcttgtccaggtttcctatgccattggtgtggccgagccgctgtccatttccatcttcacctacggaacctctcagaagacagagcgagagctgctggatgtggtgcataagaacttcgacctccggccgggcgtcattgtcagggatttggacttgaagaagcccatctaccagaagacagcatgctacggccatttcggaagaagcgagttcccatgggaggttcccaggaagcttgtattttagagccagggggagctgggcctggtctcaccctggaggcacctggtggccatgctcctcttccccagacgcctggctgctgatcgccttccccacccaccaaccctcagggcaaagccaggtccctctcatttagcctgtcctgtcatcatcatggccagctggaggcaggggcttcctggtgctggaggttggatcttgatgtaaggatgggcatggtgttctcctgctgctccctcagactggggcaatgttaatttagtggaaaaggcacccccgtcaagagtgaattccctcactcgtctcccccaacagctggaccctgaccagctccccctccctccccttgcctgtgccaggtgaggtcagcacatctcaacaggcctcagggctccttgtgggcctgggctcctggacccccctttcacaggcagccagtgccctgagccagggtctccagaaagccccacccaggccaggcatgtggcaggggttagagcaggactgatgtctcctaagcacctgtaatgtgcgagggacccagctaataactgatctcgttttttcttcactgcaacatgatgaggtagtaccttttatatcccatttatagatgggggaaagcaaagcacagagagtctggataacttccacagggtcccacagccacgtgtttagacctagatgtataactaggagctttgactcaggagcctgtgacataccccctcccccaccgttgtctcatgccagtaacaggctcaaacaatgacaaagcagattcagaaatgaggccatggactctgtcctgaaggcctgaggttactggaaattaggggattaacccactagctcttgttgagccgtgggcaattgtctgaaaagtgaagacagaaccacagggctattttgtttgcttcatgtgtcccagaagatgactgagggtgagttggcttacctggcccatcagggtaggctggagttagggactgaccagcagctttagaatcccagccccctgaccactcagagacatgcagagattgggtttttggacttctggggtaagtggtctaagtccagtccagtcctatctgggcttcctggagcagaagcagcaacttgtcctagcacagatggccagccccttagacagaggccctcaagtctttctctttccctggtcccttgtatcccctgcaggctgagtgcatttggagggagtgagtggccctttcggatccagggaggctggtcctatggcctcatgttaaataggcggggcttgccttctggtgttggacaagcttctgagacgtcatgaggagattctgcctttgccaggtgactgtctggggagcgggtctgctcccaaggggcctgagcagtccttggcctgctaaggtcttggaacttgcctgcctttccatccatggccagcagcacctgccctacctgccccacttgtccttagcctggacctctgacagcagcatctctaccttctccccagctcccaggaccacaggctcaggcaggggcctccatgggccccaggggaacactggggacttggcctctctctagggtacatggtgctgggagaggcagcccaggaagtctcatctggggagcaggcagccagcatctgggccttggcctggagcacaaagaccctggctttcattttctctcaggtgaaaggaaattaaggcaacaaaagaagcccggctcctggtcacctaggaagcctcagattccttcccatggagggagggagtggtttgcaggtggccaagttcctctaacttggctcacactcgacatgaaaattcagaattttatactttccctaccctctagagaaataagatcttttttgtcagtttgtttgtatgaaactaaagcctttatttgttaatagttcctgctaaaacaatgaataaaaactcaaggagcaactaaaaaaaaaaaaaaaa

SEQ ID NO: 55907 - DNA, 1229 bp, Homo sapiens
gaattacaaaggaggccgtctgcctcctttgtcctggatttgggagttgagcaccttcgtcgccattggctttcctcccccagctccagcctctctcatcttgggaatctgcgtcagaagtcactcgcagtcccgtcagcccagaagacgtaaagcaggctaccagcaattttgagaacttgcaaaaacagcttgcaaggaaaatgaagcttcctattttcatagcagatgcattcacagcaagagcatttcgtgggaatcctgctgctgtttgcctcctagaaaatgaattggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaccctggcttctgcagctgtgctgtttcacaaaataaaaaacatgaatagcacgctcacgtttgtcactctgagtggagaactaagggccagacgagcagaggatggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacagggtctgcacacgctgttctcagcagctactggtcccagcatctggggaagaaagaaatgcatggtaggacagctctttaccaatttcttttttatttgcctaattcgaagctagtgttccttctcatatgtactatccccttgaaaatgtaatacaatgtcatgtatcacccatgtgaaaatgaaaggttttaaaattccttcacccttaaagatcctccaccccaaacagccttcacctctgcctcccccaacatacagagactgtacagacacagatacagtaactgcccaataagtgtttgttgaataaaatagctgtataactttgaaaaa

SEQ ID NO: 55908 - DNA, 2587 bp, Homo sapiens
gaattacaaaggaggccgtctgcctcctttgtcctggatttgggagttgagcaccttcgtcgccattggctttcctcccccagctccagcctctctcatcttgggaatctgcgtcagaagtcactcgcagtcccgtcagcccagaagacgtaaagcaggctaccagcaattttgagaacttgcaaaaacagcttgcaaggaaaatgaagcttcctattttcatagcagatgcattcacagcaagagcatttcgtgggaatcctgctgctgtttgcctcctagaaaatgaattggatgaagacatgcatcagaaaattgcaagggagatgaacctctctgaaactgcttttatccgaaaactgcacccgacagacaactttgcacaaagttcctgctttggactgagatggtttacaccagcgagtgaggtcccactctgtggccatgccaccctggcttctgcagctgtgctgtttcacaaaataaaaaacatgaatagcacgctcacgtttgtcactctgagtggagaactaagggccagacgagcagaggatggcatcgtcctggacttgcctctttatccagcccacccccaggacttccatgaagtagaggacttgataaagactgccataggcaacacactggtccaggacatctgttattctccagatacccaaaagctcctcgtccgcctcagtgacgtttacaacaggtcgtttctggagaacctgaaagtgaacacggagaatctgctgcaagttgaaaacacagggaaggtgaaagggcttattcttacccttaaaggagagcctggtgggcagacccaagcatttgacttttactcaagatattttgcaccgtgggttggtgtggctgaagacccagtgacagggtctgcacacgctgttctcagcagctactggtcccagcatctggggaagaaagaaatgcatgcttttcagtgttcccaccgaggaggagagctgggaatttcccttcgtccagacggaagggttgacattagaggaggtgcagctgttgttttagagggcacactgacagcctagaggtggttatgctgtgacgctgctgtctctaaccaccaagtattttctgcttaaaaagaaatgtaaggggctgcctttagcaaatgtgcgtagtagtctacttaatcctcatgttaaaaatcgaaaaatgggccaggcgcagtggctcatgcctgtaatcgtagcactttgagaggccaaggtgggtggatcacctgaggtcaggggttcgacaccagcctggccaacatggtgaaacctcgtctctactacaaatacaaaaattagctgggtgtggtgccacatgcctgtaattccagctacttgggaggctgaggcatggagaatcgcttgaacccaggaggcagaagttgcagtgagcagagatcacaccactgcactccagcctgggcaacagagtaagactccatccacacacacacacacacacacaaaattgaaaagtgaagacattttaatggagatttaatagtgcttccagactaatgaactaatggagttttggctccactcatgagtgtatttgaaatgtaagtaaccagctacaaagaataatgtcacttcatttgattatgactaccaatcaagagaaggaggaatacatttctgaggagtgatactaaaccatttgagcttaaatgagtacctgattttgcagccattaaaatgagtcaataactatgtggaaatatagaaaaatattttataatataatactaagaaagaggacagtaggccataaagtgttagcagtgttatgctatgtctatataaataagcatgggccattaaaaatagcaaactgaaaacagttcatgtgtggggggcaagtttagaagtaattttaatgtatctaagaagtgatttcctttattgttgtactcaggtacgaagactaaaaatcaggatgaatccagaaaattaacacaaaaaagtatgtattaggctacttcctgtcatagtgaaattaaacactcaaagtaatgtaatctcagctgggcgtggcggctcatgcctgtaatcccagcactttggcaggacaaggcaggaggatcacttgaacctaggagttcgagaccagcctgggcaacacagcgagaacttgtctctattaaaaaaaaaaaaaggaatgtaatttcaatctttttcttgatatatggcttgagaatgataatgtaaaaggaattcttctcttacttcaataaaatgggttttaacataactttaaattcagttaaatatacaatattgaatacctatagttgactttgggatggggactttttcaagtcattaagagtgtttgtttaaggtgatctcattgatggtagttctcagccgtctcaaaaactgcaagctaatcagtcagacattctttaatgaccccaattttttcactttaattgttaccatgttttctatttttactgatttttgctaaagcatgtaagagtgaatttattatagcagtaatcttgtgtttctcctgatgtgcaataaatcaataattcaccagc

SEQ ID NO: 55909 - DNA, 1844 bp, Homo sapiens
aaaaagcggaaggggcgcgcggatagagctcccagtgtgccaagcgtgggcggtatacagtaaacaaagacaacccctattcttatcaccttgcctactgagtgcaagtccaggaactgtgtaagcagaccctcagaggagctctgggaaacactgaaaaatagcctctccccccattggctgccaggatggaaactaactacctgaagaggtgctttggaaattgcctggcccaggcactggcagaggtggcgaaggttcggcccagtgacccaatagaatacctggctcactggctttatcattacaggaaaacagcaaaagcaaaagaagagaatagggaaaagaagatccacctgcaggaggaatatgacagtagcctcaaggaaatggaaatgacagaaatgctgaaacaggaagagtatcagattcaacagaactgtgaaaagtgtcacaaggaactgacttctgaaactgtttccacgaagaagaccatattcatgcaggaggacacaaacccccttgagaaggaggccttgaagcaggaattcctgccaggtacttccagtctgattccaggaatgcctcaacaggttcctccttcagagtctgctggccagattgaccagaacttcaaaatgccacaagaaataaattacaaggaggcttttcagcatgaagttgctcatgaaatgcctcctggctccaaatctcctttttaggttacagaaggtagatgcttctgatttacttctctcaaagctagaagccaagaaaatggccagctagaaccaagatttaaggggctgtaaaaggcaagttcagggactctccagcctactccttttctgaaaaacccttaatcatgtgaacatttgaactagttataggataaaataaactcagaataaggatttaaaataagtaaccaagtggctgtgactttttcctcttgttttatcaacgttttggagactacacaatgaaaacacatctgttggggtgatcagacccaacacccggccatgggggctacaaagtccagccgagtcaaaggaaagagaaaagacaagtcaagagagaaagtgggaccagggggccaatgctagtatggaggctgtgaagtccccaagctctggaagcccacactatttgttggtgatcaaacaaagaaacaggtgatgaggatgtgggagttgaaagaaagtggtgtatcaagcgaatgaactacagctgtgagggtttagcattttctttgaaacatatggctacttgagataatgggagtgctagaagcaaggagccagcaagtctggacacattacaaaggccacaaggggttttatcctggaccccggacatgttccaagccctgcctcaacttttctcccaacactaagctttcctcccaacacacatccatctcgtgtgttcatgtcttaacttttgcttcacttcacagtcaggcctctccgagtattttttacacatatcctggagtctacctatgtcactgatagcagatatttttcttcaacatatattatcaatgttttaatacttttcttcaattttagtaactggtaaaatacatgtaagatgtaccatcttaaccatttttaagtgtacagatcagttgtattaagtagattcatattcttgtgcaaccatcatcaccatccggctgcaaaactctttcatcttgcaaaactgaaactctacacccattaaaaaataactcgccatttctctctctccccagcccctggcaaccaccattctttctgtctctgtgatttagattactctgtaagtatgttgtataaatagactcatacaatgtt

SEQ ID NO: 55910 - DNA, 2280 bp, Homo sapiens
tccagccagaaggatggggtggctcccactcctgctgcttctgactcaatgcttaggggtccctgggcagcgctcgccattgaatgacttccaagtgctccggggcacagagctacagcacctgctacatgcggtggtgcccgggccttggcaggaggatgtggcagatgctgaagagtgtgctggtcgctgtgggcccttaatggactgccgggccttccactacaacgtgagcagccatggttgccaactgctgccatggactcaacactcgccccacacgaggctgcggcgttctgggcgctgtgacctcttccagaagaaagactacgtacggacctgcatcatgaacaatggggttgggtaccggggcaccatggccacgaccgtgggtggcctgccctgccaggcttggagccacaagttcccgaatgatcacaagtacacgcccactctccggaatggcctggaagagaacttctgccgtaaccctgatggcgaccccggaggtccttggtgctacacaacagaccctgctgtgcgcttccagagctgcggcatcaaatcctgccgggaggccgcgtgtgtctggtgcaatggcgaggaataccgcggcgcggtagaccgcacggagtcagggcgcgagtgccagcgctgggatcttcagcacccgcaccagcaccccttcgagccgggcaagttcctcgaccaaggtctggacgacaactattgccggaatcctgacggctccgagcggccatggtgctacactacggatccgcagatcgagcgagagttctgtgacctcccccgctgcgggtccgaggcacagccccgccaagaggccacaactgtcagctgcttccgcgggaagggtgagggctaccggggcacagccaataccaccactgcgggcgtaccttgccagcgttgggacgcgcaaatccctcatcagcaccgatttacgccagaaaaatacgcgtgcaaagaccttcgggagaacttctgccggaaccccgacggctcagaggcgccctggtgcttcacactgcggcccggcatgcgcgcggccttttgctaccagatccggcgttgtacagacgacgtgcggccccaggactgctaccacggcgcaggggagcagtaccgcggcacggtcagcaagacccgcaagggtgtccagtgccagcgctggtccgctgagacgccgcacaagccgcagttcacgtttacctccgaaccgcatgcacaactggaggagaacttctgccggaacccagatggggatagccatgggccctggtgctacacgatggacccaaggaccccattcgactactgtgccctgcgacgctgcgctgatgaccagccgccatcaatcctggaccccccagaccaggtgcagtttgagaagtgtggcaagagggtggatcggctggatcagcggcgttccaagctgcgcgtggttgggggccatccgggcaactcaccctggacagtcagcttgcggaatcggcagggccagcatttctgcggggggtctctagtgaaggagcagtggatactgactgcccggcagtgcttctcctcctgccatatgcctctcacgggctatgaggtatggttgggcaccctgttccagaacccacagcatggagagccaagcctacagcgggtcccagtagccaagatggtgtgtgggccctcaggctcccagcttgtcctgctcaagctggagagatctgtgaccctgaaccagcgtgtggccctgatctgcctgccccctgaatggtatgtggtgcctccagggaccaagtgtgagattgcaggctggggtgagaccaaaggtacgggtaatgacacagtcctaaatgtggccttgctgaatgtcatctctaaccaggagtgtaacatcaagcaccgaggacgtgtgcgggagagtgagatgtgcactgagggactgttggcccctgtgggggcctgtgagggtgactacgggggcccacttgcctgctttacccacaactgctgggtcctggaaggaattataatccccaaccgagtatgcgcaaggtcccgctggccagctgtcttcacgcgtgtctctgtgtttgtggactggattcacaaggtcatgagactgggttaggcccagccttgatgccatatgccttggggaggacaaaacttcttgtcagacataaagccatgtttcctctttaaaaaaaaaaaaaaaaaaaaaaaaaaaaaaaataaaaaaaaaaaaaaaaaaaaaaaaaa

SEQ ID NO: 55911 - DNA, 404 bp, Homo sapiens
gcctgccctgacttctcatatcttgcctaggaactccaggcttgtcttggctccaaatggatcccaactgctcctgcaccacaggtggctcctgtgcctgcgccggctcctgcaagtgcaaagagtgcaaatgtacctcctgcaagaagtgctgctgctcttgctgccccgtgggctgtgccaagtgtgcccagggctgtgtctgcaaaggctcatcagagaagtgccgctgctgtgcctgatgttgggagagccctgctcccagacataaatagagcaaccagtactaacctggatttttttttttaactaccctgaccggtttgctacattcttttttctattcaatatgtgaaagacaataaaacacttttgacttgaaaaaaaaaaaaaaaaaaaaaaaa

SEQ ID NO: 55912 - DNA, 408 bp, Homo sapiens
cgctccaccacgccgtccacgtgcgccttgcggtctctccatttatcgcttgagatctccagccttaccgcggctcgaaatggaccccaactactcctgcaccactggtggctcctgcacgtgcgccggctcctgcaagtgcaaagagtgcaaatgcacctcctgcaagaagagctgctgcttctgctgccccatgggctgagccaagtgtgcccacggctgcatctgcaaagggacgtcggagaagtgcagctgctgtgcctgatgtgggaacagctcttctcccagatgttaatagaacaacctgcacaacctggattttttttttatacaatactgagccatttgctgcatttctttttatattaaatatgtgagtgacaataaaacaattttgacttgaatctt

SEQ ID NO: 55913 - DNA, 431 bp, Homo sapiens
ccacgccgtccgggtgggcctagcagtcgctccatttatcgcttgagatctccagccttaccgcggctcgaaatggaccccaactgctcctgcaccactggtgtctcctgcgcctgcaccggctcctgcaagtgcaaagagtgcaaatgcacctcctgcaagaagagctgctgctcctgctgccccgtgggctgtgccaagtgtgcccacggctgtgtctgcaaagggacgttggagaactgcagctgctgtgcctgatgtgggaacagctcttctcccagatgttaatagaacaagctgcacaacctggattttttttcaatacgatactgagccatttgctgcatttctttttatgttaaatatgtgagtgacaataaaacaattttgacttgaaaaaaaaaaaaaaaaaaaaaaaaaaaaaaaaaaaa

SEQ ID NO: 55914 - DNA, 435 bp, Homo sapiens
cctgtggcttaggaactccagcctcacctgatctccgaatggacctcagctgctcctgcgccactggtggctcctgcacctgtgccagctcctgcaaatgcaaagagtacaaatgcacctcctgcaagaagaactgctgctcctgctgccccatgggctgtgccaaatgttcccagggctgcacctgaaaaggggcattggagaagtgcagctgccgtgcctgatgttgggacagtctcaggtccgtttcctagctaaaaatgtaagagcatcaggccagatgatatgagggcacaggaatcagtcatggacctatgctttggtgagataaatagaatgaataagtatgaaaaataaaaatacaaagttatttcttatattcaacaaagaaatctcaaaacagatgtgaagaacaaaataacaggaaaaataaaa

SEQ ID NO: 55915 - DNA, 1276 bp, Homo sapiens
tgagatcacttcccttgcacagtttggaagggagagcactttattacagaccttggaagcaagaggattgcattcagcctagttcctggttgctggccaaagggatcatggacattgaagcatattttgaaagaattggctataagaactctaggaacaaattggacttggaaacattaactgacattcttgagcaccagatccgggctgttccctttgagaaccttaacatgcattgtgggcaagccatggagttgggcttagaggctatttttgatcacattgtaagaagaaaccggggtgggtggtgtctccaggtcaatcaacttctgtactgggctctgaccacaatcggttttcagaccacaatgttaggagggtatttttacatccctccagttaacaaatacagcactggcatggttcaccttctcctgcaggtgaccattgacggcaggaattacattgtcgatgctgggtctggaagctcctcccagatgtggcagcctctagaattaatttctgggaaggatcagcctcaggtgccttgcattttctgcttgacagaagagagaggaatctggtacctggaccaaatcaggagagagcagtatattacaaacaaagaatttcttaattctcatctcctgccaaagaagaaacaccaaaaaatatacttatttacgcttgaacctcgaacaattgaagattttgagtctatgaatacatacctgcagacgtctccaacatcttcatttataaccacatcattttgttccttgcagaccccagaaggggtttactgtttggtgggcttcatcctcacctatagaaaattcaattataaagacaatacagatctggtcgagtttaaaactctcactgaggaagaggttgaagaagtgctgaaaaatatatttaagatttccttggggagaaatctcgtgcccaaacctggtgatggatcccttactatttagaataaggaacaaaataaacccttgtgtatgtatcacccaactcactaattatcaacttatgtgctatcagatatcctctctaccctcacgttattttgaagaaaatcctaaacatcaaatactttcatccataaaaatgtcagcatttattaaaaaacaataactttttaaagaaacataaggacacattttcaaattaataaaaataaaggcattttaaggatggcctgtgattatcttgggaagcagagtgattcatgctagaaaacatttaatattgatttattgttgaattc

SEQ ID NO: 55916 - DNA, 1336 bp, Homo sapiens
cctaactccaatcactggcaactcctgagatcagaggaaaaccagcaacagcgtgggagtttggggagaggcattccataccagattctgtggcctgcaggtgacatgctgcctaagagaagcaggagtctgtgacagccaccccaacacgtgacgtcatggccagtagggaagatgagctgaggaactgtgtggtatgtggggaccaagccacaggctaccactttaatgcgctgacttgtgagggctgcaagggtttcttcaggagaacagtcagcaaaagcattggtcccacctgcccctttgctggaagctgtgaagtcagcaagactcagaggcgccactgcccagcctgcaggttgcagaagtgcttagatgctggcatgaggaaagacatgatactgtcggcagaagccctggcattgcggcgagcaaagcaggcccagcggcgggcacagcaaacacctgtgcaactgagtaaggagcaagaagagctgatccggacactcctgggggcccacacccgccacatgggcaccatgtttgaacagtttgtgcagtttaggcctccagctcatctgttcatccatcaccagcccttgcccaccctggcccctgtgctgcctctggtcacacacttcgcagacatcaacactttcatggtactgcaagtcatcaagtttactaaggacctgcccgtcttccgttccctgcccattgaagaccagatctcccttctcaagggagcagctgtggaaatctgtcacatcgtactcaataccactttctgtctccaaacacaaaacttcctctgcgggcctcttcgctacacaattgaagatggagcccgtgtggggttccaggtagagtttttggagttgctctttcacttccatggaacactacgaaaactgcagctccaagagcctgagtatgtgctcttggctgccatggccctcttctctcctgaccgacctggagttacccagagagatgagattgatcagctgcaagaggagatggcactgactctgcaaagctacatcaagggccagcagcgaaggccccgggatcggtttctgtatgcgaagttgctaggcctgctggctgagctccggagcattaatgaggcctacgggtaccaaatccagcacatccagggcctgtctgccatgatgccgctgctccaggagatctgcagctgaggccatgctcacttccttccccagctcacctggaacaccctggatacactggagtgggaaaatgctgggaccaaagattgggccgggttcaaagggagcccagtggttgcaatgaaagactaaagcaaaac

SEQ ID NO: 55917 - DNA, 2361 bp, Homo sapiens
aaagcagtgcttctctctggggccaaggccagagctgtggacaccttatcccactcatcctcatcctcttcctctgataaagcccctaccagtgctgataaagtctttctcgtgagagcctagaggccttaaaaaaaaaagtgcttgaaagagaaggggacaaaggaacaccagtattaagaggattttccagtgtttctggcagttggtccagaaggatgcctccattcctgcttctcacctgcctcttcatcacaggcacctccgtgtcacccgtggccctagatccttgttctgcttacatcagcctgaatgagccctggaggaacactgaccaccagttggatgagtctcaaggtcctcctctatgtgacaaccatgtgaatggggagtggtaccacttcacgggcatggcgggagatgccatgcctaccttctgcataccagaaaaccactgtggaacccacgcacctgtctggctcaatggcagccaccccctagaaggcgacggcattgtgcaacgccaggcttgtgccagcttcaatgggaactgctgtctctggaacaccacggtggaagtcaaggcttgccctggaggctactatgtgtatcgtctgaccaagcccagcgtctgcttccacgtctactgtggtcatttttatgacatctgcgacgaggactgccatggcagctgctcagataccagcgagtgcacatgcgctccaggaactgtgctaggccctgacaggcagacatgctttgatgaaaatgaatgtgagcaaaacaacggtggctgcagtgagatctgtgtgaacctcaaaaactcctaccgctgtgagtgtggggttggccgtgtgctaagaagtgatggcaagacttgtgaagacgttgaaggatgccacaataacaatggtggctgcagccactcttgccttggatctgagaaaggctaccagtgtgaatgtccccggggcctggtgctgtctgaggataaccacacttgccaagtccctgtgttgtgcaaatcaaatgccattgaagtgaacatccccagggagctggttggtggcctggagctcttcctgaccaacacctcctgccgaggagtgtccaacggcacccatgtcaacatcctcttctctctcaagacatgtggtacagtggtcgatgtggtgaatgacaagattgtggccagcaacctcgtgacaggtctacccaagcagaccccggggagcagcggggacttcatcatccgaaccagcaagctgctgatcccggtgacctgcgagtttccacgcctgtacaccatttctgaaggatacgttcccaaccttcgaaactccccactggaaatcatgagccgaaatcatgggatcttcccattcactctggagatcttcaaggacaatgagtttgaagagccttaccgggaagctctgcccaccctcaagcttcgtgactccctctactttggcattgagcccgtggtgcacgtgagcggcttggaaagcttggtggagagctgctttgccacccccacctccaagatcgacgaggtcctgaaatactacctcatccgggatggctgtgtttcagatgactcggtaaagcagtacacgtcccgggatcacctagcaaagcacttccaggtccctgtcttcaagtttgtgggcaaagaccacaaggaagtgtttctgcactgccgggttcttgtctgtggagtgttggacgagcgttcccgctgtgcccagggttgccaccggcgaatgcgtcgtggggcaggaggagaggactcagccggtctacagggccagacgctaacaggcggcccgatccgcatcgactgggaggactagttcgtagccatacctcgagtccctgcattggacggctctgctctttggagcttctccccccaccgccctctaagaacatctgccaacagctgggttcagacttcacactgtgagttcagactcccagcaccaactcactctgatcctggtccattcagtgggcacaggtcacagcactgctgaacaatgtggcctgggtggggtttcatctttctagggttgaaaactaaactgtccacccagaaagacactcaccccatttccctcatttctttcctacacttaaatacctcgtgtatggtgcaatcagaccacaaaatcagaagctgggtataatatttcaagttacaaaccctagaaaaattaaacagttactgaaattatgacttaaatacccaatgactccttaaatatgtaaattatagttataccttgaaatttcaattcaaatgcagactaattatagggaatttggaagtgtatcaataaaacagtatataatttt

SEQ ID NO: 55918 - DNA, 803 bp, Homo sapiens
gcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccagatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttggggccatcctgcccctccaacccgacatgtgtacctcagctttttccctcacttgcatcaataaagcttctgtgtttggaacagct

SEQ ID NO: 55919 - DNA, 1927 bp, Homo sapiens
gagccccaggactgagatatttttactataccttctctatcatcttgcacccccaaaatagcttccagggcacttctatttgtttttgtggaaagactggcaattagaggtagaaaagtgaaataaatggaaatagtactactcagggctgtcacatctacatctgtgtttttgcagtgccaatttgcattttctgagtgagttacttctactcaccttcacagcagccagtaccgcagtgccttgcatatattatatcctcaatgagtacttgtcaattgattttgtacatgcgtgtgacagtataaatatattatgaaaaatgaggaggccaggcaataaaagagtcaggatttcttccaaaaaaaatacacagcggtggagcttggcataaagttcaaatgctcctacaccctgccctgcagtatctctaaccaggggactttgataaggaagctgaagggtgatattacctttgctccctcactgcaactgaacacatttcttagtttttaggtggcccccgctggctaacttgctgtggagttttcaagggcatagaatcgtcctttacacaattaaaagaagatgctgtttaatctgaggatcctgttaaacaatgcagcttttagaaatggtcacaacttcatggttcgaaattttcggtgtggacaaccactacaaaataaagtgcagctgaagggccgtgaccttctcactctaaaaaactttaccggagaagaaattaaatatatgctatggctatcagcagatctgaaatttaggataaaacagaaaggagagtatttgcctttattgcaagggaagtccttaggcatgatttttgagaaaagaagtactcgaacaagattgtctacagaaacaggctttgcacttctgggaggacatccttgttttcttaccacacaagatattcatttgggtgtgaatgaaagtctcacggacacggcccgtgtattgtctagcatggcagatgcagtattggctcgagtgtataaacaatcagatttggacacccttgctaaagaagcatccatcccaattatcaatgggctgtcagatttgtaccatcctatccagatcctggctgattacctcacgctccaggaacactatagctctctgaaaggtcttaccctcagctggatcggggatgggaacaatatcctgcactccatcatgatgagcgcagcgaaattcggaatgcaccttcaggcagctactccaaagggttatgagccggatgctagtgtaaccaagttggcagagcagtatgccaaagagaatggtaccaagctgttgctgacaaatgatccattggaagcagcgcatggaggcaatgtattaattacagacacttggataagcatgggacaagaagaggagaagaaaaagcggctccaggctttccaaggttaccaggttacaatgaagactgctaaagttgctgcctctgactggacatttttacactgcttgcccagaaagccagaagaagtggatgatgaagtcttttattctcctcgatcactagtgttcccagaggcagaaaacagaaagtggacaatcatggctgtcatggtgtccctgctgacagattactcacctcagctccagaagcctaaattttgatgttgtgttacttgtcaagaaagaagcaatgttcttcagtaacagaatgagttggtttatggggaaaagagaagagaatctaaaaaataaacaaatccctaacacgtggtatgggtgaaccgtatgatatgctttgccattgtgaaactttccttaagcctttaatttaagtgctgatgcactgtaatacgtgcttaactttgcttaaactctctaattcccaatttctgagttacatttagatatcatattaattatcatatacatttacttc

SEQ ID NO: 55920 - DNA, 2680 bp, Homo sapiens
cagctgggggtaaggggggcggattattcatataattgttataccagacggtcgcaggcttagtccaattgcagagaactcgcttcccaggcttctgagagtcccggaagtgcctaaacctgtctaatcgacggggcttgggtggcccgtcgctccctggcttcttccctttacccagggcgggcagcgaagtggtgcctcctgcgtcccccacaccctccctcagcccctcccctccggcccgtcctgggcaggtgacctggagcatccggcaggctgccctggcctcctgcgtcaggacaagcccacgaggggcgttactgtgcggagatgcaccacgcaagagacaccctttgtaactctcttctcctccctagtgcgaggttaaaaccttcagccccacgtgctgtttgcaaacctgcctgtacctgaggccctaaaaagccagagacctcactcccggggagccagcatgtccactgcggtcctggaaaacccaggcttgggcaggaaactctctgactttggacaggaaacaagctatattgaagacaactgcaatcaaaatggtgccatatcactgatcttctcactcaaagaagaagttggtgcattggccaaagtattgcgcttatttgaggagaatgatgtaaacctgacccacattgaatctagaccttctcgtttaaagaaagatgagtatgaatttttcacccatttggataaacgtagcctgcctgctctgacaaacatcatcaagatcttgaggcatgacattggtgccactgtccatgagctttcacgagataagaagaaagacacagtgccctggttcccaagaaccattcaagagctggacagatttgccaatcagattctcagctatggagcggaactggatgctgaccaccctggttttaaagatcctgtgtaccgtgcaagacggaagcagtttgctgacattgcctacaactaccgccatgggcagcccatccctcgagtggaatacatggaggaagaaaagaaaacatggggcacagtgttcaagactctgaagtccttgtataaaacccatgcttgctatgagtacaatcacatttttccacttcttgaaaagtactgtggcttccatgaagataacattccccagctggaagacgtttctcaattcctgcagacttgcactggtttccgcctccgacctgtggctggcctgctttcctctcgggatttcttgggtggcctggccttccgagtcttccactgcacacagtacatcagacatggatccaagcccatgtatacccccgaacctgacatctgccatgagctgttgggacatgtgcccttgttttcagatcgcagctttgcccagttttcccaggaaattggccttgcctctctgggtgcacctgatgaatacattgaaaagctcgccacaatttactggtttactgtggagtttgggctctgcaaacaaggagactccataaaggcatatggtgctgggctcctgtcatcctttggtgaattacagtactgcttatcagagaagccaaagcttctccccctggagctggagaagacagccatccaaaattacactgtcacggagttccagcccctgtattacgtggcagagagttttaatgatgccaaggagaaagtaaggaactttgctgccacaatacctcggcccttctcagttcgctacgacccatacacccaaaggattgaggtcttggacaatacccagcagcttaagattttggctgattccattaacagtgaaattggaatcctttgcagtgccctccagaaaataaagtaaagccatggacagaatgtggtctgtcagctgtgaatctgttgatggagatccaactatttctttcatcagaaaaagtccgaaaagcaaaccttaatttgaaataacagccttaaatcctttacaagatggagaaacaacaaataagtcaaaataatctgaaatgacaggatatgagtacatactcaagagcataatggtaaatcttttggggtcatctttgatttagagatgataatcccatactctcaattgagttaaatcagtaatctgtcgcatttcatcaagattaattaaaatttgggacctgcttcattcaagcttcatatatgctttgcagagaactcataaaggagcatataaggctaaatgtaaaacacaagactgtcattagaattgaattattgggcttaatataaatcgtaacctatgaagtttattttctattttagttaactatgattccaattactactttgttattgtacctaagtaaattttctttaggtcagaagcccattaaaatagttacaagcattgaacttctttagtattatattaatataaaaacatttttgtatgttttattgtaatcataaatactgctgtataaggtaataaaactctgcacctaatccccataacttccagtatcattttccaattaattatcaagtctgttttgggaaacactttgaggacatttatgatgcagcagatgttgactaaaggcttggttggtagatattcaggaaatgttcactgaataaataagtaaatacattattgaaaagcaaatctgtataaatgtgaaatttttatttgtattagtaataaaacattagtagttta

SEQ ID NO: 55921 - DNA, 2525 bp, Homo sapiens
ccgaagtgcattatttcacaatctaaagcttgtatatataatggtagtttgtaaagtgtaccttccccacaggacgctgtgggatgtaaatttgtaggtcgagtttacagctggtttttcttgactgaagctcattcaactggttacttctttgtgggtgtctttaatgaagcttataaatggcaaaaagcaaacattcccatggtttggcatggacatcggtggaacgctggttaaattggtgtatttcgagccgaaggatattacagccgaagaggagcaagaggaagtggagaacctgaagagcatccggaagtatttgacttctaatactgcttatgggaaaactgggatccgagacgtccacctggaactgaaaaacctgaccatgtgtggacgcaaagggaacctgcacttcatccgctttcccagctgtgctatgcacaggttcattcagatgggcagcgagaagaacttctctagccttcacaccaccctctgtgccacaggaggcggggctttcaaattcgaagaggacttcagaatgattgctgacctgcagctgcataaactggatgaactggactgtctgattcagggcctgctttatgtcgactctgttggcttcaacggcaagccagaatgttactattttgaaaatcccacaaatcctgaattgtgtcaaaaaaagccgtactgccttgataacccataccctatgttgctggttaacatgggctcaggtgtcagcattctagccgtgtactccaaggacaactataaaagagttacagggaccagctttggcaacatgatgagtaaagaaaagcgagattccatcagcaaggaagacctcgcccgggccacattggtcaccatcaccaacaacattggctccattgctcggatgtgcgcgttgaatgagaacatagacagagttgtgtttgttggaaattttctcagaatcaatatggtctccatgaagctgctggcatatgccatggatttttggtccaaaggacaactgaaagctctgtttttggaacatgagggttattttggagccgttggggcactgttggaactgttcaaaatgactgatgacaagtagagacgagcagtggaggaaacagcctcccaaaaggacagagaactaaaaaattgctgctggagaaggtgaaagtcgctttgggacggaagccaagccattatggcagatgaacctgctggatttgtaaataatttaaaatccttccagatgatcttttactcttaggttttgagctaatgattcaaaacgggggaatataaaaggttttttttctgtatactgtatttttttaaaaaaatggtgcagcgtggccaaacctaccaattgtatgcattaactttgaaaagttgtttgatgtttaagaaggacctgatatgtaagcgctggtcatttttcttctggggtttactgatcagtgtggtgattttaacttcatttagtaattactctaggagattttaccttgacttatatttttcatgacgtttcatgatttgctgttggtttcaaatgaaactacaaatctggcatgttttactgtgaacacttttgttatttgttttgtacccttttttgtcttgtttttctgttttagttgtcttctgaaaaaagagtcgttccctctgtttctgtcctcagatgatgtccctccccctacctgtaacctttctttgacataattgttcatatcaatgaaggtgctgaccagctcaatacaaagttaagcacaagatctaaagctcttgaaaatgcccgtgaagagaagactgaatgtgttaatgaatttaatgagtctggcaaaagttgcaaattatatgcaagtttgtcctatcgcttataaatgtagtgtttcattggatttattttatgctaggttatattaagttgaaatagtctgtgattaaatgtcctcatccatgcacagaatatgaatggcagcaaatctttgtgcaagaaatttgaaacttattgggaaaagcctcccagtagattaattgttcatatcaggagatttagggtaagtcatgggttgaggtgtcagatagtaatatctatttgttttgtacatgtatatatctaggaactttgtaacaacacatctttaataatgttaaaggttttttcatttttaatattttaaactaaaaactgtacttcaatctcagtttctaaaattaaaaataatttatactgatctatatattttttctttttgaaagatttcattaagactgatgggtaactttcaaatgagggtcatgtacaaatattgggatgcatgagatcccatgatcttgtgtattgagcttattgttgaaagggatttttgaaggacagaacaattactccatgatgaatcttcctttctctgccttctgagcaccgtctttaatttccatatcttcaagtcttgaagaagttgatgttaattgaagaattcacttgtctggttgaaataaagcctgtttctgtt

SEQ ID NO: 55922 - DNA, 3367 bp, Homo sapiens
cctgacacctctgcaaataattgtcttcctcccgtattcctcctgaaacggttcgctcctttcgctgtctctcccagacccatctggttttcacatcgccatacaaagcccaacccgcccatctcctctctgcaagcccagagaacttgattccccatgttgaaactcgtcggtggcggtggcgggcaggactgggcatgctcagtggcggggaccagtctgggaggcgaggaagccgcgtttgaagtcgcgcggcctggggatcaggggaaggcgggcggcgggagccccggctgggggtgcgcggggatccccgattccgcgcccggggctggcgtgctccaggccggcgccgtggggccggcgcgcggggggcagggcgcagaggaggtgggggagtcggcaggaggaggggaggagcgccgggttcgccatccccaggcgccggctctgcggctgctgaatcggaagccgcagggaggatccggggaaataaagacgccggagaatgacctccagcgaggccgcctgagccggggcccgcgcacagccccgccagcccccggcatgggcgaccgcagcgggcagcaggagcgctcggtcccgcactctccaggggcccccgtgggcaccagcgccgccgctgtgaacgggctgctgcacaacggcttccatccgccgccagtccagccgccgcacgtctgcagccggggtccagtgggcggcagcgacgcggcgccccagcgcctcccgctcctgccggagctgcagccgcagccactgctccctcagcatgactccccggccaagaaatgccggctgcggaggaggatggactcggggagaaagaacaggccgccattcccatggtttggcatggacatcggtggaacgctggttaaattggtgtatttcgagccgaaggatattacagccgaagaggagcaagaggaagtggagaacctgaagagcatccggaagtatttgacttctaatactgcttatgggaaaactgggatccgagacgtccacctggaactgaaaaacctgaccatgtgtggacgcaaagggaacctgcacttcatccgctttcccagctgtgctatgcacaggttcattcagatgggcagcgagaagaacttctctagccttcacaccaccctctgtgccacaggaggcggggctttcaaattcgaagaggacttcagaatgattgctgacctgcagctgcataaactggatgaactggactgtctgattcagggcctgctttatgtcgactctgttggcttcaacggcaagccagaatgttactattttgaaaatcccacaaatcctgaattgtgtcaaaaaaagccgtactgccttgataacccataccctatgttgctggttaacatgggctcaggtgtcagcattctagccgtgtactccaaggacaactataaaagagttacagggaccagtcttggaggtggaacattcctaggcctatgttgcttgctgactggttgtgagacctttgaagaagctctggaaatggcagctaaaggcgacagcaccaatgttgataaactggtgaaggacatttacggaggagactatgaacgatttggccttcaaggatctgctgtagcatcaagctttggcaacatgatgagtaaagaaaagcgagattccatcagcaaggaagacctcgcccgggccacattggtcaccatcaccaacaacattggctccattgctcggatgtgcgcgttgaatgagaacatagacagagttgtgtttgttggaaattttctcagaatcaatatggtctccatgaagctgctggcatatgccatggatttttggtccaaaggacaactgaaagctctgtttttggaacatgagggttattttggagccgttggggcactgttggaactgttcaaaatgactgatgacaagtagagacgagcagtggaggaaacagcctcccaaaaggacagagaactaaaaaattgctgctggagaaggtgaaagtcgctttgggacggaagccaagccattatggcagatgaacctgctggatttgtaaataatttaaaatccttccagatgatcttttactcttaggttttgagctaatgattcaaaacgggggaatataaaaggttttttttctgtatactgtatttttttaaaaaaatggtgcagcgtggccaaacctaccaattgtatgcattaactttgaaaagttgtttgatgtttaagaaggacctgatatgtaagcgctggtcatttttcttctggggtttactgatcagtgtggtgattttaacttcatttagtaattactctaggagattttaccttgacttatatttttcatgacgtttcatgatttgctgttggtttcaaatgaaactacaaatctggcatgttttactgtgaacacttttgttatttgttttgtacccttttttgtcttgtttttctgttttagttgtcttctgaaaaaagagtcgttccctctgtttctgtcctcagatgatgtccctccccctacctgtaacctttctttgacataattgttcatatcaatgaaggtgctgaccagctcaatacaaagttaagcacaagatctaaagctcttgaaaatgcccgtgaagagaagactgaatgtgttaatgaatttaatgagtctggcaaaagttgcaaattatatgcaagtttgtcctatcgcttataaatgtagtgtttcattggatttattttatgctaggttatattaagttgaaatagtctgtgattaaatgtcctcatccatgcacagaatatgaatggcagcaaatctttgtgcaagaaatttgaaacttattgggaaaagcctcccagtagattaattgttcatatcaggagatttagggtaagtcatgggttgaggtgtcagatagtaatatctatttgttttgtacatgtatatatctaggaactttgtaacaacacatctttaataatgttaaaggttttttcatttttaatattttaaactaaaaactgtacttcaatctcagtttctaaaattaaaaataatttatactgatctatatattttttctttttgaaagatttcattaagactgatgggtaactttcaaatgagggtcatgtacaaatattgggatgcatgagatcccatgatcttgtgtattgagcttattgttgaaagggatttttgaaggacagaacaattactccatgatgaatcttcctttctctgccttctgagcaccgtctttaatttccatatcttcaagtcttgaagaagttgatgttaattgaagaattcacttgtctggttgaaataaagcctgtttctgtt

SEQ ID NO: 55923 - DNA, 2702 bp, Homo sapiens
ccgaagtgcattatttcacaatctaaagcttgtatatataatggtagtttgtaaagtgtaccttccccacaggacgctgtgggatgtaaatttgtaggtcgagtttacagctggtttttcttgactgaagctcattcaactggttacttctttgtgggtgtctttaatgaagcttataaatggcaaaaagcaaacattcccatggtttggcatggacatcggtggaacgctggttaaattggtgtatttcgagccgaaggatattacagccgaagaggagcaagaggaagtggagaacctgaagagcatccggaagtatttgacttctaatactgcttatgggaaaactgggatccgagacgtccacctggaactgaaaaacctgaccatgtgtggacgcaaagggaacctgcacttcatccgctttcccagctgtgctatgcacaggttcattcagatgggcagcgagaagaacttctctagccttcacaccaccctctgtgccacaggaggcggggctttcaaattcgaagaggacttcagaatgattgctgacctgcagctgcataaactggatgaactggactgtctgattcagggcctgctttatgtcgactctgttggcttcaacggcaagccagaatgttactattttgaaaatcccacaaatcctgaattgtgtcaaaaaaagccgtactgccttgataacccataccctatgttgctggttaacatgggctcaggtgtcagcattctagccgtgtactccaaggacaactataaaagagttacagggaccagtcttggaggtggaacattcctaggcctatgttgcttgctgactggttgtgagacctttgaagaagctctggaaatggcagctaaaggcgacagcaccaatgttgataaactggtgaaggacatttacggaggagactatgaacgatttggccttcaaggatctgctgtagcatcaagctttggcaacatgatgagtaaagaaaagcgagattccatcagcaaggaagacctcgcccgggccacattggtcaccatcaccaacaacattggctccattgctcggatgtgcgcgttgaatgagaacatagacagagttgtgtttgttggaaattttctcagaatcaatatggtctccatgaagctgctggcatatgccatggatttttggtccaaaggacaactgaaagctctgtttttggaacatgagggttattttggagccgttggggcactgttggaactgttcaaaatgactgatgacaagtagagacgagcagtggaggaaacagcctcccaaaaggacagagaactaaaaaattgctgctggagaaggtgaaagtcgctttgggacggaagccaagccattatggcagatgaacctgctggatttgtaaataatttaaaatccttccagatgatcttttactcttaggttttgagctaatgattcaaaacgggggaatataaaaggttttttttctgtatactgtatttttttaaaaaaatggtgcagcgtggccaaacctaccaattgtatgcattaactttgaaaagttgtttgatgtttaagaaggacctgatatgtaagcgctggtcatttttcttctggggtttactgatcagtgtggtgattttaacttcatttagtaattactctaggagattttaccttgacttatatttttcatgacgtttcatgatttgctgttggtttcaaatgaaactacaaatctggcatgttttactgtgaacacttttgttatttgttttgtacccttttttgtcttgtttttctgttttagttgtcttctgaaaaaagagtcgttccctctgtttctgtcctcagatgatgtccctccccctacctgtaacctttctttgacataattgttcatatcaatgaaggtgctgaccagctcaatacaaagttaagcacaagatctaaagctcttgaaaatgcccgtgaagagaagactgaatgtgttaatgaatttaatgagtctggcaaaagttgcaaattatatgcaagtttgtcctatcgcttataaatgtagtgtttcattggatttattttatgctaggttatattaagttgaaatagtctgtgattaaatgtcctcatccatgcacagaatatgaatggcagcaaatctttgtgcaagaaatttgaaacttattgggaaaagcctcccagtagattaattgttcatatcaggagatttagggtaagtcatgggttgaggtgtcagatagtaatatctatttgttttgtacatgtatatatctaggaactttgtaacaacacatctttaataatgttaaaggttttttcatttttaatattttaaactaaaaactgtacttcaatctcagtttctaaaattaaaaataatttatactgatctatatattttttctttttgaaagatttcattaagactgatgggtaactttcaaatgagggtcatgtacaaatattgggatgcatgagatcccatgatcttgtgtattgagcttattgttgaaagggatttttgaaggacagaacaattactccatgatgaatcttcctttctctgccttctgagcaccgtctttaatttccatatcttcaagtcttgaagaagttgatgttaattgaagaattcacttgtctggttgaaataaagcctgtttctgtt

SEQ ID NO: 55924 - DNA, 2751 bp, Homo sapiens
attcgccgctggactttgacagtggtcaaaggctctgctcagttctctgtgcctgtctccctccagcactgccgaggttctctgccgaggccaaccagaaataccccttggaagctggaatcctgcaacaatggcccagggtgtcctctggatcctactcggattgctactgtggtcagacccagggacagcctccctgcccctgctcatggactctgtcatccaggccctggctgagctggagcagaaagtgccagctgccaagaccagacacacagcttctgcgtggctgatgtcagctccaaactctggcccccacaatcgcctctaccacttcctgctgggggcatggagcctcaatgctacagagttggatccctgcccactaagcccagagctgttaggcctgaccaaggaggtggcccgacatgacgtacgagaagggaaggaatatggggtggtgctggcacctgatggctcgaccgtggctgtggagcctctgctggcggggctggaggcagggctgcaagggcgcagggtcataaatttgcccttggacagcatggctgccccttgggagactggagatacctttccagatgttgtggccattgctccagatgtaagagccacctcctccccaggactcagggatggctctccagatgtcaccactgcagatattggagccaacactccagatgctacaaaaggctgtccagatgtccaagcttccttgccagatgccaaagccaagtccccaccgaccatggtggacagcctcctggcagtcaccctggctggaaacctgggcctgaccttcctccgaggttcccagacccagagccatccagacctgggaactgagggctgctgggaccagctctctgcccctcggacctttacgcttttggaccccaaggcatctctgttaaccatggccttcctcaatggcgccctggatggggtcatccttggagactacctgagccggactcctgagccccggccatccctcagccacttgctgagccagtactatggggctggggtggccagagacccagggttccgcagcaacttccgacggcagaacggtgctgctctgacttcagcctccatcctggcccagcaggtgtggggaacccttgtccttctacagaggctggagccagtacacctccagcttcagtgcatgagccaagaacagctggcccaggtggctgccaatgctaccaaggaattcactgaggccttcctgggatgcccggccatccacccccgctgccgctggggagcggcgccttatcggggccgcccgaagctgctgcagctgccgctgggattcttgtacgtgcatcacacctacgtgcctgcaccaccctgcacggacttcacgcgctgcgcagccaacatgcgctccatgcagcgctaccaccaggacacgcaaggctggggagacatcggctacggtttcgtggtgggctcggacggctacgtgtacgagggacgcggctggcactgggtgggcgcccacacgctcggccacaactcccggggcttcggcgtggccatagtgggcaactacaccgcggcgctgcccaccgaggccgctctgcgcacggtgcgcgacacgctcccgagttgtgcggtgcgcgccggcctcctgcggccagactacgcgctgctgggccaccgccagctggtgcgcaccgactgccccggcgacgcgctcttcgacctgctgcgcacctggccgcacttcaccgcggtgagtcttcgcagcctgcactacacggcccgccgcccctccgtctacacaagctccacgaggcccctgccccctgcctgtaacagctgtgcccgcacagcctcagccaggcccccaacttcccggcggcacgtctattcaggaaacctaggcccagcctttgcgggtcactctgcgggcaacatccctgatcctgtgacttctgcctatgcagcctcagctcagccccagacccagccagcctgtcctttccccagctcctaatacctctacctttccagccaaggcatggaccctgacacctgccaacagcccctctgccctcacaacctcagcctggccttcatgacttctctacccaagtcacaacctgtcaggctgcaccacctcatcctggcccgccgaaccttgacctcacccctgcccctacccgaaggccctctgtccacacaacatgaacctaggctgtgaccttttgccttcacaacctctgtccagtccttaatcctgtgttgcaattctctgtccagacaatctcaactctgaggttgcttgtttcgtccctgactccttaacccctgatgacaactcttatgccagcacaactttgacctgatgacctcatcccagcccttgatcgccatcactaaaacaattttagaatcacacctggacaatctcgtgctacctacatactgccactccatttcattaagctattgactagcacatccatctcggcctatagttggctttgtcctcactctctcactttgggccactgtcccctccctgatccagggttccaccaccaggagggcagacccagccacataccacaaccacccccaagcctcacactcccttgtctttttccagactgttaagccaagacctgccaggagtgtctctaagagatccaggagggagccacccccaaggaccctgccagccacagacctccaataaagacagcatgg

SEQ ID NO: 55925 - DNA, 3130 bp, Homo sapiens
gatccactagtaacggccgccagtgtggtggaattcaagggactcacacactgaaagaatatctttgatgaagacaattcaggcaagcagaatgattcttgcaacagaattacatgattaattgagatcttgaagtgggtccggtgaatcctggccacctaacttatcatgatttgggggagtttcacgagaatccagttttgataaaacaattgtttttttcctccccaagtgactatacatttaaatagctaaaacatctgttcagcaacatagtaaaacatatatactcggaacgcttgagagaagagcctgccaaacagggactttgctgagggagagcaccaagataaagcaacactgtttgttttgtctagtcaggggggaaagccaaggcaaccaatattttggtttttataattttcatttgtgaagaattatttgagaaagggttggcgaggggagatttcctgacggcagtttcttaagctgtccattagtagaagagcaagagagccttggatgtcaacgcctcgctcttgagaccagccaccaaaccacgaaaagtgactttcttctcgtgtgctctctacggcccttctgatggaagcagaaacagggagcagcgtggagactggaaagaaggccaacagaggcactcgaattgccctggtcgtgtttgtcggtggcaccctagttctgggcacgatcctctttctagtgagtcaaggtctcttaagtctccaagctaaacaggagtactgcctgaagccagaatgcatcgaagcggctgctgccatcttaagtaaagtaaatctgtctgtggatccttgtgataatttcttccggttcgcttgtgatggctggataagcaataatccaattcccgaagatatgccaagctatggggtttatccttggctgagacataatgttgacctcaagttgaaggaacttttggagaaatcaatcagtagaaggcgggacaccgaagccatacagaaagccaaaatcctttattcatcctgcatgaatgagaaagcgattgaaaaagcagatgccaagccactgctacacatcctacggcattcacctttccgctggcccgtgcttgaatctaatattggccctgaaggggtttggtcagagagaaagttcagccttctgcagacacttgcaacgtttcgtggtcaatacagcaattctgtgttcatccgtttgtatgtgtcccctgatgacaaagcatccaatgaacatatcttgaagctggaccaagcaacactctccctggccgtgagggaagactaccttgataacagtacagaagccaagtcttatcgggatgccctttacaagttcatggtggatactgccgtgcttttaggagctaacagttccagagcagagcatgacatgaagtcagtgctcagattggaaattaagatagctgagataatgattccacatgaaaaccgaaccagcgaggccatgtacaacaaaatgaacatttctgaactgagtgctatgattccccagttcgactggctgggctacatcaagaaggtcattgacaccagactctacccccatctgaaagacatcagcccctccgagaatgtggtggtccgcgtcccgcagtactttaaagatttgtttaggatattagggtctgagagaaagaagaccattgccaactatttggtgtggagaatggtttattccagaattccaaaccttagcaggcgctttcagtatagatggctggaattctcaagggtaatccaggggaccacaactttgctgcctcaatgggacaaatgtgtaaactttattgaaagtgccctcccttatgttgttggaaagatgtttgtagatgtgtacttccaggaagataagaaggaaatgatggaggaattggttgagggcgttcgctgggcctttattgacatgctagagaaagaaaatgagtggatggatgcaggaacgaaaaggaaagccaaagaaaaggcgagagctgttttggcaaaagttggctatccagagtttataatgaatgatactcatgttaatgaagacctcaaagctatcaagttttcagaagccgactactttggcaacgtcctacaaactcgcaagtatttagcacagtctgatttcttctggctaagaaaagccgttccaaaaacagagtggtttacaaatccgacgactgtcaatgccttctacagtgcatccaccaaccagatccgatttccagcaggagagctccagaagcctttcttttggggaacagaatatcctcgatctctgagttatggtgctataggagtaattgtcggacatgaatttacacatggatttgataataatggtagaaaatatgataaaaatggaaacctggatccttggtggtctactgaatcagaagaaaagtttaaggaaaaaacaaaatgcatgattaaccagtatagcaactattattggaagaaagctggcttaaatgtcaaggggaagaggaccctgggagaaaatattgctgataatggaggcctgcgggaagcttttagggcttacaggaaatggataaatgacagaaggcagggacttgaggagcctcttctaccaggcatcacattcaccaacaaccagctcttcttcctgagttatgctcatgtgaggtgcaattcctacagaccagaagctgcccgagaacaagtccaaattggtgctcacagtccccctcagtttagggtcaatggtgcaattagtaactctgaagaattccagaaagcttttaactgtccacccaattccacgatgaacagaggcatggactcctgccgactctggtagctgggacgctggtttatggcatcctgagacagttgcacagtgccagcggaggctgcactgagccttcatcgcccattgctttaggcctggaggagctttcatttttagtgcattttcattatttgggtaggtgacctgcttggatctagacagcatctgttcaaagttgtagggcttataaagtggaatataagaagaactaagtatgtttctttagaaaatcaaaccaacaaaaataaatccctaggctacttttgttaaaaaaaaaaaaaaaaaa

SEQ ID NO: 55926 - DNA, 2483 bp, Homo sapiens
gcagccccaggcccacactgaaagcatgtcgatccaggagaacatatcatccctgcagcttcggtcatgggtctctaagtcccaaagagacttagcaaagtccatcctgattggggctccaggagggccagcggggtatctgcggcgggccagtgtggcccaactgacccaggagctgggcactgccttcttccagcagcagcagctgccagctgctatggcagacaccttcctggaacacctctgcctactggacattgactccgagcccgtggctgctcgcagtaccagcatcattgccaccatcgggccagcatctcgctccgtggagcgcctcaaggagatgatcaaggccgggatgaacattgcgcgactcaacttctcccacggctcccacgagtaccatgctgagtccatcgccaacgtccgggaggcggtggagagctttgcaggttccccactcagctaccggcccgtggccatcgccctggacaccaagggaccggagatccgcactgggatcctgcaggggggtccagagtcggaagtggagctggtgaagggctcccaggtgctggtgactgtggaccccgcgttccggacgcgggggaacgcgaacaccgtgtgggtggactaccccaatattgtccgggtcgtgccggtggggggccgcatctacattgacgacgggctcatctccctagtggtccagaaaatcggcccagagggactggtgacccaagtggagaacggcggcgtcctgggcagccggaagggcgtgaacttgccaggggcccaggtggacttgcccgggctgtccgagcaggacgtccgagacctgcgcttcggggtggagcatggggtggacatcgtctttgcctcctttgtgcggaaagccagcgacgtggctgccgtcagggctgctctgggtccggaaggacacggcatcaagatcatcagcaaaattgagaaccacgaaggcgtgaagaggtttgatgaaatcctggaggtgagcgacggcatcatggtggcacggggggacctaggcatcgagatcccagcagagaaggttttcctggctcagaagatgatgattgggcgctgcaacttggcgggcaagcctgttgtctgtgccacacagatgctggagagcatgattaccaagccccggccaacgagggcagagacaagcgatgtcgccaatgctgtgctggatggggctgactgcatcatgctgtcaggggagactgccaagggcaacttccctgtggaagcggtgaagatgcagcatgcgattgcccgggaggcagaggccgcagtgtaccaccggcagctgtttgaggagctacgtcgggcagcgccactaagccgtgatcccactgaggtcaccgccattggtgctgtggaggctgccttcaagtgctgtgctgctgccatcattgtgctgaccacaactggccgctcagcccagcttctgtctcggtaccgacctcgggcagcagtcattgctgtcacccgctctgcccaggctgcccgccaggtccacttatgccgaggagtcttccccttgctttaccgtgaacctccagaagccatctgggcagatgatgtagatcgccgggtgcaatttggcattgaaagtggaaagctccgtggcttcctccgtgttggagacctggtgattgtggtgacaggctggcgacctggctccggctacaccaacatcatgcgggtgctaagcatatcctgagacgcccctccctcctctggcccagcctacccttgtaccccatcccttcctccccagtctacgttctccagcccacacccctccaaagccccacctttaagtcctctcttctctattcctgaccctccctacctgaggcctatctgagactataactgtcatctagccccttcgaggttgccccttccccatctccatttcacacaggtcctgaaagtctgtgtccaattatgcactggccacccaacagcaccaattgtacattccctgcatccaatctgctcagcaggccctaagatgccttgagtctttaatcccagtttggctggttaattccataaccccaggcatcccatcccttggggtgggggagaggggagacagggcaatcttgtccacagtctcccattctcatatgtagccctcatgataatctgggcatctcgtgccagggcaggctaccccttcatggtgactaacagttacatgaaagtccacgcttttgggaaaactgggtgggatggatgctggggagaagtgagggctgggcagctgattttgtcactgtcttcacaacctccgtgctgggcttgtagaccactgtcctggctgctctcatgcctgcctgataccctgcttggtcaaatccccggctgcttccttctgcacccagaaattccttcccactcatgttgttcccacacacaaaccaagagccaaaaatgagtgtgtc

SEQ ID NO: 55927 - DNA, 2433 bp, Homo sapiens
tgcctctgacaacccaacagtgtggagcagacccacagagagggagacccagagaggtgtgcagtggcatggaagggccagcggggtatctgcggcgggccagtgtggcccaactgacccaggagctgggcactgccttcttccagcagcagcagctgccagctgctatggcagacaccttcctggaacacctctgcctactggacattgactccgagcccgtggctgctcgcagtaccagcatcattgccaccatcgggccagcatctcgctccgtggagcgcctcaaggagatgatcaaggccgggatgaacattgcgcgactcaacttctcccacggctcccacgagtaccatgctgagtccatcgccaacgtccgggaggcggtggagagctttgcaggttccccactcagctaccggcccgtggccatcgccctggacaccaagggaccggagatccgcactgggatcctgcaggggggtccagagtcggaagtggagctggtgaagggctcccaggtgctggtgactgtggaccccgcgttccggacgcgggggaacgcgaacaccgtgtgggtggactaccccaatattgtccgggtcgtgccggtggggggccgcatctacattgacgacgggctcatctccctagtggtccagaaaatcggcccagagggactggtgacccaagtggagaacggcggcgtcctgggcagccggaagggcgtgaacttgccaggggcccaggtggacttgcccgggctgtccgagcaggacgtccgagacctgcgcttcggggtggagcatggggtggacatcgtctttgcctcctttgtgcggaaagccagcgacgtggctgccgtcagggctgctctgggtccggaaggacacggcatcaagatcatcagcaaaattgagaaccacgaaggcgtgaagaggtttgatgaaatcctggaggtgagcgacggcatcatggtggcacggggggacctaggcatcgagatcccagcagagaaggttttcctggctcagaagatgatgattgggcgctgcaacttggcgggcaagcctgttgtctgtgccacacagatgctggagagcatgattaccaagccccggccaacgagggcagagacaagcgatgtcgccaatgctgtgctggatggggctgactgcatcatgctgtcaggggagactgccaagggcaacttccctgtggaagcggtgaagatgcagcatgcgattgcccgggaggcagaggccgcagtgtaccaccggcagctgtttgaggagctacgtcgggcagcgccactaagccgtgatcccactgaggtcaccgccattggtgctgtggaggctgccttcaagtgctgtgctgctgccatcattgtgctgaccacaactggccgctcagcccagcttctgtctcggtaccgacctcgggcagcagtcattgctgtcacccgctctgcccaggctgcccgccaggtccacttatgccgaggagtcttccccttgctttaccgtgaacctccagaagccatctgggcagatgatgtagatcgccgggtgcaatttggcattgaaagtggaaagctccgtggcttcctccgtgttggagacctggtgattgtggtgacaggctggcgacctggctccggctacaccaacatcatgcgggtgctaagcatatcctgagacgcccctccctcctctggcccagcctacccttgtaccccatcccttcctccccagtctacgttctccagcccacacccctccaaagccccacctttaagtcctctcttctctattcctgaccctccctacctgaggcctatctgagactataactgtcatctagccccttcgaggttgccccttccccatctccatttcacacaggtcctgaaagtctgtgtccaattatgcactggccacccaacagcaccaattgtacattccctgcatccaatctgctcagcaggccctaagatgccttgagtctttaatcccagtttggctggttaattccataaccccaggcatcccatcccttggggtgggggagaggggagacagggcaatcttgtccacagtctcccattctcatatgtagccctcatgataatctgggcatctcgtgccagggcaggctaccccttcatggtgactaacagttacatgaaagtccacgcttttgggaaaactgggtgggatggatgctggggagaagtgagggctgggcagctgattttgtcactgtcttcacaacctccgtgctgggcttgtagaccactgtcctggctgctctcatgcctgcctgataccctgcttggtcaaatccccggctgcttccttctgcacccagaaattccttcccactcatgttgttcccacacacaaaccaagagccaaaaatgagtgtgtc

SEQ ID NO: 55928 - DNA, 1839 bp, Homo sapiens
gagactgcagagggagtagtgcgatcctgcgcgcgggggaactagctggagggcaaggcgggaacaccatctattgttggggtgatcggacctaacaccaggttgtggggacaacgaagtccagaagagtgaaaggaatgagaaaagacagtttgagagagaaagtgggcccagggggccaatgcgagtatggaggctgtgaaggccccgagccctggaagcccagactatttattggtgatcaaacaaagaaacaggtggggaatattgtcctattatgattctcctgaagatgcctggaaaggttgcaaagggagcatacaaatggcagtctgtgaaattgaagttcattctgtagataatacatgcatggacctgataatccccggggaacagtatttctacctgaaggccagaagtgtgcctgaaagatagcggcggctggtggccctgggatcagccaaggcttgcctgactgacagtaggacccagaaggataaagagtttgctgaaaacactgaaaacttgaaaaccaaaatgtcagaactaagactctgctgtgacctccttgttcagcaagtagataaaacaaaagaagtgaccacaactggtgtgtccaattctgaggagggaattgatgtgggaactttgctgaaatcaacctgtaatacttttctgaagaccttggaagaatgcatgcagattgcaaatgcagccttcacctctgagctgctctaccacactccaccaggatcaccacagctggccatgctcaagtccagcaagatgaaacatcctattataccaattcataattcattggaaaggcaaacggagttgagcacttgtgaaaatggatctttaaatatggaaataaatggtgaggaagaaatcctaatgaaaaataagaattccttatatttgaaatctgcagagatagactgcagcatatcaagtgaggaaaatacagatgataatataaccgtccaaggtgaaataatgaaggaagatagaatggaaaacctgaaaaatcatgacaataacttgtctcagtctggatcagactcaagttgctctccagaatgcctctgggaggaaggcaaagaagttatcccaactttctttagtaccatgaacacaagctttagtgacattgaacttctggaagacagtggcattcccacagaagcattcttggcatcatgttgtgctgtggttccagtattagacaaacttggccctacagtgtttgctcctgttaagatggatcttgttgaaaatattaagaaagtaaatcagaagtatataaccaacaaagaagagtttaccactctccagaagatagtgctgcacgaagtggaggcggatgtagcccaggttaggaactcagcgactgaagccctcttgtggctgaagagaggtctcaaatttttgaagggatttttgacagaagtgaaaaatggggaaaaggatatccagacagccctgaataacgcatatggtaaaacattgcggcaacaccatggctgggtagttcgaggggtttttgcgttagctttaagggcaactccatcctatgaagattttgtggccgcgttaaccgtaaaggaaggtgaccaccggaaagaagctttcagtattgggatgcagagggacctcagcctttacctccctgccatgaagaagcagatggccatactggacgctttataagaggtccatgggctggaatctgatgaggttgtatgatggctgctgggcagcacctcctaacttcagggaataaagtgctaaagtgtaaaaaaaaataaaaataaaaataaataaataaataaaatt

SEQ ID NO: 55929 - DNA, 2732 bp, Homo sapiens
aacaacatcctgggattgggacccactttctgggcactgctggccagtcccaaaatggaacataaggaagtggttcttctacttcttttatttctgaaatcaggtcaaggagagcctctggatgactatgtgaatacccagggggcttcactgttcagtgtcactaagaagcagctgggagcaggaagtatagaagaatgtgcagcaaaatgtgaggaggacgaagaattcacctgcagggcattccaatatcacagtaaagagcaacaatgtgtgataatggctgaaaacaggaagtcctccataatcattaggatgagagatgtagttttatttgaaaagaaagtgtatctctcagagtgcaagactgggaatggaaagaactacagagggacgatgtccaaaacaaaaaatggcatcacctgtcaaaaatggagttccacttctccccacagacctagattctcacctgctacacacccctcagagggactggaggagaactactgcaggaatccagacaacgatccgcaggggccctggtgctatactactgatccagaaaagagatatgactactgcgacattcttgagtgtgaagaggaatgtatgcattgcagtggagaaaactatgacggcaaaatttccaagaccatgtctggactggaatgccaggcctgggactctcagagcccacacgctcatggatacattccttccaaatttccaaacaagaacctgaagaagaattactgtcgtaaccccgatagggagctgcggccttggtgtttcaccaccgaccccaacaagcgctgggaactttgcgacatcccccgctgcacaacacctccaccatcttctggtcccacctaccagtgtctgaagggaacaggtgaaaactatcgcgggaatgtggctgttaccgtttccgggcacacctgtcagcactggagtgcacagacccctcacacacataacaggacaccagaaaacttcccctgcaaaaatttggatgaaaactactgccgcaatcctgacggaaaaagggccccatggtgccatacaaccaacagccaagtgcggtgggagtactgtaagataccgtcctgtgactcctccccagtatccacggaacaattggctcccacagcaccacctgagctaacccctgtggtccaggactgctaccatggtgatggacagagctaccgaggcacatcctccaccaccaccacaggaaagaagtgtcagtcttggtcatctatgacaccacaccggcaccagaagaccccagaaaactacccaaatgctggcctgacaatgaactactgcaggaatccagatgccgataaaggcccctggtgttttaccacagaccccagcgtcaggtgggagtactgcaacctgaaaaaatgctcaggaacagaagcgagtgttgtagcacctccgcctgttgtcctgcttccagatgtagagactccttccgaagaagactgtatgtttgggaatgggaaaggataccgaggcaagagggcgaccactgttactgggacgccatgccaggactgggctgcccaggagccccatagacacagcattttcactccagagacaaatccacgggcgggtctggaaaaaaattactgccgtaaccctgatggtgatgtaggtggtccctggtgctacacgacaaatccaagaaaactttacgactactgtgatgtccctcagtgtgcggccccttcatttgattgtgggaagcctcaagtggagccgaagaaatgtcctggaagggttgtgggggggtgtgtggcccacccacattcctggccctggcaagtcagtcttagaacaaggtttggaatgcacttctgtggaggcaccttgatatccccagagtgggtgttgactgctgcccactgcttggagaagtccccaaggccttcatcctacaaggtcatcctgggtgcacaccaagaagtgaatctcgaaccgcatgttcaggaaatagaagtgtctaggctgttcttggagcccacacgaaaagatattgccttgctaaagctaagcagtcctgccgtcatcactgacaaagtaatcccagcttgtctgccatccccaaattatgtggtcgctgaccggaccgaatgtttcatcactggctggggagaaacccaaggtacttttggagctggccttctcaaggaagcccagctccctgtgattgagaataaagtgtgcaatcgctatgagtttctgaatggaagagtccaatccaccgaactctgtgctgggcatttggccggaggcactgacagttgccagggtgacagtggaggtcctctggtttgcttcgagaaggacaaatacattttacaaggagtcacttcttggggtcttggctgtgcacgccccaataagcctggtgtctatgttcgtgtttcaaggtttgttacttggattgagggagtgatgagaaataattaattggacgggagacagagtgacgcactgactcacctagaggctgggacgtgggtagggatttagcatgctggaaataactggcagtaatcaaacgaagacactgtccccagctaccagctacgccaaacctcggcattttttgtgttattttctgactgctggattctgtagtaaggtgacatagctatgacatttgttaaaaataaactctgtacttaactttgatttgagtaaattttggtttt

SEQ ID NO: 55930 - DNA, 1360 bp, Homo sapiens
gtcaacaacatcctgggactgggacacactttctgggcactgctggccagtcccaaaatggaacataaggaagtggttcttctacttcttttatttctgaaatcaggtcaaggagagcctctggatgactatgtaaatgcccagggggcttcactgttcagtgtcactaagaagcagctgggggcaggaagcagagaagaatgtgcagcaaaatgtgaggaggacaaagaattcacctgcagggcattccaatatcacagtaaagagcaacaatgtgtgataatggctgaaaacaagaagtcctccataatcattaggatgagagatgtagttttatttgaaaagtaaatgtatctttcagagtgcaagactgggaatggaaagaactacagagggacgatgtccaaaacaaaaaatggcatcacctgtcaaaaatggagttccacttctccccgcagacctagattctcacctgctacacacccctcagagggactggaggaatccagacaacgatgcgcaggggccctggtgttatactactgatccagaacagagatatgactactgcgacattcctgagtgtgaagggcaggagtggctctagaaaatgttttcatttctgctcttcacctgtaaaataatttgttgtaaagccccttcccacagggatattattaataattgcgtaacgtgttcacctctcggaaaggagcaaaactttgctcagatcccagaattaacctgatttttttttttttttctgagacagaattttgctctcattgcccaggctagagtgcaatggtgcgatctcggctcaccacaacctccgcctccgggttcaagcgattctcctacctcagcctcccaagtagctggaattacatgcatgtgccaccatgcctggctaattttacatttttagtagagacagggtttctccatgttggtcaggctggtcttgaactctcgacctcaggtgagccgcccgcctcagcctcccaaagtgctgggattacaggcgtgagccaccatgcccagcagacctgaattattattattattaaaatgttacatcaacatgtacaaatataaaactacatctaaactctaagtacaaacttcttatgcttaaaactcttacacagtgttaaccccaagacagatttgcaattaagtagttaaaataaaacaacaaagtcaataaaaatcaaataaacaatatacatttaatgtggtagactttgctgttttgctgaagctaagcaaggaaccagtttttaaatcagcaatccgttattttaatggactgagcaatttaatagtgcacctcaaaggtcaatgctaaaaactaaaa

SEQ ID NO: 55931 - DNA, 1535 bp, Homo sapiens
ggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcaaacctaggtcagacttttcctttcatctttgtgttcatctactgtaaagtgtccgtctgtgtctgtgagggattggttccaggacccctgtggctaccaaaatccatgcttctcaagtcccttatgtaaaatggtgcagtatttgcatataacctacataccttctcttgtgcaatccctaatataatgtaaatgctatgtaatcgttgttatactgtattgtttttatttgtattatgttttattgtcatattgttattttctctcatctttttcaagtcttttccatccacagttggttgaatttgtggatgtggaacccatggatacagagggccaactgtatttaggataatttcatcacttttaattcaaaccagaatatgtgaataagcagacagaaagaatctttttgatgtcgatgttcaactatttttggcaccatagtagaacatggttgctttctattttttcttgggtatggaggtttcttgaagacctagaacatagaagaatgcctagttaaaaaaaaaaatcaatgaaactacgagttttaggccaaatctgagaaaagaccaaagatgactatgtttgggactgaagtaaacatatcaagttagaactctcatcacatgtttgactcaaattgtggagcaaaatagtaaataaaatataaaaatgaaaatgaagatacgtgaaattcaaatgtcacaacttgcctattatttattttagtgcatttttttgtgcttttcccagtttggtgttaggtggccttaagttctcagtaatgacacttatcaaataggaacttagtgttactcacctttatccattcccccaacactcaacaaattgcctttgctatatccctatgagatgagcagatcaaatattccccgtgagttaatgaaaactgattcaaccaaatggcgaagtcagagactatcgggggccatggagacactctgggccatttttatgaggtagtctaggctcatcttcatgagggaactgaggtcttggggggtgggggttacccaaataggttcacagaagaaccagaaataaaacctgcctttctagactgtaa

SEQ ID NO: 55932 - DNA, 1564 bp, Homo sapiens
tctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcagacctaggtcagacttttcctttcatctttgtgttcatctactgtaaagtgtccgtctgtgtctgtgagggattggttccaggacccctgtggctaccaaaatccatgcttctcaagtcccttatgtaaaatggtgcagtatttgcatataacctacataccttctcttgtgcaatccctaatataatgtaaatgctatgtaatcgttgttatactgtattgtttttatttgtattatgttttattgtcatattgttattttctctcatctttttcaagtcttttccatccacagttggttgaatttgtggatgtggaacccatggatacagagggccaactgtatttaggataatttcatcacttttaattcaaaccagaatatgtgaataagcagacagaaagaatctttttgatgtcgatgttcaactatttttggcaccatagtagaacatggttgctttctattttttcttgggtatggaggtttcttgaagacctagaacatagaagaatgcctagttaaaaaaaaaaatcaatgaaactacgagttttaggccaaatctgagaaaagaccaaagatgactatgtttgggactgaagtaaacatatcaagttagaactctcatcacatgtttgactcaaattgtggagcaaaatagtaaataaaatataaaaatgaaaatgaagatacgtgaaattcaaatgtcacaacttgcctattatttattttagtgcatttttttgtgcttttcccagtttggtgttaggtggccttaagttctcagtaatgacacttatcaaataggaacttagtgttactcacctttatccattcccccaacactcaacaaattgcctttgctatatccctatgagatgagcagatcaaatattccccgtgagttaatgaaaactgattcaaccaaatggcgaagtcagagactatcgggggccatggagacactctgggccatttttatgaggtagtctaggctcatcttcatgagggaactgaggtcttggggggtgggggttacccaaataggttcacagaagaaccagaaataaaacctgcctttctagactgtaaaaaa

SEQ ID NO: 55933 - DNA, 2395 bp, Homo sapiens
agagcctcctagcccgtcggtgtctgcgcccatcgatccctttgtctatccccgaccatggcgaagctgattgcgctcaccctcttggggatgggactggcactcttcaggaaccaccagtcttcttaccaaacacgacttaatgctctccgagaggtacaacccgtagaacttcctaactgtaatttagttaaaggaatcgaaactggctctgaagacttggagatactgcctaatggactggctttcattagctctggattaaagtatcctggaataaagagcttcaaccccaacagtcctggaaaaatacttctgatggacctgaatgaagaagatccaacagtgttggaattggggatcactggaagtaaatttgatgtatcttcatttaaccctcatgggattagcacattcacagatgaagataatgccatgtacctcctggtggtgaaccatccagatgccaagtccacagtggagttgtttaaatttcaagaagaagaaaaatcgcttttgcatctaaaaaccatcagacataaacttctgcctaatttgaatgatattgttgctgtgggacctgagcacttttatggcacaaatgatcactattttcttgacccctacttacaatcctgggagatgtatttgggtttagcgtggtcgtatgttgtctactatagtccaagtgaagttcgagtggtggcagaaggatttgattttgctaatggaatcaacatttcacccgatggcaagtatgtctatatagctgagttgctggctcataagattcatgtgtatgaaaagcatgctaattggactttaactccattgaagtcccttgactttaataccctcgtggataacatatctgtggatcctgagacaggagacctttgggttggatgccatcccaatggcatgaaaatcttcttctatgactcagagaatcctcctgcatcagaggtgcttcgaatccagaacattctaacagaagaacctaaagtgacacaggtttatgcagaaaatggcacagtgttgcaaggcagtacagttgcctctgtgtacaaagggaaactgctgattggcacagtgtttcacaaagctctttactgtgagctctaacagaccgatttgcacccatgccatagaaactgaggccattatttcaaccgcttgccatattccgaggacccagtgttcttagctgaacaatgaatgctgaccctaaatgtggacatcatgaagcatcaaagcactgtttaactgggagtgatatgatgtgtagggcttttttttgagaatacactatcaaatcagtcttggaatacttgaaaacctcatttaccataaaaatccttctcactaaaatggataaatcagttatgtcaattgtcagatattaaataacagtgtgtgaccccaaaagtacttaccctaaaacatgtgttgcctgaaagcacatgtgtgtatcgctgccttgccatgtcttgttcagaagacacaggggagcagggttagctcacgtgtctttagaactccagtactcacccagggactccagttcacaggccagaaaacatatgcattatgaagttcccctctactccatgcacatagtaagtctgactatggcagtcagacttacttactcccattttcccttcgatatatgactttttctcagtaaatattaacctgaactattccaactccccttgtactcttgctttttcaattctcctgttgcaatgacacataggaaaatcttaaaattcttgggagtgttgtcacacctgaaaattatgagtctctatgatcttggcacaaattgtacatttgagtgtctttgacttggttaaaggaagtttgttcacttcgatgactggatacagaatgaatcccataattgacatgggcgacagtaaaagtgtccccaaagactacactgttgttgaggtggtggtagtgctggtgggtttttgtttaatatttaaacttcttgttgtggaggctgaaaagaaaaaaaataatagaaaggtaaacaaacaaataaatagaaaagatcaacaacccctttggctatctactgagacatgactaggaagaaaacatgactttatcattttgttatagaagctgatatataaggttacacattttcatttatttgtttttctgatttgaaggtataaccttcatgatgaattacttcttcagggtgttaaggcagtgactttagaaacaaatttttttcttgcttttgttttgtttttgagaccgaatctcactctgttgcccaggctggagtgcagtggtgcgatcttggctcactgcaacttctacctccgaggttcaagagattcttgtgcctcagcctcccggatagctgccg

SEQ ID NO: 55934 - DNA, 1075 bp, Homo sapiens
atggggaagctcgtggcgctggtcctgctgggggtcggcctgtccttagtcggggagatgttcctggcgtttagagaaagggtgaatgcctctcgagaagtggagccagtagaacctgaaaactgccaccttattgaggaacttgaaagtggctctgaagatattgatatacttcctagtgggctggcttttatctccagtggattaaaatatccaggcatgccaaactttgcgccagatgaaccaggaaaaatcttcttgatggatctgaatgaacaaaacccaagggcacaagcactagaaatcagtggtggatttgacaaagaattatttaatccacatgggatcagtattttcatcgacaaagacaatactgtgtatctttatgttgtgaatcatccccacatgaagtccactgtggagatatttaaatttgaggaacaacaacgttctctggtatacctgaaaactataaaacatgaacttctcaaaagtgtgaatgacattgtggttcttggaccagaacagttctatgccaccagagaccactattttaccaactccctcctgtcattttttgagatgatcttggatcttcgctggacttatgttcttttctacagcccaagggaggttaaagtggtggccaaaggattttgtagtgccaatgggatcacagtctcagcagaccagaagtatgtctatgtagctgatgtagcagctaagaacattcacataatggaaaaacatgataactgggatttaactcaactgaaggtgatacagttgggcaccttagtggataacctgactgtcgatcctgccacaggagacattttggcaggatgccatcctaatcctatgaagctactgaactataaccctgaggaccctccaggatcagaagtacttcgcatccagaatgttttgtctgagaagcccagggtgagcaccgtgtatgccaacaatggctctgtgcttcagggcacctctgtggcttctgtgtaccatgggaaaattctcataggcaccgtatttcacaaaactctgtactgtgagctctagactctagata

SEQ ID NO: 55935 - DNA, 3807 bp, Homo sapiens
gacatctccgggaacccagcccaggccctgcctcccggacacaccgacgctcacgtagtcgcgcttgccacaaccctgcgggctctccgatgcggcgagcgagctggggagggggcttctccgcggcccaaaagcctgttcatctagccccatgatggctgtggacatcgagtacagatacaactgcatggctccttccttgcgccaagagaggtttgcctttaagatctcaccaaagcccagcaaaccactgaggccttgtattcagctgagcagcaagaatgaagccagtggaatggtggccccggctgtccaggagaagaaggtgaaaaagcgggtgtccttcgcagacaaccaggggctggccctgacaatggtcaaagtgttctcggaattcgatgacccgctagatatgccattcaacatcaccgagctcctagacaacattgtgagcttgacgacagcagagagcgagagctttgttctggatttttcccagccctctgcagattacttagactttagaaatcgacttcaggccgaccacgtctgccttgagaactgtgtgctcaaggacaaggccattgcaggcactgcgaaggttcagaacctcgcatttgagaagaccgtgaaaataaggatgacgttcgacacctggaagagctacacagactttccttgtcagtacgtgaaggacacttatgccggttcagacagggacacgttctccttcgacatcagtttgcccgagaagattcagtcttatgaaagaatggagtttgctgtgtactacgagtgcaatggacagacgtactgggacagcaacagaggcaagaactataggatcatccgggctgagttaaaatctacccagggaatgaccaagccccacagtggaccggatttgggaatatcctttgaccagttcggaagccctcggtgttcctatggtctgtttccagagtggccaagttacttaggatatgaaaagctagggccctactactagtgactgcaggtgacagggcgtggcggagctgccacagacaagcctagctctgctcactgtgcagtggagatggaaggccagggaggagcaacgtggaacttccatgaggccccgtttgggaaaataaaaggatcctcttcacttctttcttaaacagcaaatccagccaggttcagattacacaaccagtgtctcactcaaaggagcagtggtggctggcgcgctttcgcactgtggcagccacgagagtctgtgcacgtctgtgctggaaagggtatggatgggaatcaagcctatgccagtgctgatgaagctggaggagtctctcttctgctctccactcagatgtgggacatcagtcgccaaaagccactcagccccagccacctcgcgtgagaccctcactgttcattgtgttcatctttgggtgctctctgccagccaggcctttcctgcaagctgctgtgcttccccgtccacgtgtatctctgctgtgacacactgagctgacgcacatctccagtgcagctgcagaagagaaatgggattggctcttgttttctgcaagttcatgttttgcattttatgttcttccacaattgatctgatgttcaggaaaagataataaaggcaaattagttagtggttgagacaggcatttcctcctcccgcttcttgaccccacagatgtattccagcagagagcaacacaccagtcatcaaaacccactggctcctgtgcggtgtcacagattgcagggttctgacaaggcaggacagtcaagagtggggacactttcagcttctacttttgccttctagggggagctttctaagtccccacatttaccccgagtcaccggaaaaatctgatttttcccccgaaagctcaatgactttaacgtgcttggctggtttgtctcattctttatgaaagaattttggggccgggcgcggtggcttatgcctgtaatcccagcactttgggaggccgaggcaggtggatcacgaggtcaggagatcgagaccatcctggctaacacggtgaaaccctgtctctactaaaaatacaaaaaaattagccaggcgtggtggcgggcgcctgtagtcccagctacttgggaggctgaggcaggagaatggcgggaacctgggaggcggagcttacagtgaaccgagatcacaccactgcattcccgcctgggcagcagagcgagactccgtctcaaacagaaaaaaaaagagaattttgaatctcctttcccaaagagtcatcttttctgctgtgtttaggacatttgatttgcatatccaatatctcctcgaaaccttcagaaaatggttttatcgtgactgtgattcacactatctagaacactttaccagcacccagggacatggacttgggtgttcttatttatggtgtgtatgtaaagagataggggagaaaaacctcacccaagttcttatacgttattttaaacgtttgccaactctgaaatttcagagattcattgttcttaaccatattggactaaagtctgttggttagtgctgttgtaaaagagacctctggggccgagtgtggtggcttatgcctgtaatccctgcactttgggaagccaaggcgggcagctcacctgaggtcaggcgttcaagaccagcctggccaacatggtgaaacctcgtctgtactaaaaatacaaaatttagctgagtgtggtggcaggcgcctgtaatccagctactcgggaggctgaggcaggagaatcacttgaacccaggaggtggaggttgcagtgagccgagatcacgtcactgcatttcagcctgagcgacagagtgaaactgtctcaaaaaagagagacttccgggacagtcattatcagataggccccaaacctgtgatttttcttgggcaagattggtgtttacttaggggtgttttaaaaatatatttttacaagtatacttgtaggaagttggttttttattttctatttttgtttgtttttggagtttggttaaacgactcttttattttctgttttgccttatcttactaaagtgaagttttcctaaggcaagcaagaagaggagtggaagcacagttgcctggatttggaggcagagttgtcaggcttttcaagctaagagtcttgtgcttggattttccagattaatttgaaaagacctcccatttgtggctttgtacataaccaacaggcagatactgagtgccttggctcctagagttttgtggttgggttaggttgtttttgttgttgttttgttttggttttgttttcatttctgaagtttaagatgccttgactttttaaatgctcttaaggctattcgatgtaattcttactcctaaaactggctgttcttagcctgaaatctaatgctttgttttttgtacctctcccaggtgggtaacactctaggatgacatgatgttataattttaggggaaatcacatttttaccttatgctgttactgggcagaaccacgttttatgtaaacataccagacatcgggtaacagacagtactttaaatgttataaatttggtgatcagaactattaatagcataaatcgaactcaaatggaagcaaaactgatttcatgcaggtcctgaattttactttgccttaagaagtgccctccccacaatgcaggagaggcacagagtgcactgtcattgacatgttacccgactaaggatcactctgttcataagaaaaaggcctgaagtgactctgtttaataaagtcagtttaattttatct

SEQ ID NO: 55936 - DNA, 1677 bp, Homo sapiens
tagagatggggtctcactatgtcgcccagggtagtctcaaactcctcggtcttggcctcccaaagtgttgggattacaaacgtgagaaccgtattttcaaatgtattcaataacactacagcgtttccaattttaagaggaagcaattgccacaaaatcactgcccctggtctgggcaaggggcagttggtgaacttgctgcctccagagaaccttccctggtgtggaggcagccagggacccaggatgctccggacctgttacgtgctctgttcccaagctggtcccccctccaggggctggcagtccctgagctttgatggcggggccttccaccttaagggcacaggagagctgacacgggccttgctggttctccggctgtgtgcctggcccccactcgtcactcacgggctgttgctccaggcctggtctcggcgactcctgggctcccggctctcaggcgcatttctccgagcatccgtctatgggcagtttgtggctggtgagacagcagaggaggtgaagggctgcgtgcagcagctgcggaccctcagcctccgaccactgctggcagtgcccactgaggaggagccggactctgctgccaagagtggtgaggcgtggtatgaggggaacctcggtgctatgctgcggtgtgtggacctgtcacggggcctcctggagccccccagcctggctgaggccagcctcatgcagctgaaggtgacggcgctgaccagtactcggctctgtaaggagctagcctcgtgggtcagaaggccaggagcctccttggagctgagccccgagaggctggctgaagctatggactctgggcagaacctccaggtctcctgcctcaatgctgagcagaaccagcacctccgggcctccctcagccgcctgcatcgggtggcacagtatgcccgggcccagcacgtgcggctcctggtggatgcggagtacacctcactgaaccctgcgctctcgctgctggtggctgccctggctgtgcgctggaacagcccgggtgaaggcgggccctgggtgtggaacacctaccaggcctgtctaaaggacacattcgagcggctggggagggatgcagaggctgcgcacagggccggcctggccttcggagtgaagctggtacgaggtgcatatctggacaaggagagagcggtggcccagctccatgggatggaagaccccactcagcctgactatgaggccaccagtcagagttacagccgctgcctggaactgatgctgacgcacgtggcccgccatggccccatgtgccacctcatggtggcttcccacaatgaggaatctgttcgccaggcaaccaagcgcatgtgggagctgggcattcctctggatgggactgtctgtttcggacaacttctgggcatgtgtgaccacgtctctctagcactggggcaggccggctatgtagtgtataagtccattccctatggctccttggaggaggtaatcccctacctgatccggagggcccaggagaaccggagcgtgcttcagggtgcccgcagggaacaggagctgctcagccaagaactgtggcggcggctgctgccaggatgccgaaggataccccactagcacccctgagggggtcatgtggtcaataaaagtccttaggtgctgcct

SEQ ID NO: 55937 - DNA, 3088 bp, Homo sapiens
ccccttttccagaatcacttgcactgtcttgttcttgaatgagaaaggaagaaaagagcctcccattactcagacccgtgtaaacattattccccccaggagaaaatggtgttattcaaatgaatcataataaaatagcctctaaacagtttctaagcgggagcctccgtggaactcagcgctccgctcctcccagttcctaagaggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaacagaagcgagaggagcgccgacagctgaaacagcagctggaggacatgcagaaacagctgcgccagctgcaggaaaagttctaccaaatctatgacagcactgattcggaaaatgatgaagatggtaacctgtctgaagacagcatgcgctcggagatcctggatgccagggcccaggactctgtcggaaggtcagataatgagatgtgcgagctagacccaggacagtttattgaccgagctcgagccctgatcagagagcaggaaatggctgaaaacaagccgaagcgagaaggcaacaacaaagaaagagaccatgggccaaactccttacaaccggaaggcaaacatttggctgagaccttgaaacaggaactgaacactgccatgtcgcaagttgtggacactgtggtcaaagtcttttcggccaagccctcccgccaggttcctcaggtcttcccacctctccagatcccccaggccagatttgcagtcaatggggaaaaccacaatttccacaccgccaaccagcgcctgcagtgctttggcgacgtcatcattccgaaccccctggacacctttggcaatgtgcagatggccagttccactgaccagacagaagcactgcccctggttgtccgcaaaaactcctctgaccagtctgcctccggccctgccgctggcggccaccaccagcccctgcaccagtcgcctctctctgccaccacgggcttcaccacgtccaccttccgccaccccttcccccttcccttgatggcctatccatttcagagcccattaggtgctccctccggctccttctctggaaaagacagagcctctcctgaatccttagacttaactagggataccacgagtctgaggaccaagatgtcatctcaccacctgagccaccacccttgttcaccagcacacccgcccagcaccgccgaagggctctccttgtcgctcataaagtccgagtgcggcgatcttcaagatatgtctgaaatatcaccttattcgggaagtgcaatgcaggaaggattgtcacccaatcacttgaaaaaagcaaagctcatgtttttttatacccgttatcccagctccaatatgctgaagacctacttctccgacgtaaagttcaacagatgcattacctctcagctcatcaagtggtttagcaatttccgtgagttttactacattcagatggagaagtacgcacgtcaagccatcaacgatggggtcaccagtactgaagagctgtctataaccagagactgtgagctgtacagggctctgaacatgcactacaataaagcaaatgactttgaggttccagagagattcctggaagttgctcagatcacattacgggagtttttcaatgccattatcgcaggcaaagatgttgatccttcctggaagaaggccatatacaaggtcatctgcaagctggatagtgaagtccctgagattttcaaatccccgaactgcctacaagagctgcttcatgagtagaaatttcaacaactctttttgaatgtatgaagagtagcagtcccctttggatgtccaagttatatgtgtctagattttgatttcatatatatgtgtatgggaggcatggatatgttatgaaatcagctggtaattcctcctcatcacgtttctctcattttcttttgttttccattgcaaggggatggttgttttctttctgcctttagtttgcttttgcccaaggcccttaacatttggacacttaaaatagggttaattttcagggaaaaagaatgttggcgtgtgtaaagtctctattagcaatgaagggaatttgttaacgatgcatccacttgattgatgacttattgcaaatggcggttggctgaggaaaacccatgacacagcacaactctacagacagtgatgtgtctcttgtttctactgctaagaaggtctgaaaatttaatgaaaccacttcatacatttaagtattttgtttggtttgaactcaatcagtagcttttccttacatgtttaaaaataattccaatgacagatgagcagctcacttttccaaagtaccccaaaaggccaaattaaaaaaaaaaaaaaaaaaa

SEQ ID NO: 55938 - DNA, 1485 bp, Homo sapiens
ggtgggaatggcaggctgcgtcccactgctccagggcctggtcctggtcctcgccctccatcgtgtggagccctcagtatttctcccggcctccaaagcaaacgacgttctggtgaggtggaagcgtgcgggctcctatcttctggaagaactcttcgagggaaacttggaaaaagaatgttatgaagaaatctgtgtctatgaagaagcaagagaagtgtttgaaaatgaagtagtcactgatgaattctggagacgatataagggcggctccccgtgcatctcccagccctgcctccacaacggctcttgccaggacagcatctggggctacacctgcacctgctcccccggctatgagggcagcaactgcgagctggctaaaaatgaatgtcacccagagcggactgatgggtgtcaacacttctgcctcccaggacaggaatcctacacgtgcagctgtgctcagggctacaggcttggtgaggaccacaaacagtgtgtgccccacgaccagtgtgcctgcggggtgctgacctctgagaagcgtgcaccggatctacaggacctcccgtggcaggtaaagttaacaaattccgaaggaaaagacttctgtggtggtgttataatacgggaaaattttgtactgacaacagcaaaatgttcactgttacacaggaatattactgtaaaaacatattttaacagaacgagccaagacccgctgatgatcaagataacgcacgtccatgtgcacatgcggtatgacgcggacgcgggggagaatgacctgtcactgctggagctggagtggcccatccagtgcccaggtgcggggctccccgtgtgcacccctgagaaagacttcgctgagcacctcctcatcccacgcaccaggggcctcctcagcggctgggcacgcaatggcactgacctgggcaactcgctgaccacgcggcctgtcacacttgtggagggggaggagtgcgggcaggtcctgaatgtgactgtcaccaccaggacctactgtgagagaagcagcgtggcggccatgcactggatggatggaagtgtggtcaccagagaacacagaggctcctggtttctcacgggggtcctgggctcgcagccagtaggagggcaggctcacatggtccttgtcaccaaggtctccaggtactcactctggtttaaacagatcatgaactaactgaaactcagctagccagaatgaacaacacaaccggaagcgggattccaagctggcactgccactgtggagggcgctgaaacttcatcacacactgagaggccgtcacagccccagaccacccgcttggcccacgcagcagcagagccgccgtttgctgggttgtttaccgagcactgtgacctttctttccctggaactctttatctcaatagagaccttaaaagaaaacatgagatacgttaaataataaaataagataatctgtcagtcat

SEQ ID NO: 55939 - DNA, 1114 bp, Homo sapiens
cggacgcgtgggcggacgcgtgggcggacgcgtgggtctctgcggggagacgccagcctgcgtctgccatggggctcgggttgaggggctggggacgtcctctgctgactgtggccaccgccctgatgctgcccgtgaagccccccgcaggctcctggggggcccagatcatcgggggccacgaggtgaccccccactccaggccctacatggcatccgtgcgcttcgggggccaacatcactgcggaggcttcctgctgcgagcccgctgggtggtctcggccgcccactgcttcagccacagagacctccgcactggcctggtggtgctgggcgcccacgtcctgagtactgcggagcccacccagcaggtgtttggcatcgatgctctcaccacgcaccccgactaccaccccatgacccacgccaacgacatctgcctgctgcggctgaacggctctgctgtcctgggccctgcagtggggctgctgaggctgccagggagaagggccaggccccccacagcggggacacggtgccgggtggctggctggggcttcgtgtctgactttgaggagctgccgcctggactgatggaggccaaggtccgagtgctggacccggacgtctgcaacagctcctggaagggccacctgacacttaccatgctctgcacccgcagtggggacagccacagacggggcttctgctcggccgactccggagggcccctggtgtgcaggaaccgggctcacggcctcgtttccttctcgggcctctggtgcggcgaccccaagacccccgacgtgtacacgcaggtgtccgcctttgtggcctggatctgggacgtggttcggcggagcagtccccagcccggccccctgcctgggaccaccaggcccccaggagaagccgcctgagccacaaccttgcggcatgcaaatgagatggccgctccaggcctggaatgttccgtggctgggccccacgggaagcctgatgttcagggttggggtgggacgggcagcggtggggcacacccattccacatgcaaagggcagaagcaaacccagtaaaatgttaactgacaaaaaaaaaaaaaaaaaaaagaaa

SEQ ID NO: 55940 - DNA, 1001 bp, Homo sapiens
cgtgggtgcaccctggaccccaccatggctcaccggccccccagccctgccctggcgtccgtgctgctggccttgctgctgagcggtgctgcccgagctgcggagatcgtgggcgggcacgaggcgcagccacactcccggccctacatggcctccctgcagatgcgggggaacccgggcagccacttctgcggaggcaccttgatccaccccagcttcgtgctgacggccgcgcactgcctgcgggacataccccagcgcctggtgaacgtggtgctcggagcccacaacgtgcggacgcaggagcccacccagcagcacttctcggtggctcaggtgtttctgaacaactacgacgcggagaacaaactgaacgacgttctcctcatccagctgagcagcccagccaacctcagtgcctccgtcgccacagtccagctgccacagcaggaccagccagtgccccacggcacccagtgcctggccatgggctggggccgcgtgggtgcccacgaccccccagcccaggtcctgcaggagctcaatgtcaccgtggtcaccttcttctgccggccacataacatttgcactttcgtccctcgccgcaaggccggcatctgcttcggagactcaggtggccccctgatctgtgatggcatcatccaaggaatagactccttcgtgatctggggatgtgccacccgccttttccctgacttcttcacgcgggtagccctctacgtggactggatccgttccacgctgcgccgtgtggaggccaagggccgcccctgaaccgcccctcccacagcgctggccgggaccccgagcctggctccaaaccctcgaggcggatctttggacagaagcagctcttccccgaacactgtggcgtccgggacggccccacccgtccccccacactccctcccacggggctccgggagacaggccggccctgcacctcaccccaccgtgacctcaataaacgttgaaactcc

SEQ ID NO: 55941 - DNA, 941 bp, Homo sapiens
cgcctccctcgctccacgcgcgcccggactcggcggccaggcttgcgcgcggttcccctcccggtgggcggattcctgggcaagatgaagtgggtgtgggcgctcttgctgttggcggcgctgggcagcggccgcgcggagcgcgactgccgagtgagcagcttccgagtcaaggagaacttcgacaaggctcgcttctctgggacctggtacgccatggccaagaaggaccccgagggcctctttctgcaggacaacatcgtcgcggagttctccgtggacgagaccggccagatgagcgccacagccaagggccgagtccgtcttttgaataactgggacgtgtgcgcagacatggtgggcaccttcacagacaccgaggaccctgccaagttcaagatgaagtactggggcgtagcctcctttctccagaaaggaaatgatgaccactggatcgtcgacacagactacgacacgtatgccgtgcagtactcctgccgcctcctgaacctcgatggcacctgtgctgacagctactccttcgtgttttcccgggaccccaacggcctgcccccagaagcgcagaagattgtaaggcagcggcaggaggagctgtgcctggccaggcagtacaggctgatcgtccacaacggttactgcgatggcagatcagaaagaaaccttttgtagcaatatcaagaatctagtttcatctgagaacttctgattagctctcagtcttcagctctatttatcttaggagtttaatttgcccttctctccccatcttccctcagttcccataaaaccttcattacacataaagatacacgtgggggtcagtgaatctgcttgcctttcctgaaagtttctggggcttaagattccagactctgattcattaaactatagtcacccgtgtcctgtgaaaaaaaaaaaaa

SEQ ID NO: 55942 - DNA, 2425 bp, Homo sapiens
atcacccattttctgcatcagtcacactgggagctgcagaccggagctgttcctatttgcccatcctctccctgctttctttacctctgaggttggattctccctgtggatcctgcaatccttctgccccaaaaaactattatagcaggagggaacctgttcctgctcactctttgccttctccttctcatcctagacaagcctgaccgtgccctagttttcagaggagtgattgattctggggtgcggagaggatgaggaaactcaggctcagagagggtttttccacctaatgtgcctggaaaccatgggtagctacccaataaggcctttctatgttagaaggtcatggaccgagagtgcttggtatcggagctttgtagagacagtttgaccctgtacttagagcagagggtgtgtttgcctaggagagtgtgtgtgggcagctgtgtgtaagcctgtgtgagttgtgtgtatgttcctgtgtcttatatatgtgtgtgctccttcatggacactgcatgcatgtagtgggcatagcaaggcagagagaaaccaggagtctaggggcacagcccagtaggaagatagtatcttcctactgggcaggacttgaggtgtgcaaaggtgtgcatgagtactgcaaaagcagttcaaagagcagagaggtggggccagaataatatgttgcagaaaggcgatcatcagggaggaaagtgaggattccctgccaagatgcctgagggcttccctgcctaccacagccctctgtgttcttaaatcctcctgtctgaacagaggccagactctggtttcccccacagcctgtctgtgtctgtcctctgcaaagccatgtggctctacctggcggttttcgtgggcctgtactaccttctgcactggtaccgggagaggcaggtgctgagccacctgagagataagtatgtgttcatcacgggctgtgactctggcttcgggaaactgctggccagacagctggatgcacgaggcttgcgggtgctggctgcatgtctgacggagaaaggagccgagcagctgaggggccagacttcagacaggctggagacggtgaccctggatgttaccaagacagagagcgttgctgcagccgcccagtgggtgaaggagtgcgtgagagacaaaggactctggggcctggtgaataatgctggcatctccttgcccacggctcccaatgagttgctcaccaagcaggacttgctgaccatactggacgtgaacttgttgggggtgattgatgtgactctgaacctgctgcccttagtgaggagggccaggggccgtgtggtcaacgtcttcagtgtcatgggccgggtgtcactttttggtggaggctactgcatctccaagtatggcgtggaagccttctctgactccctcaggagggaactctcctactttggggtgaaggtggctatgattgaacctggctatttcaagactgctgtgaccagtaaggagagattcttaaagagcttcctggagatttgggaccggtccagtccagaggtcaaggaggcctatggcgagaagtttgttgcagactataagaaatcagctgaacaaatggagcagaagtgcacacaggatctgtcgttggtgaccaactgcatggagcatgcgctgattgcctgccacccccgtactcgctactcagctggctgggatgccaagcttctctacctccccatgagctacatgcccaccttcctggtggatgccattatgtactgggtctctccaagcccggccaaggctctatgaagctaaggttggatgcatggttgcatggatttggggtgtgctatgagggtggtgttatccttgggaaaatataaagtggaaggaaggaccgtccggtcagtaggcaccaatcccactccttcattactcctggccatgaatctcctgggaataattctgctctctggagatgttggtaggaaagtttcaagttacgcagctgaaaaacagggaccaaatagtgctcctgggtgcattgtcaccgtgggtggccactcaagggtccaagcctctagggccatccttgggctaacaactggggtgggtgtgagcaggtggaaggagcctcagcccatgccattacctcctgcttccttatcaggctgtgtgttaattctgggccagtctacaccctcccacggggtggaaatggcctggaggatgtgagggcacccctcctctgaagatccctgtacacgtggtgttgggactggaaccattatgcggccccataggcctcaggagtcatcccagaagcagtggctgggaggtggtgtcctaagtaaggatctgtgcagaggacaaataaatcagtttttgatttgtcttaaaaaaaaaaaaaaaaaaaaaaaaaaaaaaa

SEQ ID NO: 55943 - DNA, 6711 bp, Homo sapiens
atttgtgacttgtctcatgaacgtgatgggttttaacacagaccgcttagcatggactagaaataagttgagaggattctattttgcaaagctgtattatgaagctaaagaatatgatcttgctaaaaaatacgtatgtacttaccttagtgtgcaagagagggatcccagagctcacagatttctgggtcttctttatgaattggaagaaaacacagagaaagccgttgaatgttacaggcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggttccaagaccaaagattaaattaataaaaggtgaagctggacaaaatctgctggaaatgatggcctgtgaccgactgagccaatcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtacctggaaactcagcagaattgagacttgtagttcagcatgaaataaacactctaagagcccaggaaaaacatggccttcaacctgctctgcttgtacattgggcaaaatgccttcagaaaatgggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggcatcagaaattgttgagtatgaagaagatgcacacataacttttgctatattggatgcagtacatggaaatatagaagatgctgtgactgcttttgaatctataaaaagtgttgtttcttattggaatcttgcactgatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaagtattctcccaaaacaccacctcgatgggcagaagatcagaattctttacggaaaatgatttgccaagaagtaaaggccattacgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggttcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacattcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtttgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagtaaaaaaaaaaaaaaaaaaa

SEQ ID NO: 55944 - DNA, 7202 bp, Homo sapiens
ctttcctgttggaattggcgactgctgcggggctgagcgctggtttcacgcgtctcgggagccaggttggcggtgcgatgaggcgcagcaaagcctacggggagcggtacctcgcctcggtgcagggctccgccccgtcgcctggaaagaagttgagaggattctattttgcaaagctgtattatgaagctaaagaatatgatcttgctaaaaaatacgtatgtacttaccttagtgtgcaagagagggatcccagagctcacagatttctgggtcttctttatgaattggaagaaaacacagagaaagccgttgaatgttacaggcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggttccaagaccaaagattaaattaataaaaggtgaagctggacaaaatctgctggaaatgatggcctgtgaccgactgagccaatcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtacctggaaactcagcagaattgagacttgtagttcagcatgaaataaacactctaagagcccaggaaaaacatggccttcaacctgctctgcttgtacattgggcaaaatgccttcagaaaatgggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggcatcagaaattgttgagtatgaagaagatgcacacataacttttgctatattggatgcagtacatggaaatatagaagatgctgtgactgcttttgaatctataaaaagtgttgtttcttattggaatcttgcactgatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaagtattctcccaaaacaccacctcgatgggcagaagatcagaattctttacggaaaatgatttgccaagaagtaaaggccattacgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacatggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtctgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttaatgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagttgaaacgtgaatcatttaaaaaattgctatcagatccacagagggcaatccactcatatagttgactataaagcttgaggaggaattcataaaaatctaaaggttttacacatgcagattgattaataaatgtcgagatatggtccacttcaaaaataaggaaagtaattattgtagatgttgcactagagcatagtttatgcaggaaatgcaccagagaccttctactggtgaccccatattcgaagaaaaaaagcctctgctctacatcaagaggtgtcaagtacacttgtgttttcaatgaaaatataaaatgtttaaggtatatttgcaccatcatttaaggttacccactttagccatttttaaattcactgatcaatcacatggggagtactcctaacgtacctacagcaaactaa

SEQ ID NO: 55945 - DNA, 7111 bp, Homo sapiens
gacttgtctcatgaacgtgatgggttttaacacagaccgcttagcatggactagaaataagttgagaggattctattttgcaaagctgtattatgaagctaaagaatatgatcttgctaaaaaatacgtatgtacttaccttagtgtgcaagagagggatcccagagctcacagatttctgggtcttctttatgaattggaagaaaacacagagaaagccgttgaatgttacaggcgttcactggaattaaacccaccacaaaaagatcttgtgttgaagattgcagaattgctttgtaaaaatgatgttactgatggaagagcaaaatactgggttgaaagggcagcgaaacttttcccaggaagtcctgcaatttataaactaaaggaacatcttctagattgtgaaggtgaagatggatggaataaactttttgactggattcagtcagaactttatgtaagacctgatgacgtccatatgaacatccggctagtggagttgtatcgctcaaataaaagattgaaggatgctgtggcccgctgccatgaggcagagaggaacatagctttgcgttcaagtttagagtggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactggaaagttttgatagtgctcttcagtctgcaaaatcttctttgggtggaaatgatgaactgtcagctactttcttagaaatgaaaggacatttctacatgcatgctggttctctgctcttgaagatgggtcagcatggtaataatgttcaatggcaagctctttctgagctggctgcattgtgctatgtcatagcatttcaggttccaagaccaaagattaaattaataaaaggtgaagctggacaaaatctgctggaaatgatggcctgtgaccgactgagccaatcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtacctggaaactcagcagaattgagacttgtagttcagcatgaaataaacactctaagagcccaggaaaaacatggccttcaacctgctctgcttgtacattgggcaaaatgccttcagaaaatgggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggcatcagaaattgttgagtatgaagaagatgcacacataacttttgctatattggatgcagtacatggaaatatagaagatgctgtgactgcttttgaatctataaaaagtgttgtttcttattggaatcttgcactgatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaagtattctcccaaaacaccacctcgatgggcagaagatcagaattctttacggaaaatgatttgccaagaagtaaaggccattacgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacatggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtctgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttaatgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagttgaaacgtgaatcatttaaaaaattgctatcagatccacagagggcaatccactcatatagttgactataaagcttgaggaggaattcataaaaatctaaaggttttacacatgcagattgattaataaatgtcgagatatggtccacttcaaaaataaggaaagtaattattgtagatgttgcactagagcatagtttatgcaggaaatgcaccagagaccttctactggtgaccccatattcgaagaaaaaaagcctctgctctacatcaagaggtgtcaagtacacttgtgttttcaatgaaaatataaaatgtttaaggtatatttgcaccatcatttaaggttacccactttagccatttttaaattcactgatcaatcacatggggagtactcctaacgtacctacagcaaactaa

SEQ ID NO: 55946 - DNA, 6506 bp, Homo sapiens
ggtgtgtgccaccacgcctgcctctttgtttttttttttattatttttagtagagactgggtttcaccatgttggccaggctggtctcgaactcctgacctcaagtgatcagcccaccttggcctcccagagtgttgggattacaggtgtgagccaccacgcctgtacctggcctatctttcataggttatataaattccttggttcccagtttttgcagtcttttccaattcagtttaattaatggttaactgtttattcattatcaaaaaaagtacagtgtaatagacaagaccatgttactattagaagtatgggtatcatcaaattaagatttttgattctaaaattattaggttccaagaccaaagattaaattaataaaaggtgaagctggacaaaatctgctggaaatgatggcctgtgaccgactgagccaatcagggcatatgttgctaaacttaagtcgtggcaagcaagattttttaaaagaggttgttgaaacttttgccaacaaaagcgggcagtctgtgttatataatgctctgttttctagtcagtcatctaaggatacatcttttcttggtagcgatgatattggaaacattgatgtacaagaaccagagcttgaagatttggctagatacgatgttggtgctattcaagcacataatggtagtcttcagcaccttacttggcttggcttacagtggaattcattgcctgctttacctggaatccgaaaatggctaaaacagcttttccatcatttgccccaggaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacggctttgtacagagagacaaaaatcttggtgggatgcggtttgtactctgattcacagaaaagcagtacctggaaactcagcagaattgagacttgtagttcagcatgaaataaacactctaagagcccaggaaaaacatggccttcaacctgctctgcttgtacattgggcaaaatgccttcagaaaatgggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggcatcagaaattgttgagtatgaagaagatgcacacataacttttgctatattggatgcagtacatggaaatatagaagatgctgtgactgcttttgaatctataaaaagtgttgtttcttattggaatcttgcactgatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaagtattctcccaaaacaccacctcgatgggcagaagatcagaattctttacggaaaatgatttgccaagaagtaaaggccattacgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacatggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtctgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttaatgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagttgaaacgtgaatcatttaaaaaattgctatcagatccacagagggcaatccactcatatagttgactataaagcttgaggaggaattcataaaaatctaaaggttttacacatgcagattgattaataaatgtcgagatatggtccacttcaaaaataaggaaagtaattattgtagatgttgcactagagcatagtttatgcaggaaatgcaccagagaccttctactggtgaccccatattcgaagaaaaaaagcctctgctctacatcaagaggtgtcaagtacacttgtgttttcaatgaaaatataaaatgtttaaggtatatttgcaccatcatttaaggttacccactttagccatttttaaattcactgatcaatcacatggggagtactcctaacgtacctacagcaaactaa

SEQ ID NO: 55947 - DNA, 5036 bp, Homo sapiens
aattaatgtcttttatttttagttgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaaggtaaacaggaaagaatggaatcatttcattgtgaaattgtttctaagtgttttaaatgctcttttgttatttttatttttttttttagtattctcccaaaacaccacctcgatgggcagaagatcagaattctttacggaaaatgatttgccaagaagtaaaggccattacgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacatggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtctgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttaatgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagttgaaacgtgaatcatttaaaaaattgctatcagatccacagagggcaatccactcatatagttgactataaagcttgaggaggaattcataaaaatctaaaggttttacacatgcagattgattaataaatgtcgagatatggtccacttcaaaaataaggaaagtaattattgtagatgttgcactagagcatagtttatgcaggaaatgcaccagagaccttctactggtgaccccatattcgaagaaaaaaagcctctgctctacatcaagaggtgtcaagtacacttgtgttttcaatgaaaatataaaatgtttaaggtatatttgcaccatcatttaaggttacccactttagccatttttaaattcactgatcaatcacatggggagtactcctaacgtacctacagcaaactaa

SEQ ID NO: 55948 - DNA, 6699 bp, Homo sapiens
accacagctcctatcagccgttatgcctgccccttcctgtgtgtaaacggctttgtacagagagacaaaaatcttggtgggatgcggtttgtactctgattcacagaaaagcagtgtaagtagtaaaacaaaaatattgctttcacttagtgcgtaggttttaccggggatttaatcctcatgtgaagatttaatttgtcatgtgacccattaacatatatgtatgtaagcgctgaactgtgtatttagaaaacaattttagtaaattgaagtattttttagacctggaaactcagcagaattgagacttgtagttcagcatgaaataaacactctaagagcccaggaaaaacatggccttcaacctgctctgcttgtacattgggcaaaatgccttcagaaaatggtgagttttaaagtataagcatttttaaagaacattaccttaattttttaaaatcatgcactttttattgaaagtttttttgttcagaaaacagcagcttggtcatattatgacagatgtgttttttattgctgcaaaatagttaatgtagttaaatataagcacttagaggagcaatgcctggcacacagtgaatgttacatattagctgagctgttactgttattccttaataattaagttctgataattattcagcctgaaaattaaaaaaaaaaattagcacaaggctttgtaggtaagaccattatagatctttctaaatatttaaggtttgttttgtgtcaccattaggtgaagatggtcagccttttgaacaaactgacactacagaagaggcaggtttcagctatctaaaaatggcaactgttaaaaagtagttgggattgctacattagggtggtatcattagaagtgtttaaaagttgagtgtagaggccgggtgcggtggctcacatctgtaatcccagcacgttaggaggccgaggcgggcagatcacaagatcaggagatcgagatcattcctggctaacacggtgaaaccccgtctctactaaaaatacaaaaaaaaactctactaaaactacaaaattagccagacatggtggcaggtgcctgtaatcccagctacttgggaagctgaggcaggagaattgcttgaacctgcacggcagaggttgcagtgagttcactggtattaaggtggtttagttattacagtatttggaagttgaacaaatgactattgaggtaccatttggttttgacttgaaattttagccagttcttacaacctgtaaatgaactttagatctaatcatgcgtgttccttaaagttgtgtgcttttaactttcttttttagggcaggggtcttaattcttcttatgatcaacaagaatacatagggagaagtgttcattattggaagaaagttttgccattgttgaagataataaagaagaacagtattcctgaacctattgatcctctgtttaaacattttcatagtgtagacattcaggcatcagaaattgttgagtatgaagaagatgcacacataacttttgctatattggatgcagtacatggaaatatagaagatgctgtgactgcttttgaatctataaaaagtgttgtttcttattggaatcttgcactgatttttcacaggaaagcagaagacattgaaaatgatgccgtttttcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaagtcagtcatgcaggaactcgaagactatagtgaaggaggtcctctctataaaaatggttctttgcgaaatgcagattcagaaataaaacattctacaccatctcctaccaaatattcactatcaccaagtaaaagttacaagtattctcccaaaacaccacctcgatgggcagaagatcagaattctttacggaaaatgatttgccaagaagtaaaggccattacgaaactaaatagcagtaagtcagcatcccgtcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggttcttctaatacagaatttaagtcaaccaaagaaggattttccatcgctgtgtctgctgatggatttaaatttggcatttcggaaccaggaaatcaagaaaagaaaagtgaaaagcctcttgaaaatgatactggcttccaggctcaggatattagtggccagaagaatggccgtggtgtgatttttggccaaacaagtagcacttttacatttgcagatgttgcaaaatcaacttcaggagaaggatttcagtttggcaaaaaagaccccaatttcaagggattttcaggtgctggagaaaaattattctcatcacaatgcggtaaaatggccaataaagcaaacacttccggtgactttgagaaagatgatgatgcctgtaagactgaggacagcgatgacatccattttgaaccagtagttcaaatgcctgaaaaagtagaacttgtaacaggagaagaaggtgaaaaagttctgtattcacagggggtaaaactatttagatttgatgctgagataagtcagtggaaagaaaggggcttggggaacttaaaaattctcaaaaatgaggtcaatggcaaaccaagaatgctgatgcgaagagaccaagtactaaaagtgtgtgctaatcattggataacaactacaatgaacctgaagcccctctctggatcagatagagcatggatgtggttagccagtgatttctctgatggtgatgccaaactagagcggttggcagcacaatttaaaacaccagagctggctgaagaattcaagcagaaatttgaggaatgccagcggcttctgttagacataccacttcaaactccccataaacttgtagatactggcagagctgccaagctaatacagagagctgaagaaatgaagagtggactgaaagatttcaaaacgtttttgacaaatgatcaaacaaaagtcactgaggaagaaaataagggttcaggtacaggtgcagccggtgcctcagacacaacaataaaacccaatcctgaaaacactgggcccacattagaatgggataactatgatttaagggaagatgctttggatgataatgttagtagtagctcagtacatgattctccgttggcaagtagccctgtgagaaaaaatattttccgctttgatgagtcaacaacaggatttaacttcagttttaaatctgctttgagtctatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacatggcagaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgagtttgcaaaatatgaaagggacagaaagagtatgggtgtggactgcatgtgattttgcagatggagaaagaaaagtagagcatttagctgttcgttttaaactacaggatgttgcagactcatttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcagcttcagaagttgaagtgtctagcacatctgaaacaacaacaaaagcagtggtttctcctccaaagtttgtatttggttcagagtctgttaaaagaatttttagtagtgaaaaatcaaacccatttgcatttggcaacagttctgccactgggtctttgtttggatttagttttaatgcacctttgaaaagtaacgatagtgaaactagttcagtagcccagagtggatctgaaagcaaagtggaacctaaaaaatgtgaactgtcaaagaactctgatatcgaacagtcttcagatagcaaagtcaaaaatctctctgcttcctttccaatggaagaatcttcaatcaactacacatttaaaacaccagaaaaggagcctccattatggcatgctgaatttaccaaagaagaattggttcagaagctcagttccaccacaaaaagtgcagatcagttaaacggcctgcttcgggaaacagaggcaaccagtgcagtccttatggagcaaattaagcttctcaaaagtgaaataagaagattggaaaggaatcaagaggagtctgcagctaacgtggaacacttgaagaacgtcttgctgcagttcattttcttgaagccaggtagtgagagagagagccttcttcctgttataaatacgatgttgcagctcagccctgaagaaaagggaaaacttgctgcggttgctcaaggtcttcaagaaacctccatacccaagaaaaaatagaaagcaaccatgttctactatggtgccaaaaatagttgaacatcgacatcaaaaagattctttctgtctgcttattcacatattctggtttgaattaaaagtgatgaaattatcctaaatacagttggccctctgtatccatgggttccacatccacaaattcaaccaactgtggatggaaaagacttgaaaaagatgagagaaaataacaatatgacaataaaacataatacaaataaaaacaatacagtataacaacgattacatagcatttacattatattagggattgcacaagagaaggtatgtaggttatatgcaaatactgcaccattttacataagggacttgagaagcatggattttggtagccacaggggtcctggaaccaatccctcacagacacagacggacactttacagtagatgaacacaaagatgaaaggaaaagtctgacctaggtctgcggggagaagtggaactccatttttgacaggtgatgccattttttgttttggacatcgtccctctgtagttctttccattcccagtcttgcactctgaaagatacactgaaggaaagtccacacagtggtcaaagtctttcacaagacaccacgtgaaggtctgcacagcacagtcacattgagaaaaagatctcatgcaccagaccccctgtttctgctttctaaaagatcatcttttgcacctgcaaaaaggctgcagtaaactgggccattccatactttgattcatgtattcaaatgctacttatgagctctctgtgtattgagccccaccaggatgctggggacacacggggcacagtgcagccagaggcttggccatcatagagctcacattctagtggaatcagacaggggggttacaggaaatattcaagtaaacaatataaaatgagatcacttaatgatgatacatggatacatgttacatacatgatgagacagagtaagagaatggggaaagggtttttagatgggggaatggcaggcttttccgaggctgaaagagatccaacccacttctatttcttcaggctcccagtgatatgaaaaagtgccaaacaggactataaaattgtggtctactgtaaatggtttgcagtaaaagttctcaaccagcttccactcaaccaactcaccagttagacaatgggccctctcctgtgtttaaaacagtccggtgcccacctgggtccacatgcagctggcaggtgtttgctagtgtgcccacccatgtctgttccccccacgtgagttatgtgcttacaacgagtcgtttctttgcattttccaactttcttacatttatatttaattaaagatgatctaaactgagaaatgaatgtgaaaagaaacaaagctcttttttgtttggtttttaactaaattaaatgtttttaacaagttgaaacgtgaatcatttaaaaaattgctatcagatccacagagggcaatccactcatatagttgactataaagcttgaggaggaattcataaaaatctaaaggttttacacatgcagattgattaataaatgtcgagatatggtccacttcaaaaataaggaaagtaattattgtagatgttgcactagagcatagtttatgcaggaaatgcaccagagaccttctactggtgaccccatattcgaagaaaaaaagcctctgctctacatcaagaggtgtcaagtacacttgtgttttcaatgaaaatataaaatgtttaaggtatatttgcaccatcatttaaggttacccactttagccatttttaaattcactgatcaatcacatggggagtactcctaacgtacctacagcaaactaa

SEQ ID NO: 55949 - DNA, 1396 bp, Homo sapiens
gcgtaattaaaaggcggcggaagaaggtgggagggtcatgacgcagcgagtttcagtcgtgacttttctgggggcatcgcggcgtccccttttttttgcctttaaagtaaaacgtcgccccgacgcaccccccgcgtatttcggggggcggaggcggcgggccacggcgcgaagaggggcggtgctgacgccggccggtcacgtgggcgtgttgtgggggggaggggcgccgccgcgcggtcggttccgggcggttgggagcgcgcgagctagcgagcgagaggcagccgcgcccgccgccgcccctgctctgtatgccgctctctcccggcgcggccgccgccgatcacagcagcaggagccaccgccgccgcggttgatgtggttgggccggggctgaggaggccgccaagatgccgcagtccaagtcccggaagatcgcgatcctgggctaccggtctgtggggaaatcctcattgacgattcaatttgttgaaggccaatttgtggactcctacgatccaaccatagaaaacacttttacaaagttgatcacagtaaatggacaagaatatcatcttcaacttgtagacacagccgggcaagatgaatattctatctttcctcagacatactccatagatattaatggctatattcttgtgtattctgttacatcaatcaaaagttttgaagtgattaaagttatccatggcaaattgttggatatggtggggaaagtacaaatacctattatgttggttgggaataagaaagacctgcatatggaaagggtgatcagttatgaagaagggaaagctttggcagaatcttggaatgcagcttttttggaatcttctgctaaagaaaatcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcaaaaaaaaaaaaaaaaaaa

SEQ ID NO: 55950 - DNA, 817 bp, Homo sapiens
atctcccactacagacctgccagggcccaggagagctcgacccacccaggcacaccatagccccagagatggctggggacacagaagtgtggaagcaaatgtttcaggagttaatgcgggaggtgaagccatggcacaggtggaccctgagaccagacaagggccttcttcccaacgtcctgaagccaggctggatgcaataccagcagtggaccttcgccaggttccagtgctcctcctgctctcgtaactgggcctctgcccaagttctggtccttttccacatgaactggagtgaggagaagtccaggggccaggtgaagatgagggtgtttacccagagatgtaagaagtgcccccaacctctgtttgaggaccctgagttcacacaagagaacatctcaaggatcctgaaaaacctggtgttccgaattctgaagaaatgctatagaggaagatttcagttgatagaggaggttcctatgatcaaggacatctctcttgaagggccacacaatagtgacaactgtgaggcatgtctgcagggcttctgtgctgggcccatacaggttacaagcctccccccatctcagaccccaagagtacactccatttacaaggtggaggaggtagttaagccctgggcctcaggagagaatgtctattcctacgcatgccaaaaccacatctgtaggaacttaagcattttctgctgttgtgtcattctcattgttatcgtggtgattgttgtaaaaactgctatatgagccttggaaacatgaagctaagtcagaaaaaaaatcagatacaaaaagtc

SEQ ID NO: 55951 - DNA, 526 bp, Homo sapiens
cagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgagccctcggggcagggattcaaagttagtgaggtctatgtccagagaagctgagatatggcatataataggcatctaataaatgcttaagaggtgg

SEQ ID NO: 55952 - DNA, 1620 bp, Homo sapiens
gaccattcagaagactgtccacccgtcctcagccccctctcttcgtgggctatctactcagttgatccctccctcgctggcttggctctgactcctgctcagacccatcacctttgccgggaatgatgtctggagaacccctgcacgtgaagacccccatccgtgacagcatggccctgtccaaaatggccggcaccagcgtctacctcaagatggacagtgcccagccctccggctccttcaagatccggggcattgggcacttctgcaagaggtgggccaagcaaggctgtgcacattttgtctgctcctcggcgggcaacgcaggcatggcggctgcatatgcggccaggcaactcggcgtccccgccaccatcgtggtgcccagcaccacacctgctctcaccattgagcgcctcaagaatgaaggtgccacagtcaaggtggtgggtgagttattggatgaagccttcgagctggccaaggccctagcgaagaacaacccgggttgggtctacattcccccctttgatgaccccctcatctgggaaggccacgcttccatcgtgaaagagctgaaggagacactgtgggaaaagccgggggccatcgcgctgtcagtgggcggcgggggcctgctgtgtggagtggtccaggggctgcaggaggtgggctggggggacgtgcctgtcatcgccatggagacttttggtgcccacagcttccacgctgccaccaccgcaggcaaacttgtctccctgcccaagatcaccagtgttgccaaggccctgggcgtgaagactgtgggggctcaggccctgaagctgtttcaggaacaccccattttctctgaagttatctcggaccaggaggctgtggccgccattgagaagttcgtggatgatgagaagatcctggtggagcccgcctgcggggcagccctggccgctgtctatagccacgtgatccagaagctccaactggaggggaatctccgaaccccgctgccatccctcgtggtcatcgtctgcgggggcagcaacatcagcctggcccagctgcgggcgctcaaggaacagctgggcatgacaaataggttgcccaagtgaggacggaccccttaccgatctgtgctctcctagcccaagagacccctggaggggctggagttttatccagcgcctcgtcgtatgtttggctgagcacctgtggcctgggtgcaggttaacttcttgttatcaggagcccactatgcagaggccaaaggtcggcagccagcgaggctatgaattggacctttttggtatctgtgtgactgctctgtgcccatccttagccaacttgctggcgtgacaagtgcccacaagtaacacaccaggtacccagagcagggtggacaggagagacctgaatcacagcagtgaggaattcctcaaagctgtgacctcgcccctgaacttgttcccagtgaaggtcaacagggccaccaaccagggttgaggaaccatctcagccatcctcccaggaagcccacccctgacccttactaatttttctaatgtgcaaactttttcattgaaaaataaaatatatttatgaaacaaaaaaaaaaaaaaaaaa

SEQ ID NO: 55953 - DNA, 2064 bp, Homo sapiens
ggtcagggctgacaaactaggcttggcctcttgcctatagtggccaccactcctcaagccccagccagcaccatgagcggccgagttggagacctgagccccaaacaggcagagaccctggccaagttccgagaaaacgtccaggatgtgcttcctgccctgcccaaccctgatgattatttccttctacgctggctccgagctcggaattttgacttgcagaagtcggaggctttgctccgcaagtacatggagttccggaagaccatggatattgaccatatccttgattggcagcccccagaggtgatccagaagtacatgcctgggggcctgtgtggctatgaccgtgatggctgccccgtgtggtatgacatcattgggccacttgatcccaaggggttgctcttctcagtcaccaagcaggacctgctcaagaccaagatgagggactgtgagcgcatcctgcatgagtgtgacctgcagacagagaggctagggaagaagattgagaccatcgtgatgatatttgactgtgagggcctgggactgaaacacttctggaaacctctggtagaagtgtaccaggagttctttggcctccttgaagagaattacccagagaccctgaagttcatgctcatcgtgaaagctaccaaactgttccctgtgggctacaacctcatgaagccattcctgagtgaggacactcgcaggaaaattattgtgttgggaaataactggaaggaaggtttgctgaaactcatcagtcctgaggaactgcctgcccagtttgggggcaccctgactgacccagatgggaaccccaaatgtttaaccaagattaactatggcggggagatccccaagtccatgtacgtgcgggaccaggtgaagactcagtacgagcactcggtgcagatcaaccgcggctcatcacaccaagtggaatacgagatcctatttccaggctgcgttctcaggtggcagttctcatctgatggtgcggacatcggcttcggagttttcctgaagaccaagatgggggagcgacagcgggcaggggagatgacagatgttctacccagccagcgctataacgcccacatggtgcccgaggatgggaacctcacctgctcagaggccggcgtctatgtcctacgcttcgacaacacctatagctttgtccacgccaagaaggtcagcttcacagtggaggtcctgctccctgacgagggcatgcagaaatatgataaggagctcacccctgtctaggtggctccctcatttctcagagacctcctaaccctttgatttctctgtttatatcctacactccctccctccctgaaattgattgttagtcctcctgactctgtgacgttagtgagtacagaaagagatgccctggggaaaactcatctactgtggtcagatcaagaaaggtatgagaggcacaaccttggagggtaccaaggttgcagaagaggaaaaagcaagggtaaaggcaagaagtgggtgtcatgaaactcaataaatagcaaaatgaatcccctagcctttgtcctcacctaccctaaggcaggtgtgtatgcttgaattccttccgtatggctgtgagcaacttgggttggagacatatctaaatcctttttacttccactccctatatatagtagatgctcagtgtatatttgtggcattgaatggaggaccagaaggtagggtgcaggtgactcaacagctgtacatgattaggaggagcctatgtggggtggatttcagcaccttggacaggagcagatgtgtggtggggttggactctcttctggagacccagacaattcagtctccagatttctggcagtggctgtcttttgagggccccagccacaaaggccacatgcctctgataggagctgcctacatcaggctttgtctgacttgcacgctcagcttcccaccctaacccacttcccttgttgcacatagcttatgttttagggactttcctggaagcaaaggcagtcacatctggcataatcataataaagaaaacaacta

SEQ ID NO: 55954 - DNA, 2466 bp, Homo sapiens
ctggagtggggtaagaggcgaattatagacacaaggggctcctctgcaggaaggaggccaagggaaagaggcttgaaaggcttgatatttcacccaccaccactcactgccggagtaagcaggtctccccttcccagggctgaggggaggcagggatgtgtgctgtcccagggctgagaagtggcaggtgagctggtgattccttactgcccaggttctgtctaggaaggtgcgtcctcaccatgctggatggtgtcctagtccaggagcaccccctgagctcctggcctagactccaaagggttgggtagatgagcaaagactttacaaagaccttaggcgatatatgtccaggagcacccaggaattactgggctaccactgcagactgcaggacaagctccaagaacaggaaggaagtcttgcagctgaagggaggcactccttggcctccgcagccgatcacatgaaggtggtgccaagtctcctgctctccgtcctcctggcacaggtgtggctggtacccggcttggcccccagtcctcagtcgccagagaccccagcccctcagaaccagaccagcagggtagtgcaggctcccaaggaggaagaggaagatgagcaggaggccagcgaggagaaggccagtgaggaagagaaagcctggctgatggccagcaggcagcagcttgccaaggagacttcaaacttcggattcagcctgctgcgaaagatctccatgaggcacgatggcaacatggtcttctctccatttggcatgtccttggccatgacaggcttgatgctgggggccacagggccgactgaaacccagatcaagagagggctccacttgcaggccctgaagcccaccaagcccgggctcctgccttccctctttaagggactcagagagaccctctcccgcaacctggaactgggcctcacacaggggagttttgccttcatccacaaggattttgatgtcaaagagactttcttcaatttatccaagaggtattttgatacagagtgcgtgcctatgaattttcgcaatgcctcacaggccaaaaggctcatgaatcattacattaacaaagagactcgggggaaaattcccaaactgtttgatgagattaatcctgaaaccaaattaattcttgtggattacatcttgttcaaagggaaatggttgaccccatttgaccctgtcttcaccgaagtcgacactttccacctggacaagtacaagaccattaaggtgcccatgatgtacggtgcaggcaagtttgcctccacctttgacaagaattttcgttgtcatgtcctcaaactgccctaccaaggaaatgccaccatgctggtggtcctcatggagaaaatgggtgaccacctcgcccttgaagactacctgaccacagacttggtggagacatggctcagaaacatgaaaaccagaaacatggaagttttctttccgaagttcaagctagatcagaagtatgagatgcatgagctgcttaggcagatgggaatcagaagaatcttctcaccctttgctgaccttagtgaactctcagctactggaagaaatctccaagtatccagggttttacaaagaacagtgattgaagttgatgaaaggggcactgaggcagtggcaggaatcttgtcagaaattactgcttattccatgcctcctgtcatcaaagtggaccggccatttcatttcatgatctatgaagaaacctctggaatgcttctgtttctgggcagggtggtgaatccgactctcctataattcaggacacgcataagcacttcgcgtgtagtagatgctgaatctgaggtatcaaacacacacaggataccagcaatggatggcaggggagagtgttccttttgttcttaactagtttagggtgttctcaaataaatacagtagtccccacttatctgagggggatacattcaaagacccccagcagatgcctgaaacggtggacagtgctgaaccttatatatattttttcctacacatacatacctatgataaagtttaatttataaattaggcacagtaagagattaacaataataacaacattaagtaaaatgagttacttgaatgcaagcactgcaataccataacagtcaaactgattatagagaaggctactaagtgactcatgggcgaggagcatagacagtgtggagacattgggcaaggggagaattcacatcctgggtgggacagagcaggacaatgcaagattccatcccactactcagaatggcatgctgcttaagacttttagattgtttatttctggaatttttcatttaatgtttttggaccatggttgaccatggttaactgagactgcagaaagcaaaaccatggataagggaggactactacaaaagcattaaattgatacatattttttaaaaaaaaaaaaaaaa

SEQ ID NO: 55955 - DNA, 1465 bp, Homo sapiens
gtgggtagaggtgatgcagtgctgaagacctgggcccctgctcagtgcctttgctctagaatgggtccagcttggctttggctactgggaacagggatcctggcctctgtccactgtcagccccttcttgcccatggagataaaagtctgcaggggcctcaaccccccaggcatcagctctcagagccagcccccgcctaccacagaatcacacccaccattaccaattttgctttgcgtttgtataaagagctggcagcagacgcccccggaaacatcttcttctcgccagtgagcatctccaccaccctggccctgctctctcttggggcccaagctaacacctcagctctgatcctggagggcctgggattcaacctcacagaaacccctgaagccgacatccaccagggcttccggagcctcctccacacccttgccctgcccagccccaaactcgaactaaaagtaggaaactccctgttcctagacaagcgactaaagcctcggcagcactatttggacagcatcaaggagctttatggagcttttgctttttctgccaacttcacagattctgttacaactgggaggcagattaatgactatttgagaaggcaaacatacgggcaagtcgtggactgcctcccggagttcagccaggacacgttcatggttcttgccaattacatcttcttcaaagccaagtggaagcaccctttcagtcgctaccagacccagaagcaggaaagtttctttgtggatgagaggacttctctccaggtccccatgatgcaccaaaaggaaatgcacagattcctctatgaccaggatttggcttgcaccgtcctccagatagaatacagaggaaatgccttggcgctgctggtcctccctgacccggggaaaatgaagcaggtggaggctgctctgcagccacagaccctgagaaaatggggccaattgctcctgcccagtctgttggatttgcacttgccaaggttttcaatttctggaacatataacctggaagacatacttccccaaattggtctcaccaacatactcaacttagaagctgacttctcaggagtcactgggcagctcaacaaaaccatctccaaggtgtcacacaaggcgatggtggacatgagtgagaaggggaccgaggccggggctgcttcaggcctcctctcccagcccccatctctgaacaccatgtcagacccacatgcccacttcaacaggcctttcctcttgctcctttgggaggtcaccacccagagcttactcttcctgggaaaagttgtcaacccagttgcagggtaaccatggtgggaggccaggagttatcttatctcatcctggaccaaacagataggccagaaccagcctgcatcctggggctgctatgtggttcagttaatcagtgtgccaagattctaataaagttgaccttgggttc

SEQ ID NO: 55956 - DNA, 1465 bp, Homo sapiens
gtgggtagaggtgatgcagtgctgaagacctgggcccctgctcagtgcctttgctctagaatgggtccagcttggctttggctactgggaacagggatcctggcctctgtccactgtcagccccttcttgcccatggagataaaagtctgcaggggcctcaaccccccaggcatcagctctcagagccagcccccgcctaccacagaatcacacccaccattaccaattttgctttgcgtttgtataaagagctggcagcagacgcccccggaaacatcttcttctcgccagtgagcatctccaccaccctggccctgctctctcttggggcccaagctaacacctcagctctgatcctggagggcctgggattcaacctcacagaaacccctgaagccgacatccaccagggcttccggagcctcctccacacccttgccctgcccagccccaaactcgaactaaaagtaggaaactccctgttcctagacaagcgactaaagcctcggcagcactatttggacagcatcaaggagctttatggagcttttgctttttctgccaacttcacagattctgttacaactgggaggcagattaatgactatttgagaaggcaaacatacgggcaagtcgtggactgcctcccggagttcagccaggacacgttcatggttcttgccaattacatcttcttcaaagccaagtggaagcaccctttcagtcgctaccagacccagaagcaggcaagtttctttgtggatgagaggacttctctccaggtccccatgatgcaccaaaaggaaatgcacagattcctctatgaccaggatttggcttgcaccgtcctccagatagaatacagaggaaatgccttggcgctgctggtcctccctgacccggggaaaatgaagcaggtggaggctgctctgcagccacagaccctgagaaaatggggccaattgctcctgcccagtctgttggatttgcacttgccaaggttttcaatttctggaacatataacctggaagacatacttccccaaattggtctcaccaacatactcaacttagaagctgacttctcaggagtcactgggcagctcaacaaaaccatctccaaggtgtcacacaaggcgatggtggacatgagtgagaaggggaccgaggccggggctgcttcaggcctcctctcccagcccccatctctgaacaccatgtcagacccacatgcccacttcaacaggcctttcctcttgctcctttgggaggtcaccacccagagcttactcttcctgggaaaagttgtcaacccagttgcagggtaaccatggtgggaggccaggagttatcttatctcatcctggaccaaacagataggccagaaccagcctgcatcctggggctgctatgtggttcagttaatcagtgtgccaagattctaataaagttgaccttgggttc

SEQ ID NO: 55957 - DNA, 1752 bp, Homo sapiens
atgaccccaggctccaccaagcatcttcatgtccccctgctcatcccccactcccccccacccagagttgctcatcctgccagggctggctgtgcccaccccaaggctgccctcctgggggccccagaactgcctgatcgtgccgtggcccagttttgtggcatctgcagcaacacaagagagaggacaattcacatggccataggcctgctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtgcccagaaatcttcctctggcctagttgtggagcctggcctaagtcgcacattgctggagatggtgaagctgaccagcatgagaggcagtggcacagcagagccagggccagatctggaggtggctgtgcccccctggggggtgcagactcacagcccctccaacagggagcccctccagagtggagagaacgagtccttcccagtcacacccaggagccctcgggtggcacttggcagctggtgtcaccaccctaagtacccacacaaatgggctatggaggcagagcaacaaggattccagctcctggtgagagattcccaggccagggtcttggtagacacaagcctggtgacttcaggcagctggcaattactgggcatctaccaagggacaataccattctctgtctcatggggcgtcctcctgctggcaggcctgtgctgcctggtccccagctccctggttgaggatccccaggaagatgctgcccaaaagacggatacatcccaccatgatcaaggggactgggaggaccttgcttgccagaagatctcctataacgtcaccgacctcgcctttgatttgtacaaagagctggctgatctatcacaaaccagcaatgtcttagtcaccccaacaagcgtggctatggcctttgcaatgctctccctggggaccaaggctgacactcgcacagagatcctggaaggcctgaatgtcaacctcacagagacgcctgaggccaagatccacgaatgcttccagcaagttctccaagccctcagcaggccagacacccggctccagctgaccaccggcagtagcctgtttgttaacaagagtatgaagctagtggacacgtttttggaggataccaagaagctgtaccactcagaagcctcttccatcaacttcagggacaccgaggaggccaaagagcagatcaacaattatgtggagaaaagaactggaagaaaagtagtggatttggtcaaacacctgaaaaaagacacaagtcttgccctggtggattacatttcctttcacggcaagtggaaagataaattcaaggctgagcgcattatggtagagggcttccatgtggatgataagaccatcatcagagtgcctatgataaaccacctgggtagatttgacatccaccgggacagggagttatccagctgggtgctggcacagcactatgtggggaacgccactgccttcttcatcctgcccgatccaaagaagatgtggcagttggaagaaaaattgacctacagccaccttgaaaatatccagagagcctttgacataaggtga

SEQ ID NO: 55958 - DNA, 1629 bp, Homo sapiens
attcatgaaaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttggaaaaaaaaaaaaaaaaaaaaaaaaaaaaaaaaaaaaaaaa

SEQ ID NO: 55959 - DNA, 1678 bp, Homo sapiens
cagagctgagacagccacccagggggtccactccaggacagactgtgccgcctgagagtgcagaggatgcatcttatcgactacctgctcctcctgctggttggactactggccctttctcatggccagctgcacgttgagcatgatggtgagagttgcagtaacagctcccaccagcagattctggagacaggtgagggctcccccagcctcaagatagcccctgccaatgctgactttgccttccgcttctactacctgatcgcttcggagaccccggggaagaacatctttttctccccgctgagcatctcggcggcctacgccatgctttccctgggggcctgctcacacagccgcagccagatccttgagggcctgggcttcaacctcaccgagctgtctgagtccgatgtccataggggcttccagcacctcctgcacactctcaacctccccggccatgggctggaaacacgcgtgggcagtgctctgttcctgagccacaacctgaagttccttgcaaaattcctgaatgacaccatggccgtctatgaggctaaactcttccacaccaacttctacgacactgtgggcacaatccagcttatcaacgaccacgtcaagaaggaaactcgagggaagattgtggatttggtcagtgagctcaagaaggacgtcttgatggtgctggtgaattacatttacttcaaagccctgtgggagaaaccattcatttcctcaaggaccactcccaaagacttttatgttgatgagaacacaacagtccgggtgcccatgatgctgcaggaccaggagcatcactggtatcttcatgacagatacttgccctgctcggtgctacggatggattacaaaggagacgcaaccgtgtttttcattctccctaaccaaggcaaaatgagggagattgaagaggttctgactccagagatgctaatgaggtggaacaacttgttgcggaagaggaatttttacaagaagctagagttgcatcttcccaagttctccatttctggctcctatgtattagatcagattttgcccaggctgggcttcacggatctgttctccaagtgggctgacttatccggcatcaccaaacagcaaaaactggaggcatccaaaagtttccacaaggccaccttggacgtggatgaggctggcaccgaggctgcagcagccaccagcttcgcgatcaaattcttctctgcccagaccaatcgccacatcctgcgattcaaccggcccttccttgtggtgatcttttccaccagcacccagagtgtcctctttctgggcaaggtcgtcgaccccacgaaaccatagccctcccagggctgctcatctgttccaagcaggaggatgtggcaggggagggctgggagtgagtagctctgtgtttagagttggggacaaggatgacaccgaaggtccaggagtccaggacagcaggtgctggccggtggggagcggggaggggcactgagatgggcagggcctggacattccacaccctggtgctgtgcagcctctggcagagcatccgacctcttggagcaagtttctgcctctggaaagggggcgggcccttttcacaacaggctggttgtaccgagtaaacaacacgatgccatgaaaaaaaaaaaaaaaaaaa

SEQ ID NO: 55960 - DNA, 1510 bp, Homo sapiens
atccaccgcaggcttactgtacacatgctagggtccaggacagcaggaccaagccagcagaaacagcctgagcccaccgcagactggcctggctatactggacaatgccactcctcctgtacacctgtcttctctggctgcccaccagcggcctctggaccgtccaggccatggatcctaacgctgcttatgtgaacatgagtaaccatcaccggggcctggcttcagccaacgttgactttgccttcagcctgtataagcacctagtggccttgagtcccaaaaagaacattttcatctcccctgtgagcatctccatggccttagctatgctgtccctgggcacctgtggccacacacgggcccagcttctccagggcctgggtttcaacctcactgagaggtctgagactgagatccaccagggtttccagcacctgcaccaactctttgcaaagtcagacaccagcttagaaatgaccatgggcaatgccttgtttcttgatggcagcctggagttgctggagtcattctcagcagacatcaagcactactatgagtcagaggtcttggctatgaatttccaggactgggcaacagccagcagacagatcaacagctatgtcaagaataagacacaggggaaaattgtcgacttgttttcagggctggatagcccagccatcctcgtcctggtcaactatatcttcttcaaaggcacatggacacagccctttgacctggcaagcaccagggaggagaacttctatgtggacgagacaactgtggtgaaggtgcccatgatgttgcagtcgagcaccatcagttaccttcatgacgcggagctcccctgccagctggtgcagatgaactacgtgggcaatgggactgtcttcttcatccttccggacaaggggaagatgaacacagtcatcgctgcactgagccgggacacgattaacaggtggtccgcaggcctgaccagcagccaggtggacctgtacattccaaaggtcaccatctctggagtctatgacctcggagatgtgctggaggaaatgggcattgcagacttgttcaccaaccaggcaaatttctcacgcatcacccaggacgcccagctgaagtcatcaaaggtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctggcgagggttatgaacccagtgtaagagaccacccacccagagcctcagcactgtctgactttgggaaccagggatcccacagaaatgttttggagagcgggaggtttcccccaatctcctccaagttcttctccctccaaccagagttgtgtctaactttaggcatcttttaataaatgtcattgcgactctgaaaaaaaaaaaaaaaaaaa

SEQ ID NO: 55961 - DNA, 1559 bp, Homo sapiens
attaacttccttccaaaatgtcaccattcctgtacctggttctcttggtacttgggcttcatgctacaatccactgtgcatcacctgaaggcaaagtaacagcctgccattcatcccaaccaaatgccactctctacaagatgtcatccattaatgctgactttgcattcaatctgtaccggaggttcactgtggagaccccagataagaacatcttcttttcccctgtgagcatttctgcagctttggttatgctttcctttggggcctgctgcagcacccaaactgagattgtggagaccttggggttcaacctcacagacactccaatggtagagatccagcatggcttccagcatctgatctgttcactgaattttccaaagaaggaactggaattgcagataggaaatgccctcttcattggcaagcatctgaaaccactggcaaagttcttgaatgatgtcaagaccctctatgagactgaagtcttttctaccgacttctccaacatttctgcagccaagcaggagattaacagtcatgtggagatgcaaaccaaagggaaagttgtgggtctaattcaagacctcaagccaaacaccactatggtcttagtgaactatattcactttaaagcccagtgggcaaatccttttgatccatccaagacagaagacagttccagcttcttaatagacaagaccaccactgttcaagtgcccatgatgcaccagatggaacaatactatcacctagtggatatggaattgaactgcacagttctgcaaatggactacagcaagaatgctctggcactctttgttcttcccaaggagggacagatggagtcagtggaagctgccatgtcatctaaaacactgaagaagtggaaccgcttactacagaagggatgggttgacttgtttgttccaaagttttccatttctgccacatatgaccttggagccacacttttgaagatgggcattcagcatgcctattctgaaaatgctgatttttctggactcacagaggacaatggtctgaaactttccaatgctgcccataaggctgtgctgcacattggtgaaaagggaactgaagctgcagctgtccctgaagttgaactttcggatcagcctgaaaacactttcctacaccctattatccaaattgatagatctttcatgttgttgattttggagagaagcacaaggagtattctctttctagggaaagttgtgaacccaacggaagcgtagttgggaaaaaggccattggctaattgcacgtgtgtattgcaatgggaaataaataaataatatagcctggtgtgattgatgtgagcttggacttgcattcccttatgatgggatgaagattgaaccctggctgaactttgttggctgtggaagaggccaatcctatggcagagcattcagaatgtcaatgagtaattcattattatccaaagcataggaaggctctatgtttgtatatttctctttgtcagaatacccctcaactcatttgctctaataaatttgactgggttg

SEQ ID NO: 55962 - DNA, 1559 bp, Homo sapiens
aaagaaccagttttcaggcggattgcctcagatcacactatctccacttgcccagccctgtggaagattagcggccatgtattccaatgtgataggaactgtaacctctggaaaaaggaaggtttatcttttgtccttgctgctcattggcttctgggactgcgtgacctgtcacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagctgggtgcctgtaatgacaccctccagcaactgatggaggtatttaagtttgacaccatatctgagaaaacatctgatcagatccacttcttctttgccaaactgaactgccgactctatcgaaaagccaacaaatcctccaagttagtatcagccaatcgcctttttggagacaaatcccttaccttcaatgagacctaccaggacatcagtgagttggtatatggagccaagctccagcccctggacttcaaggaaaatgcagagcaatccagagcggccatcaacaaatgggtgtccaataagaccgaaggccgaatcaccgatgtcattccctcggaagccatcaatgagctcactgttctggtgctggttaacaccatttacttcaagggcctgtggaagtcaaagttcagccctgagaacacaaggaaggaactgttctacaaggctgatggagagtcgtgttcagcatctatgatgtaccaggaaggcaagttccgttatcggcgcgtggctgaaggcacccaggtgcttgagttgcccttcaaaggtgatgacatcaccatggtcctcatcttgcccaagcctgagaagagcctggccaaggtagagaaggaactcaccccagaggtgctgcaagagtggctggatgaattggaggagatgatgctggtggtccacatgccccgcttccgcattgaggacggcttcagtttgaaggagcagctgcaagacatgggccttgtcgatctgttcagccctgaaaagtccaaactcccaggtattgttgcagaaggccgagatgacctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagtaaaatgttcttattctttgcacctcttcctatttttggtttgtgaacagaagtaaaaataaatacaaactacttccatctcacattaaaa

SEQ ID NO: 55963 - DNA, 2237 bp, Homo sapiens
atgaccttggctgctttcatctctgaagcgccacttctcagaaacacagagctttagctccgccaaaatgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggaaaacaccgtcaccaacgactggattccagagggggaggaggacgacgactatctggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgctgaaagaccaggtcaacactttcgataacatcttcatagcacccgttggcatttctactgcgatgggtatgatttccttaggtctgaagggagagacccatgaacaagtgcactcgattttgcattttaaagactttgttaatgccagcagcaagtatgaaatcacgaccattcataatctcttccgtaagctgactcatcgcctcttcaggaggaattttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagaccctgctacccagatgatgattctcaactgcatctacttcaaaggatcctgggtgaataaattcccagtggaaatgacacacaaccacaacttccggctgaatgagagagaggtagttaaggtttccatgatgcagaccaaggggaacttcctcgcagcaaatgaccaggagctggactgcgacatcctccagctggaatacgtggggggcatcagcatgctaattgtggtcccacacaagatgtctgggatgaagaccctcgaagcgcaactgacaccccgggtggtggagagatggcaaaaaagcatgacaaacagaactcgagaagtgcttctgccgaaattcaagctggagaagaactacaatctagtggagtccctgaagttgatggggatcaggatgctgtttgacaaaaatggcaacatggcaggcatctcagaccaaaggatcgccatcgacctgttcaagcaccaaggcacgatcacagtgaacgaggaaggcacccaagccaccactgtgaccacggtggggttcatgccgctgtccacccaagtccgcttcactgtcgaccgcccctttcttttcctcatctacgagcatcgcaccagctgcctgctcttcatgggaagagtggccaaccccagcaggtcctagaggtggaggtctaggtgtctgaagtgccttgggggcaccctcattttgtttccattccaacaacgagaacagagatgttctggcatcatttacgtagtttacgctaccaatctgaattcgaggcccatatgagaggagcttagaaacgaccaagaagagaggcttgttggaatcaattctgcacaatagcccatgctgtaagctcatagaagtcactgtaactgtagtgtgtctgctgttacctagagggtctcacctccccactcttcacagcaaacctgagcagcgcgtcctaagcacctcccgctccggtgaccccatccttgcacacctgactctgtcactcaagcctttctccaccaggcccctcatctgaataccaagcacagaaatgagtggtgtgactaattccttacctctcccaaggagggtacacaactagcaccattcttgatgtccagggaagaagccacctcaagacatatgaggggtgccctgggctaatgttagggcttaattttctcaaagcctgacctttcaaatccatgatgaatgccatcagtccctcctgctgttgcctccctgtgacctggaggacagtgtgtgccatgtctcccatactagagataaataaatgtagccacatttactgtgaaaaaaaaaaaaaaaa

SEQ ID NO: 55964 - DNA, 1580 bp, Homo sapiens
aaagaaggcatccagcaagaactgcacaagaaacggagtcagccggagaacaaggagtggtcttccactgcctcacaggaggatggaggcccacaacgcgtctgccccattcaacttcaccctgccacccaactttggcaagcgccccacagacctggcactgagcgtcatcctggtgttcatgttgttcttcatcatgctctcgctgggctgcaccatggagttcagcaagatcaaggctcacttatggaagcctaaagggctggccatcgccctggtggcacagtatggcatcatgcccctcacggcctttgtgctgggcaaggtcttccggctgaagaacattgaggcactggccatcttggtctgtggctgctcacctggagggaacctgtccaatgtcttcagtctggccatgaagggggacatgaacctcagcattgtgatgaccacctgctccaccttctgtgcccttggcatgatgcctctcctcctgtacatctactccagggggatctatgatggggacctgaaggacaaggtgccctataaaggcatcgtgatatcactggtcctggttctcattccttgcaccatagggatcgtcctcaaatccaaacggccacaatacatgcgctatgtcatcaagggagggatgatcatcattctcttgtgcagtgtggccgtcacagttctctctgccatcaatgtggggaagagcatcatgtttgccatgacaccactcttgattgccacctcctccctgatgccttttattggctttctgctgggttatgttctctctgctctcttctgcctcaatggacggtgcagacgcactgtcagcatggagactggatgccaaaatgtccaactctgttccaccatcctcaatgtggcctttccacctgaagtcattggaccacttttcttctttcccctcctctacatgattttccagcttggagaagggcttctcctcattgccatattttggtgctatgagaaattcaagactcccaaggataaaacaaaaatgatctacacagctgccacaactgaagaaacaattccaggagctctgggaaatggcacctacaaaggggaggactgctccccttgcacagcctagcccttcccctggtggcctggattctggtcccaaagcaattctgaaagccagtgtggtaaactagagagagcagcaaaaacaccagtcttgcctgagtctttctccagcatttccagtacatctatcagaatcatcaagtcttggccgggaacacagacagggtgtctacccaagaagcctcacctatccccaacttagaatttgctacttattttaaagacttgttcagtgactgtaaactctatgaaaccagaaaccgaatctgcctcttgctgggatctctaaaagtgtctgataagcatcttaaagtcactcaattcctgaactaatcaatatatatgtttaacccattactcaaatacccaaatcccattccaagttttgtgacccaaaagagaaataaatgctcacaagtgctgtagaattaaacttcagaagttctaacctt

SEQ ID NO: 55965 - DNA, 3248 bp, Homo sapiens
ccctcccgcgcgatggcctcggcgctgagctatgtctccaagttcaagtccttcgtgatcttgttcgtcaccccgctcctgctgctgccactcgtcattctgatgcccgccaagtttgtcaggtgtgcctacgtcatcatcctcatggccatttactggtgcacagaagtcatccctctggctgtcacctctctcatgcctgtcttgcttttcccactcttccagattctggactccaggcaggtgtgtgtccagtacatgaaggacaccaacatgctgttcctgggcggcctcatcgtggccgtggctgtggagcgctggaacctgcacaagaggatcgccctgcgcacgctcctctgggtgggggccaagcctgcacggctgatgctgggcttcatgggcgtcacagccctcctgtccatgtggatcagtaacacggcaaccacggccatgatggtgcccatcgtggaggccatattgcagcagatggaagccacaagcgcagccaccgaggccggcctggagctggtggacaagggcaaggccaaggagctgccagggagtcaagtgatttttgaaggccccactctggggcagcaggaagaccaagagcggaagaggttgtgtaaggccatgaccctgtgcatctgctacgcggccagcatcgggggcaccgccaccctgaccgggacgggacccaacgtggtgctcctgggccagatgaacgagttgtttcctgacagcaaggacctcgtgaactttgcttcctggtttgcatttgcctttcccaacatgctggtgatgctgctgttcgcctggctgtggctccagtttgtttacatgagattcaattttaaaaagtcctggggctgcgggctagagagcaagaaaaacgagaaggctgccctcaaggtgctgcaggaggagtaccggaagctggggcccttgtccttcgcggagatcaacgtgctgatctgcttcttcctgctggtcatcctgtggttctcccgagaccctggcttcatgcccggctggctgactgttgcctgggtggagggtgagacaaagtatgtctccgatgccactgtggccatctttgtggctaccctgctattcattgtgccttcacagaagcccaagtttaacttccgcagccagactgaggaagaaaggaaaactccattttatccccctcccctgctggattggaaggtaacccaggagaaagtgccctggggcatcgtgctgctactagggggcggatttgctctggctaaaggatccgaggcctcggggctgtccgtgtggatggggaagcagatggagcccttgcacgcagtgcccccggcagccatcaccttgatcttgtccttgctcgttgccgtgttcactgagtgcacaagcaacgtggccaccaccaccttgttcctgcccatctttgcctccatgtctcgctccatcggcctcaatccgctgtacatcatgctgccctgtaccctgagtgcctcctttgccttcatgttgcctgtggccacccctccaaatgccatcgtgttcacctatgggcacctcaaggttgctgacatggtgaaaacaggagtcataatgaacataattggagtcttctgtgtgtttttggctgtcaacacctggggacgggccatatttgacttggatcatttccctgactgggctaatgtgacacatattgagacttaggaagagccacaagaccacacacacagcccttaccctcctcaggactaccgaaccttctggcacaccttgtacagagttttggggttcacaccccaaaatgacccaacgatgtccacacaccaccaaaacccagccaatgggccacctcttcctccaagcccagatgcagagatggacatgggcagctggagggtaggctcagaaatgaagggaacccctcagtgggctgctggacccatctttcccaagccttgccattatctctgtgagggaggccaggtagccgagggatcaggatgcaggctgctgtacccgctctgcctcaagcatcccccacacagggctctggttttcactcgcttcgtcctagatagtttaaatgggaatcagatcccctggttgagagctaagacaaccacctaccagtgcccatgtcccttccagctcaccttgagcagcctcagatcatctctgtcactctggaagggacaccccagccagggacggaatgcctggtcttgagcaacctcccactgctggagtgcgagtgggaatcagagcctcctgaagcctctgggaactcctcctgtggccaccaccaaaggatgaggaatctgagttgccaacttcaggacgacacctggcttgccacccacagtgcaccacaggccaacctacgcccttcatcacttggttctgttttaatcgactggccccctgtcccacctctccagtgagcctccttcaactccttggtcccctgttgtctgggtcaacatttgccgagacgccttggctggcaccctctggggtcccccttttctcccaggcaggtcatcttttctgggagatgcttcccctgccatccccaaatagctaggatcacactccaagtatgggcagtgatggcgctctgggggccacagtgggctatctaggccctccctcacctgaggcccagagtggacacagctgttaatttccactggctatgccacttcagagtctttcatgccagcgtttgagctcctctgggtaaaatcttccctttgttgactggccttcacagccatggctggtgacaacagaggatcgttgagattgagcagcgcttggtgatctctcagcaaacaacccctgcccgtgggccaatctacttgaagttactcggacaaagaccccaaagtggggcaacaactccagagaggctgtgggaatcttcagaagcccccctgtaagagacagacatgagagacaagcatcttctttcccccgcaagtccattttatttccttcttgtgctgctctggaagagaggcagtagcaaagagatgagctcctggatggcattttccagggcaggagaaagtatgagagcctcaggaaaccccatcaaggaccgagtatgtgtctggttccttgggtgggacgattcctgaccacactgtccagctcttgctctcattaaatgctctgtctcccgcggaaaaaaaaaaaaaaaaaaaaaaaaaaaaaaaaaaaaaaaaaaa

SEQ ID NO: 55966 - DNA, 1549 bp, Homo sapiens
cttcagccgtgtatgcaaatggataaccggttgcctcccaaaaaagttccaggtttctgttcctttcgctatggattgtctttccttgtgcactgttgtaatgttataataacagcacagcgtgcgtgcctgaacctcacaatggtagtcatggtgaatagcacagatccacatggtttgcccaacacctccacaaagaagctcctggataatataaagaaccctatgtataattggagcccagatatccagggaatcatcttgagttccacctcctatggtgtcatcatcatccaagttcctgttggatacttctctggaatatattctacaaagaaaatgattggctttgcattatgcctcagctctgtgttaagcctgctcatcccaccagcagctggaattggagtagcttgggtcgttgtatgtcgagcagttcagggagcagcccaggggatagttgcaacagcccagtttgaaatatatgtcaaatgggctcctcccctggaacgaggccgacttacttctatgagtacatcagggtttttgctgggaccctttattgtcctacttgtgactggagttatctgtgaatctctgggctggcccatggtcttctatatttttggtgcttgtggctgtgccgtatgtcttctctggttcgttctgttttatgatgaccccaaagaccacccatgtataagcatcagtgaaaaggaatacatcacatcctccctggtccagcaggtcagttcaagtagacaatctctgcctatcaaggctatacttaagtcgcttccagtctgggctatttccattggtagttttacgtttttctggtcacataacatcatgacactatacactccaatgtttatcaactccatgcttcatgttaatataaaagagaatgggttcttgtcttcccttccctatttgtttgcctggatctgtggtaacctagcaggtcagttatcagacttcttcctgaccaggaatattctcagcgtaattgctgtccggaaactcttcacagcagcaggatttctccttcctgcaatctttggtgtctgcctgccttacctgagttccaccttctacagcattgtcattttcctaatacttgctggtgcaacaggcagcttttgcttgggtggagtgtttataaatggcttggatattgctcccagatattttggatttattaaagcatgttcaactttaactggaatgataggaggactaattgcttccactttgactggattgatccttaagcaggatccggaatccgcctggtttaaaaccttcatcctgatggcagccattaatgtgactggcctaattttctaccttatagttgctacagcagaaattcaggactgggctaaagaaaaacaacacacacgtctctgaagtgtgaaacagagcacttgcagagcctgggacaacctccttattgaagggaagagggaccagcacatgaggctgaggctgaggggcagtcaccagcaccaggaagaaggtggtaggaggagtcctaggggct

SEQ ID NO: 55967 - DNA, 2281 bp, Homo sapiens
ggacagaaaactccctccttttccaagttagccttatagtctagggcttaaaatactggtttaatggtgaaggtaagtgcttttcttctttttgggtagaaggattattactaacttaccaaaggtccattaaggggagggaacagttttaggagaagtcagagaaaagacattaacagcaacataaggatctccatctggtaatattgcctaattccaaaatgaagagactctctgaaaaagataactgattcaatgaagaccctagggcaaggcttgagaagccactggtaccaatggacactgtggacaatggtcatttctccaaggacgctataaaagactgtcgtagtaaaagagattcagggcacagggaaactccaccacaaagcgtggtaccatttcccacagaagctaaatggacgggaagcctgccaccaggaaaggtccagatttctgttcattacgctatgggctggctcttatcatgcacttctcaaacttcaccatgataacgcagcgtgtgagtctgagcattgcgatcatcgccatggtgaacaccactcagcagcaaggtctatctaatgcctccactgaggggcctgttgcagatgccttcaataactccagcatatccatcaaggaatttgatacaaaggcctctgtgtatcaatggagcccagaaactcagggtatcatctttagctccatcaactatgggataatactgactctgatcccaagtggatatttagcagggatatttggagcaaaaaaaatgcttggtgctggtttgctgatctcttcccttctcaccctctttacaccactggctgctgacttcggagtgattttggtcatcatggttcggacagtccagggcatggcccagggaatggcatggacaggtcagtttactatttgggcaaagtgggctcctccacttgaacgaagcaagctcaccaccattgcaggatcagggtcagcatttggatccttcatcatcctctgtgtggggggactaatctcacaggccttgagctggccttttatcttctacatctttggtagcactggctgtgtctgctgtctcctatggttcacagtgatttatgatgaccccatgcatcacccgtgcataagtgttagggaaaaggagcacatcctgtcctcactggctcaacagcccagttctcctggacgagctgtccccataaaggcgatggtcacatgcctaccactttgggccattttcctgggttttttcagccatttctggttatgcaccatcatcctaacatacctaccaacgtatatcagtactctgctccatgttaacatcagagatagtggagttctgtcctccctgccttttattgctgctgcaagctgtacaattttaggaggtcagctggcagatttccttttgtccaggaatcttctcagattgatcactgtgcgaaagctcttttcatctcttgatatgcaagtttcctcatgggaatctcaaggggatttgggctcatcgcaggaatcatctcttccactgccactggattcctcatcagtcaggattttgagtctggttggaggaatgtctttttcctgtctgctgcagtcaacatgtttggcctggtcttttacctcacgtttggacaagcagaacttcaagactgggccaaagagaggacccttacccgcctctgaggacataaagttacaaacttaaatgtggtactgagcatgaactttttaaacattttttacttctctccatattcctgaccatagactcagcagttcttaactctggctgtgtgttagtcttccctggggagcctttataagacactgatacttgggacccactccagagattctgaatgaattggtctggggtggaacccagatactactaatttttagatactccttagaggtttctagcatgcgcccggggttgacaacagctggacaaacttgaaaagtcaattcatgtggcctttgaattttcctcattggaaagtactaaataaataaaaattcatgtgaaaatgatcactgataaatatcttcatggtggggcaggttattggatgcagagaagatctgctcggaattgtagccatatgttacagatctcagcaccgatcagaactgtaaagctataatccccagaattaaagtttttattattttttatacattgtaaaacatagacgtttatttatgtgattaaattctattaaaatttacatgctaaaataaaaaaaaaaaaaaa

SEQ ID NO: 55968 - DNA, 2626 bp, Homo sapiens
gaattcctcgacactgttggcctactggatttatttgaaaggaatgaggatcctgcactcttcctccctcagtaagtaaatgccagtccctaggaagagagaaccaaaatgtctaccggaccagatgtcaaggctacagtgggggacatttccagtgatggcaatttaaacgtggctcaagaggaatgctccaggaaaggtttttgttcagtccgacatgggctggccctcatcttgcagctctgtaatttttcaatttacacccaacaaatgaacttgagcattgccattccagctatggtgaacaacacagccccacctagccagcccaatgcctccacagaacggccctccactgactcccagggctactggaatgaaactctaaaagaatttaaagcaatggcccctgcatatgactggagtcctgaaatccagggaatcatcctcagctccctcaactatggctcattcttggctccaatccccagtggctatgtggctggaatatttggagccaagtatgtggttggtgctggcttgtttatttcctcattcctgaccctcttcattccactggcagctaatgcgggagtggccttgctcattgtcctccggattgtacaaggcatagcccaggttatggtattaactggtcagtattcaatttgggtcaaatgggctcccccactggaaaggagtcaactcaccaccattgctggatcagggtcaatgctggggtccttcattgttctacttgctggtggtctcctctgccagaccataggatggccttacgtcttctatatctttggaggaattggctgtgcttgttgtcctctctggtttcctctcatttatgatgatcctgtgaatcatccctttatcagtgctggtgagaagagatacattgtgtgttcattggctcagcaggactgttcaccaggctggtctcttcccattagggctatgatcaaatccttaccactctgggccattttagtctcttatttctgtgaatactggcttttttataccattatggcgtacacaccaacgtacatcagctcggtacttcaagccaacctcagagatagtgggatcctgtctgccttgccgtttgttgttggatgtatctgcattatccttggaggtctactggcagactttcttctctccagaaaaatcctcagactcatcaccatcaggaaactcttcactgccattggggttctcttcccatccgtgatcctcgtgtccctgccctgggtcagatccagccacagcatgaccatgaccttcttggtgctgtcttctgccatcagcagcttctgtgaatcaggagcccttgttaacttcttggatattgctcctcggtacactggctttctcaaaggactattgcaagtctttgcacacatagctggagccatctctcctactgctgctggatttttcatcagtcaggattcagagtttggttggagaaatgtcttcttgctttcagctgctgttaacatatcgggcctggttttctacctcatctttggccgagcagatgtgcaggactgggctaaggagcagacattcacccacctctgagcaaaccgagagatgtgctagatcctggtgcttagttcatcattgttttccctcacagacatttctctttcatgcctgcttgactgataagccattagctagaccctgactatgtaacgctaaagattttaccatgcctggaaattttacaggggaagaaaacacgctagttatttaactgcaagctactaaaagcataggtgtgttgagatttctgtgttctccactcttccactgttatcctagtaaaagcatcaggggctggggacaatttctttccaaagcaaaagaggaagccagaccttgggaccgagaactgagaatcacaagggagttgcgcccaacatgcagaacatgaatcctctgagctgtcctcaaaagaaagccccaaacaacagaaagcatagtgttttccattgttggtgaaaaatgtcaaggaggaaagaacaataatgattccatcatgataagaggaatgaacgtgtctgcaactaatgggagcaagatagtacactttaactctttcagacaacttgcattctgtggatgccagctttggaatcagagccgcctctggaatacctgtgcttccagagttagcttttggacagttaccttctttctggccatcttgacttctgccccacatctgctttttggctttgtgcagatctttaacatgttagtgaacagacattgcccagtgtctcttctagcccctccaacagttcttcatgtagcactgcttttggacagtgacccatgatatctgccttcgtttgcccctctgactgttggaatcccacgcaccattcagtaggattcaattcaatgtggaaccattcaacattcacctcattaacctaaaatgtctcccaaagatgtatgtaagacacacactgccctaacctcacttcaaatgtctggagaaatgtgtgtagtgcttttgttaaagcccctatatgggcagcatggaggatcataagatagcaaaaccatttcaacactaaatgaatattaatgt

SEQ ID NO: 55969 - DNA, 1921 bp, Homo sapiens
ctgatttcaaaccactccttttcaaagatctctgagggagacattgcacctggccactgcagcccagagcaggtctggccacggccatgagcatgctgagccatcatgcccaccgtggatgacattctggagcaggttggggagtctggctggttccagaagcaagccttcctcatcttatgcctgctgtcggctgcctttgcgcccatctgtgtgggcatcgtcttcctgggtttcacacctgaccaccactgccagagtcctggggtggctgagctgagccagcgctgtggctggagccctgcggaggagctgaactatacagtgccaggcctggggcccgcgggcgaggccttccttggccagtgcaggcgctatgaagtggactggaaccagagcgccctcagctgtgtagaccccctggctagcctggccaccaacaggagccacctgccgctgggtccctgccaggatggctgggtgtatgacacgcccggctcttccatcgtcactgagttcaacctggtgtgtgctgactcctggaagctggacctctttcagtcctgtttgaatgcgggcttcttgtttggctctctcggtgttggctactttgcagacaggtttggccgtaagctgtgtctcctgggaactgtgctggtcaacgcggtgtcgggcgtgctcatggccttctcgcccaactacatgtccatgctgctcttccgcctgctgcagggcctggtcagcaagggcaactggatggctggctacaccctaatcacagaatttgttggctcgggctccagaagaacggtggcgatcatgtaccagatggccttcacggtggggctggtggcgcttaccgggctggcctacgccctgcctcactggcgctggctgcagctggcagtctccctgcccaccttcctcttcctgctctactactggtgtgtgccggagtcccctcggtggctgttatcacaaaaaagaaacactgaagcaataaagataatggaccacatcgctcaaaagaatgggaagttgcctcctgctgatttaaagatgctttccctcgaagaggatgtcaccgaaaagctgagcccttcatttgcagacctgttccgcacgccgcgcctgaggaagcgcaccttcatcctgatgtacctgtggttcacggactctgtgctctatcaggggctcatcctgcacatgggcgccaccagcgggaacctctacctggatttcctttactccgctctggtcgaaatcccgggggccttcatagccctcatcaccattgaccgcgtgggccgcatctaccccatggccatgtcaaatttgttggcgggggcagcctgcctcgtcatgatttttatctcacctgacctgcactggttaaacatcataatcatgtgtgttggccgaatgggaatcaccattgcaatacaaatgatctgcctggtgaatgctgagctgtaccccacattcgtcaggaacctcggagtgatggtgtgttcctccctgtgtgacataggtgggataatcacccccttcatagtcttcaggctgagggaggtctggcaagccttgcccctcattttgtttgcggtgttgggcctgcttgccgcgggagtgacgctacttcttccagagaccaagggggtcgctttgccagagaccatgaaggacgccgagaaccttgggagaaaagcaaagcccaaagaaaacacgatttaccttaaggtccaaacctcagaaccctcgggcacctgagagagatgttttgcggcgatgtcgtgttggagggatgaagatggagttatcctctgcagaaattcctagacgccttcacttctctgtattcttcctcatacttgcctacccccaaattaatatcagtcctaaagaaaaaaaaaaaaaaaaa

SEQ ID NO: 55970 - DNA, 1808 bp, Homo sapiens
ctgatttcaaaccactccttttcaaagatctctgagggagacattgcacctggccactgcagcccagagcaggtctggccacggccatgagcatgctgagccatcatgcccaccgtggatgacattctggagcaggttggggagtctggctggttccagaagcaagccttcctcatcttatgcctgctgtcggctgcctttgcgcccatctgtgtgggcatcgtcttcctgggtttcacacctgaccaccactgccagagtcctggggtggctgagctgagccagcgctgtggctggagccctgcggaggagctgaactatacagtgccaggcctggggcccgcgggcgaggccttccttggccagtgcaggcgctatgaagtggactggaaccagagcgccctcagctgtgtagaccccctggctagcctggccaccaacaggagccacctgccgctgggtccctgccaggatggctgggtgtatgacacgcccggctcttccatcgtcactgagttcaacctggtgtgtgctgactcctggaagctggacctctttcagtcctgtttgaatgcgggcttcttgtttggctctctcggtgttggctactttgcagacaggtttggccgtaagctgtgtctcctgggaactgtgctggtcaacgcggtgtcgggcgtgctcatggccttctcgcccaactacatgtccatgctgctcttccgcctgctgcagggcctggtcagcaagggcaactggatggctggctacaccctaatcacagaatttgttggctcgggctccagaagaacggtggcgatcatgtaccagatggccttcacggtggggctggtggcgcttaccgggctggcctacgccctgcctcactggcgctggctgcagctggcagtctccctgcccaccttcctcttcctgctctactactggtgtgtgccggagtcccctcggtggctgttatcacaaaaaagaaacactgaagcaataaagataatggaccacatcgctcaaaagaatgggaagttgcctcctgctgatttaaagatgctttccctcgaagaggatgtcaccgaaaagctgagcccttcatttgcagacctgttccgcacgccgcgcctgaggaagcgcaccttcatcctgatgtacctgtggttcacggactctgtgctctatcaggggctcatcctgcacatgggcgccaccagcgggaacctctacctggatttcctttactccgctctggtcgaaatcccgggggccttcatagccctcatcaccattgaccgcgtgggccgcatctaccccatggccatgtcaaatttgttggcgggggcagcctgcctcgtcatgatttttatctcacctgacctgcactggttaaacatcataatcatgtgtgttggccgaatgggaatcaccattgcaatacaaatgatctgcctggtgaatgctgagctgtaccccacattcgtcagcggtgttgggcctgcttgccgcgggagtgacgctacttcttccagagaccaagggggtcgctttgccagagaccatgaaggacgccgagaaccttgggagaaaagcaaagcccaaagaaaacacgatttaccttaaggtccaaacctcagaaccctcgggcacctgagagagatgttttgcggcgatgtcgtgttggagggatgaagatggagttatcctctgcagaaattcctagacgccttcacttctctgtattcttcctcatacttgcctacccccaaattaatatcagtcctaaagaaaaaaaaaaaaaaaaa

SEQ ID NO: 55971 - DNA, 2547 bp, Homo sapiens
ccacctccagagtccaagggtctatgtggtgggcagtttgagctggctggatactagagggaggctgcacctgaagcatttggtgggtgagcagcatgggctttgaggagctgctggagcaggtgggcggctttgggcccttccaactgcggaatgtggcactgctggccctgccccgagtgctgctaccactgcacttcctcctgcccatcttcctggctgccgtgcctgcccaccgatgtgccctgccgggtgcccctgccaacttcagccatcaggatgtgtggctggaggcccatcttccccgggagcctgatggcacgctcagctcctgcctccgctttgcctatccccaggctctccccaacaccacgttgggggaagaaaggcagagccgtggggagctggaggatgaacctgccacagtgccctgctctcagggctgggagtacgaccactcagaattctcctctaccattgcaactgagtgggatctggtgtgtgagcagaaaggtctgaacagagctgcgtccactttcttcttcgccggtgtgctggtgggggctgtggcctttggatatctgtccgacaggtttgggcggcggcgtctgctgctggtagcctacgtgagtaccctggtgctgggcctggcatctgcagcctccgtcagctatgtaatgtttgccatcacccgcacccttactggctcagccctggctggttttaccatcatcgtgatgccactggagctggagtggctggatgtggagcaccgcaccgtggctggagtcctgagcagcaccttctggacagggggcgtgatgctgctggcactggttgggtacctgatacgggactggcgatggcttctgctagctgtcaccctgccttgtgccccaggcatcctcagcctctggtgggtgcctgagtctgcacgctggcttctgacccaaggccatgtgaaagaggcccacaggtacttgctccactgtgccaggctcaatgggcggccagtgtgtgaggacagcttcagccaggaggctgtgagcaaagtggccgccggggaacgggtggtccgaagaccttcatacctagacctgttccgcacaccacggctccgacacatctcactgtgctgcgtggtggtgtggttcggagtgaacttctcctattacggcctgagtctggatgtgtcggggctggggctgaacgtgtaccagacacagctgttgttcggggctgtggaactgccctccaagctgctggtctacttgtcggtgcgctacgcaggacgccgcctcacgcaagccgggacactgctgggcacggccctggcgttcggcactagactgctagtgtcctccgatatgaagtcctggagcactgtcctggcagtgatggggaaagctttttctgaagctgccttcaccactgcctacctgttcacttcagagttgtaccctacggtgctcagacagacagggatggggctgactgcactggtgggccggctggggggctctttggccccactggcggccttgctggatggagtgtggctgtcactgcccaagcttacttatggggggatcgccctgctggctgccggcaccgccctcctgctgccagagacgaggcaggcacagctgccagagaccatccaggacgtggagagaaagagtgccccaaccagtcttcaggaggaagagatgcccatgaagcaggtccagaactaagtgggagtggaggcaggccctccacagaagctctgcagcaggggctgggagagcagaagggcaggccctgcaactcaggctgggagtatcgaaccctctgcctagggccggagttgctgccagtacccgctccctctgctcatccatccttgattatttggcttctaggaacagttgacttcccagaatgcagtgggctgctgggcacccctctcacggttggggaggattctgtaaataaaggtgccccttgggttggggcagtggtgacgagctgtgggaagagccctggataggaagccactgagtctgccctgggctctgataaaaccttcaccattaacttgctgtgtgaccttgggcatgtggctttccctctctgggcctcagtctgttcatctcccaaatggataatgaagcctcttgggaggccctaccataggatctgttgccatgctcaaatgagttactgaataaggtgcttctgcttcttctagagatggtgctaaagaaaggactagcatatgagacttctggtaccaatggggctggtgggcatgctgtccactgtgtggtgctaggactgccaatgccaggcccaagggacaaaaagaacagagctttttgttctcatggctggccctgctacctccgaggcaccctgcagggcaatgcatgtcatcccaacccccacactccccatcctccaacccactggtctcatgcccaaagaagagttgaaggcatgggagccaacattttattgaagaagccacagaggctgaaattcaataaacacaagttttatgag

SEQ ID NO: 55972 - DNA, 2845 bp, Homo sapiens
ccacctccagagtccaagggtctatgtggtgggcagtttgagctggctggatactagagggaggctgcacctgaagcatttggtgggtgagcagcatgggctttgaggagctgctggagcaggtgggcggctttgggcccttccaactgcggaatgtggcactgctggccctgccccgagtgctgctaccactgcacttcctcctgcccatcttcctggctgccgtgcctgcccaccgatgtgccctgccgggtgcccctgccaacttcagccatcaggatgtgtggctggaggcccatcttccccgggagcctgatggcacgctcagctcctgcctccgctttgcctatccccaggctctccccaacaccacgttgggggaagaaaggcagagccgtggggagctggaggatgaacctgccacagtgccctgctctcagggctgggagtacgaccactcagaattctcctctaccattgcaactgagtcccaggtcggtatttacataatccatctggaggtggaatgtcggtggaggcagtctccctgggaggcagcaggtcgaggccttccttgggaagaagctgaggctgcaggactggggagggacaaagtttcctattccccaagctggcgtgaatcgttgggaggtttattatctggcatggaggtaccagaatggcagagttcgcctcagaaggctccagggtctggagaggaggagctggtgcctgctggagaggggctgatgttcataggaggtccctttctgcctgtccttgcagtgggatctggtgtgtgagcagaaaggtctgaacagagctgcgtccactttcttcttcgccggtgtgctggtgggggctgtggcctttggatatctgtccgacaggtttgggcggcggcgtctgctgctggtagcctacgtgagtaccctggtgctgggcctggcatctgcagcctccgtcagctatgtaatgtttgccatcacccgcacccttactggctcagccctggctggttttaccatcatcgtgatgccactggagctggagtggctggatgtggagcaccgcaccgtggctggagtcctgagcagcaccttctggacagggggcgtgatgctgctggcactggttgggtacctgatacgggactggcgatggcttctgctagctgtcaccctgccttgtgccccaggcatcctcagcctctggtgggtgcctgagtctgcacgctggcttctgacccaaggccatgtgaaagaggcccacaggtacttgctccactgtgccaggctcaatgggcggccagtgtgtgaggacagcttcagccaggaggctgtgagcaaagtggccgccggggaacgggtggtccgaagaccttcatacctagacctgttccgcacaccacggctccgacacatctcactgtgctgcgtggtggtgtggttcggagtgaacttctcctattacggcctgagtctggatgtgtcggggctggggctgaacgtgtaccagacacagctgttgttcggggctgtggaactgccctccaagctgctggtctacttgtcggtgcgctacgcaggacgccgcctcacgcaagccgggacactgctgggcacggccctggcgttcggcactagactgctagtgtcctccgatatgaagtcctggagcactgtcctggcagtgatggggaaagctttttctgaagctgccttcaccactgcctacctgttcacttcagagttgtaccctacggtgctcagacagacagggatggggctgactgcactggtgggccggctggggggctctttggccccactggcggccttgctggatggagtgtggctgtcactgcccaagcttacttatggggggatcgccctgctggctgccggcaccgccctcctgctgccagagacgaggcaggcacagctgccagagaccatccaggacgtggagagaaagagtgccccaaccagtcttcaggaggaagagatgcccatgaagcaggtccagaactaagtgggagtggaggcaggccctccacagaagctctgcagcaggggctgggagagcagaagggcaggccctgcaactcaggctgggagtatcgaaccctctgcctagggccggagttgctgccagtacccgctccctctgctcatccatccttgattatttggcttctaggaacagttgacttcccagaatgcagtgggctgctgggcacccctctcacggttggggaggattctgtaaataaaggtgccccttgggttggggcagtggtgacgagctgtgggaagagccctggataggaagccactgagtctgccctgggctctgataaaaccttcaccattaacttgctgtgtgaccttgggcatgtggctttccctctctgggcctcagtctgttcatctcccaaatggataatgaagcctcttgggaggccctaccataggatctgttgccatgctcaaatgagttactgaataaggtgcttctgcttcttctagagatggtgctaaagaaaggactagcatatgagacttctggtaccaatggggctggtgggcatgctgtccactgtgtggtgctaggactgccaatgccaggcccaagggacaaaaagaacagagctttttgttctcatggctggccctgctacctccgaggcaccctgcagggcaatgcatgtcatcccaacccccacactccccatcctccaacccactggtctcatgcccaaagaagagttgaaggcatgggagccaacattttattgaagaagccacagaggctgaaattcaataaacacaagttttatgag

SEQ ID NO: 55973 - DNA, 2327 bp, Homo sapiens
acatttcattgtaaacgactgggagtatctgagcaaattatttcttacgtgactttagagaaaacggctacctatctgaccccaaaacgacttgaggaaactgtttccacggtcctgctgcagaggggaagcacagtcgtcaagaagagagtggggtcaggatcaaaacacatttagtgtgacttagggaaagaaaacattttccctctttgaacctctctggatacagtcattttgcctctacttgaggatcaactgttcaacctcaatggcctttcaggacctcctgggtcacgctggtgacctgtggagattccagatccttcagactgtttttctctcaatctttgctgttgctacataccttcattttatgctggagaacttcactgcattcatacctggccatcgctgctgggtccacatcctggacaatgacactgtctctgacaatgacactggggccctcagccaagatgcactcttgagaatctccatcccactggactcaaacatgaggccagagaagtgtcgtcgctttgttcatcctcagtggcagctccttcacctgaatgggaccttccccaacacaagtgacgcagacatggagccctgtgtggatggctgggtgtatgacagaatctccttctcatccaccatcgtgactgagtgggatctggtatgtgactctcaatcactgacttcagtggctaaatttgtattcatggctggaatgatggtgggaggcatcctaggcggtcatttatcagacaggtttgggagaaggttcgtgctcagatggtgttacctccaggttgccattgttggcacctgtgcagccttggctcccaccttcctcatttactgctcactacgcttcttgtctgggattgctgcaatgagcctcataacaaatactattatgttaatagccgagtgggcaacacacagattccaggccatgggaattacattgggaatgtgcccttctggtattgcatttatgaccctggcaggcctggcttttgccattcgagactggcatatcctccagctggtggtgtctgtaccatactttgtgatctttctgacctcaagttggctgctagagtctgctcggtggctcattatcaacaataaaccagaggaaggcttaaaggaacttagaaaagctgcacacaggagtggaatgaagaatgccagagacaccctaaccctggagattttgaaatccaccatgaaaaaagaactggaggcagcacaaaaaaaaaaaccttctctgtgtgaaatgctccacatgcccaacatatgtaaaaggatctccctcctgtcctttacgagatttgcaaactttatggcctattttggccttaatctccatgtccagcatctggggaacaatgttttcctgttgcagactctctttggtgcagtcatcctcctggccaactgtgttgcaccttgggcactgaaatacatgaaccgtcgagcaagccagatgcttctcatgttcctactggcaatctgccttctggccatcatatttgtgccacaagaaatgcagacgctgcgtgaggttttggcaacactgggcttaggagcgtctgctcttgccaatacccttgcttttgcccatggaaatgaagtaattcccaccataatcagggcaagagctatggggatcaatgcaacctttgctaatatagcaggagccctggctcccctcatgatgatcctaagtgtgtattctccacccctgccctggatcatctatggagtcttccccttcatctctggctttgctttcctcctccttcctgaaaccaggaacaagcctctgtttgacaccatccaggatgagaaaaatgagagaaaagaccccagagaaccaaagcaagaggatccgagagtggaagtgacgcagttttaaggaattccaggagctgactgccgatcaatgagccagatgaagggaacaatcaggactattcctagacactagcaaaatctagaaaataaataacaaggctgggtgcggtggctcacgcctgtaatcccagcaccttgggaggctgaggcgggcagatcatgaggtcagaagataaagaccaccctggccaacatggtgaaaccctgtctctactaaaacaaatacaaaacttcgctgggcacagtggcacaggcctttaattccagctacttgggaggctgaggcaggagaattacttgaacccaggaggtggaaattgcaatgagccaagattgggccactgcattccagcctggtgacagagcgagactgtctcaaaaaaaaaaaaaaaaaaaaa

SEQ ID NO: 55974 - DNA, 3405 bp, Homo sapiens
gctgctcgcgggagccagagggccctgcggtcctcggtggtcttgccagcccctcgtcatcccagggccctccgcgcctgtgaggactccctcaggtcggccacgggacctgacgcaacaggatggacgagtcccctgagcctctgcagcagggcagagggccggtgccggtccgacggcagcgcccagcaccccggggtctgcgtgagatgctgaaggccaggctgtggtgcagctgctcgtgcagtgtgctgtgcgtccgggcgctggtgcaggacctgctccccgccacgcgctggctgcgtcagtaccgcccgcgggagtacctggcaggcgacgtcatgtctgggctggtcatcggcatcatcctggtgccgcaggccatcgcctactcattgctggccgggctgcagcccatctacagcctctatacgtccttcttcgccaacctcatctacttcctcatgggcacctcacggcatgtctccgtgggcatcttcagcctgctttgcctcatggtggggcaggtggtggaccgggagctccagctggccggctttgacccctcccaggacggcctgcagcccggagccaacagcagcaccctcaacggctcggctgccatgctggactgcgggcgtgactgctacgccatccgtgtcgccaccgccctcacgctgatgaccgggctttaccaggtcctcatgggcgtcctccggctgggcttcgtgtccgcctacctctcacagccactgctcgatggctttgccatgggggcctccgtgaccatcctgacctcgcagctcaaacacctgctgggcgtgcggatcccgcggcaccaggggcccggcatggtggtcctcacatggctgagcctgctgcgcggcgccgggcaggccaacgtgtgcgacgtggtcaccagcacggtgtgcctggcggtgctgctagccgcgaaggagctctcagaccgctaccgacaccgcctgagggtgccgctgcccacggagctgctggtcatcgtggtggccacactcgtgtcgcacttcgggcagctccacaagcgctttggctcgagcgtggctggcgacatccccacgggtttcatgccccctcaggtcccagagcccaggctgatgcagcgtgtggctttggatgccgtggccctggccctcgtggctgccgccttctccatctcgctggcggagatgttcgcccgcagtcacggctactctgtgcgtgccaaccaggagctgctggctgtgggctgctgcaacgtgctacccgccttcctccactgcttcgccaccagcgccgccctggccaagagcctggtgaagacagccactggctgccggacacagctgtccagcgtggtcagcgccaccgtggtgctgctggtgctgctggcgctggcaccgctgttccacgacctacagcgaagcgtgctggcctgcgtcatcgtggtcagcctgcggggggccctgcgcaaggtgtgggacctcccgcggctgtggcggatgagcccggctgacgcgctggtctgggcaggcaccgcggccacctgtatgctggtcagcacagaggccgggctgctggctggcgtcatcctctcgctgctcagcctggccggccgcacccaacgcccacgcaccgccctgctggcccgcatcggggacacggccttctacgaggatgccacagagttcgagggcctcgtccctgagcccggcgtgcgggtgttccgctttggggggccgctgtactatgccaacaaggacttcttcctgcagtcactctacagcctcacggggctggacgcagggtgcatggctgccaggaggaaggaggggggctcagagacgggggtcggtgagggaggccctgcccagggcgaggacctgggcccggttagcaccagggctgcgctggtgcccgcagcggccggcttccacacagtggtcatcgactgcgccccgctgctgttcctagacgcagccggtgtgagcacgctgcaggacctgcgccgagactacggggccctgggcatcagcctgctgctagcctgctgcagcccgcctgtgagagacattctgagcagaggaggcttcctcggggagggccccggggacacggctgaggaggagcagctgttcctcagtgtgcacgatgccgtgcagacagcacgagcccgccacagggagctggaggccaccgatgcccatctgtagcagggccaggcctgcccagcagcctctgctccctcctggggacccacagcagacgtctgcaagccactgctgagacccttcccagggaggagccacccaagagctgcactcttgtgccacagctgccctggggaaaccggggaaccccaactgggaaaggaggccctctgatcacacgcaggacccaaacactcagaaatcaagaacctctgcctccgagacaggctggcccacagtgctggctgggccccaatgcaccgtccctcagctcaggagggatgggcctgacctgacgctcagggttgacatcttatttgaacaagggtcccccgccatcatgcagcctccaaggtgccaagaggactccctatgcccaggcctgcccggtgcccaccctgctggtaggagccagcggctctggccaagtgcacgagggtctctgtgtttccagaaggccccacacacccaagtgcccctcacacctcgtgcctccccctcacagggtggccacctgcaccagcgtcagggcccagggtgctgtgaccgatgagacctcagctcagccctcaggtgcagtggccctacccagcctggccagcagacacacacagggatgctcacgggtgcaccaggagccaggtgcggcgcagccaaccctgagcctgcagggagacctgcaggaagcccaccgtgccccatgcaggggctccctccagcacacagccctcaccccagcacagccagcaaggacacgctctccccaacagggtgcttcggcgggaggtgggggaacaaggggtcttccgagcagcccccagccctcccctcccatctgtgcctctgtaaggggctctgggacgcccagaccctgcccgccgcccacctggtggtgacaagctccagcagccagtgggtccggacctgcttgatgccgcggtgagggacggcgcccacataggcgaggttgagctgctggtcccagctgaggacgtactggtcagcctggctgtgtggcagcggggggctggggacaacaaaggggcggctcagtcccgagcctcagcatggctggcagcgcggctgacacacacgttcaagcccaggactgcccgggcgcaggatccaggcgctgcccgtgcgttcagtgactaataaaatgacccttagggccaggaaa

SEQ ID NO: 55975 - DNA, 3673 bp, Homo sapiens
accactgcctgcaggttggcgccaccacccccactctccccgctgctcgcgggagccagagggccctgcggtcctcggtggtcttgccagcccctcgtcatcccagggccctccgcgcctgtgaggactccctcagcgtgcaaacagcaggctcagcccaggctccagggtgtcctgggcacctggtgtcctgggagcaaagtctttgcctaacgtcgctgagaagaatgtttaaagtgaaagtacattggagtctgcaaacaggacagacccgaggcctcacgtgggaccagtcaggcctctaagcaccgcctccctaacgccacggtgttttccgagatcaagggaaaggtcggccacgggacctgacgcaacaggatggacgagtcccctgagcctctgcagcagggcagagggccggtgccggtccgacggcagcgcccagcaccccggggtctgcgtgagatgctgaaggccaggctgtggtgcagctgctcgtgcagtgtgctgtgcgtccgggcgctggtgcaggacctgctccccgccacgcgctggctgcgtcagtaccgcccgcgggagtacctggcaggcgacgtcatgtctgggctggtcatcggcatcatcctggtgccgcaggccatcgcctactcattgctggccgggctgcagcccatctacagcctctatacgtccttcttcgccaacctcatctacttcctcatgggcacctcacggcatgtctccgtgggcatcttcagcctgctttgcctcatggtggggcaggtggtggaccgggagctccagctggccggctttgacccctcccaggacggcctgcagcccggagccaacagcagcaccctcaacggctcggctgccatgctggactgcgggcgtgactgctacgccatccgtgtcgccaccgccctcacgctgatgaccgggctttaccaggtcctcatgggcgtcctccggctgggcttcgtgtccgcctacctctcacagccactgctcgatggctttgccatgggggcctccgtgaccatcctgacctcgcagctcaaacacctgctgggcgtgcggatcccgcggcaccaggggcccggcatggtggtcctcacatggctgagcctgctgcgcggcgccgggcaggccaacgtgtgcgacgtggtcaccagcacggtgtgcctggcggtgctgctagccgcgaaggagctctcagaccgctaccgacaccgcctgagggtgccgctgcccacggagctgctggtcatcgtggtggccacactcgtgtcgcacttcgggcagctccacaagcgctttggctcgagcgtggctggcgacatccccacgggtttcatgccccctcaggtcccagagcccaggctgatgcagcgtgtggctttggatgccgtggccctggccctcgtggctgccgccttctccatctcgctggcggagatgttcgcccgcagtcacggctactctgtgcgtgccaaccaggagctgctggctgtgggctgctgcaacgtgctacccgccttcctccactgcttcgccaccagcgccgccctggccaagagcctggtgaagacagccactggctgccggacacagctgtccagcgtggtcagcgccaccgtggtgctgctggtgctgctggcgctggcaccgctgttccacgacctacagcgaagcgtgctggcctgcgtcatcgtggtcagcctgcggggggccctgcgcaaggtgtgggacctcccgcggctgtggcggatgagcccggctgacgcgctggtctgggcaggcaccgcggccacctgtatgctggtcagcacagaggccgggctgctggctggcgtcatcctctcgctgctcagcctggccggccgcacccaacgcccacgcaccgccctgctggcccgcatcggggacacggccttctacgaggatgccacagagttcgagggcctcgtccctgagcccggcgtgcgggtgttccgctttggggggccgctgtactatgccaacaaggacttcttcctgcagtcactctacagcctcacggggctggacgcagggtgcatggctgccaggaggaaggaggggggctcagagacgggggtcggtgagggaggccctgcccagggcgaggacctgggcccggttagcaccagggctgcgctggtgcccgcagcggccggcttccacacagtggtcatcgactgcgccccgctgctgttcctagacgcagccggtgtgagcacgctgcaggacctgcgccgagactacggggccctgggcatcagcctgctgctagcctgctgcagcccgcctgtgagagacattctgagcagaggaggcttcctcggggagggccccggggacacggctgaggaggagcagctgttcctcagtgtgcacgatgccgtgcagacagcacgagcccgccacagggagctggaggccaccgatgcccatctgtagcagggccaggcctgcccagcagcctctgctccctcctggggacccacagcagacgtctgcaagccactgctgagacccttcccagggaggagccacccaagagctgcactcttgtgccacagctgccctggggaaaccggggaaccccaactgggaaaggaggccctctgatcacacgcaggacccaaacactcagaaatcaagaacctctgcctccgagacaggctggcccacagtgctggctgggccccaatgcaccgtccctcagctcaggagggatgggcctgacctgacgctcagggttgacatcttatttgaacaagggtcccccgccatcatgcagcctccaaggtgccaagaggactccctatgcccaggcctgcccggtgcccaccctgctggtaggagccagcggctctggccaagtgcacgagggtctctgtgtttccagaaggccccacacacccaagtgcccctcacacctcgtgcctccccctcacagggtggccacctgcaccagcgtcagggcccagggtgctgtgaccgatgagacctcagctcagccctcaggtgcagtggccctacccagcctggccagcagacacacacagggatgctcacgggtgcaccaggagccaggtgcggcgcagccaaccctgagcctgcagggagacctgcaggaagcccaccgtgccccatgcaggggctccctccagcacacagccctcaccccagcacagccagcaaggacacgctctccccaacagggtgcttcggcgggaggtgggggaacaaggggtcttccgagcagcccccagccctcccctcccatctgtgcctctgtaaggggctctgggacgcccagaccctgcccgccgcccacctggtggtgacaagctccagcagccagtgggtccggacctgcttgatgccgcggtgagggacggcgcccacataggcgaggttgagctgctggtcccagctgaggacgtactggtcagcctggctgtgtggcagcggggggctggggacaacaaaggggcggctcagtcccgagcctcagcatggctggcagcgcggctgacacacacgttcaagcccaggactgcccgggcgcaggatccaggcgctgcccgtgcgttcagtgactaataaaatgacccttagggccaggaaaaaaaaaaaaaaa

SEQ ID NO: 55976 - DNA, 2343 bp, Homo sapiens
atacgactacacctgctccggagcccgcggcggtacctgcagcggaggagctctgtcttccccttcatctcacgcgagcccggcgtcccgccgcgtgcgccccggcgcagcccgccagtccgcccggagcccgcccagtcgccgcgctgcacgcccggggtgaaccctctgccctcgctgggacagagggccccgcagccgtcatgctttccgccatctacacagtcctggcgggactgctgttcctgccgctcctggtgaacctctgctgcccatacttcttccaggacataggctacttcttgaaggtggccgccgtgggccggagggtgcgcagctacgggcagcggcggccggcgcgcaccatcctgcgggcgttcctggagaaagcgcgccagacgccacacaagccttttctgctcttccgcgacgagactctcacctacgcgcaggtggaccggcgcagcaatcaagtggcccgggcgctgcacgaccacctcggcctgcgccagggagactgcgtggcgctccttatgggtaacgagccggcctacgtgtggctgtggctggggctggtgaagctgggctgtgccatggcgtgcctcaattacaacatccgcgcgaagtccctgctgcactgcttccagtgctgcggggcgaaggtgctgctggtgtcgccagaactacaagcagctgtcgaagagatactgccaagccttaaaaaagatgatgtgtccatctattatgtgagcagaacttctaacacagatgggattgactctttcctggacaaagtggatgaagtatcaactgaacctatcccagagtcatggaggtctgaagtcactttttccactcctgccttatacatttatacttctggaaccacaggtcttccaaaagcagccatgatcactcatcagcgcatatggtatggaactggcctcacttttgtaagcggattgaaggcagatgatgtcatctatatcactctgcccttttaccacagtgctgcactactgattggcattcacggatgtattgtggctggtgctactcttgccttgcggactaaattttcagccagccagttttgggatgactgcagaaaatacaacgtcactgtcattcagtatatcggtgaactgcttcggtatttatgcaactcaccacagaaaccaaatgaccgtgatcataaagtgagactggcactgggaaatggcttacgaggagatgtgtggagacaatttgtcaagagatttggggacatatgcatctatgagttctatgctgccactgaaggcaatattggatttatgaattatgcgagaaaagttggtgctgttggaagagtaaactacctacagaaaaaaatcataacttatgacctgattaaatatgatgtggagaaagatgaacctgtccgtgatgaaaatggatattgcgtcagagttcccaaaggtgaagttggacttctggtttgcaaaatcacacaacttacaccatttaatggctatgctggagcaaaggctcagacagagaagaaaaaactgagagatgtctttaagaaaggagacctctatttcaacagtggagatctcttaatggttgaccatgaaaatttcatctatttccacgacagagttggagatacattccggtggaaaggggaaaatgtggccaccactgaagttgctgatacagttggactggttgattttgtccaagaagtaaatgtttatggagtgcatgtgccagatcatgagggtcgcattggcatggcctccatcaaaatgaaagaaaaccatgaatttgatggaaagaaactctttcagcacattgctgattacctacctagttatgcaaggccccggtttctaagaatacaggacaccattgagatcactggaacttttaaacaccgcaaaatgaccctggtggaggagggctttaaccctgctgtcatcaaagatgccttgtatttcttggatgacacagcaaaaatgtatgtgcctatgactgaggacatctataatgccataagtgctaaaaccctgaaactctgaatattcccaggaggataactcaacatttccagaaagaaactgaatggacagccacttgatataatccaactttaatttgattgaagattgtgaggaaattttgtaggaaatttgcatacccgtaaagggagacttttttaaataacagttgagtctttgcaagtaaaaagatttagagattattatttttcagtgtgcacctactgtttgtatttgcaaactgagcttgttggagggaaggcattattttttaaaatacttagtaaattaaatgaac

SEQ ID NO: 55977 - DNA, 2830 bp, Homo sapiens
cggacgcgtgggcggacgcgtgggtcgcccacgcgtccgacttgttgcagttgctgtaggattctaaatccaggtgattgtttcaaactgagcatcaacaacaaaaacatttgtatgatatctatatttcaatcatggaccaaaatcaacatttgaataaaacagcagaggcacaaccttcagagaataagaaaacaagatactgcaatggattgaagatgttcttggcagctctgtcactcagctttattgctaagacactaggtgcaattattatgaaaagttccatcattcatatagaacggagatttgagatatcctcttctcttgttggttttattgacggaagctttgaaattggaaatttgcttgtgattgtatttgtgagttactttggatccaaactacatagaccaaagttaattggaatcggttgtttcattatgggaattggaggtgttttgactgctttgccacatttcttcatgggatattacaggtattctaaagaaactaatatcgattcatcagaaaattcaacatcgaccttatccacttgtttaattaatcaaattttatcactcaatagagcatcacctgagatagtgggaaaaggttgtttaaaggaatctgggtcatacatgtggatatatgtgttcatgggtaatatgcttcgtggaataggggagactcccatagtaccattggggctttcttacattgatgatttcgctaaagaaggacattcttctttgtatttaggtatattgaatgcaatagcaatgattggtccaatcattggctttaccctgggatctctgttttctaaaatgtacgtggatattggatatgtagatctaagcactatcaggataactcctactgattctcgatgggttggagcttggtggcttaatttccttgtgtctggactattctccattatttcttccataccattctttttcttgccccaaactccaaataaaccacaaaaagaaagaaaagcttcactgtctttgcatgtgctggaaacaaatgatgaaaaggatcaaacagctaatttgaccaatcaaggaaaaaatattaccaaaaatgtgactggttttttccagtcttttaaaagcatccttactaatcccctgtatgttatgtttgtgcttttgacgttgttacaagtaagcagctatattggtgcttttacttatgtcttcaaatacgtagagcaacagtatggtcagccttcatctaaggctaacatcttattgggagtcataaccatacctatttttgcaagtggaatgtttttaggaggatatatcattaaaaaattcaaactgaacaccgttggaattgccaaattctcatgttttactgctgtgatgtcattgtccttttacctattatattttttcatactctgtgaaaacaaatcagttgccggactaaccatgacctatgatggaaataatccagtgacatctcatagagatgtaccactttcttattgcaactcagactgcaattgtgatgaaagtcaatgggaaccagtctgtggaaacaatggaataacttacatctcaccctgtctagcaggttgcaaatcttcaagtggcaataaaaagcctatagtgttttacaactgcagttgtttggaagtaactggtctccagaacagaaattactcagcccatttgggtgaatgcccaagagatgatgcttgtacaaggaaattttacttttttgttgcaatacaagtcttgaatttatttttctctgcacttggaggcacctcacatgtcatgctgattgttaaaattgttcaacctgaattgaaatcacttgcactgggtttccactcaatggttatacgagcactaggaggaattctagctccaatatattttggggctctgattgatacaacgtgtataaagtggtccaccaacaactgtggcacacgtgggtcatgtaggacatataattccacatcattttcaagggtctacttgggcttgtcttcaatgttaagagtctcatcacttgttttatatattatattaatttatgccatgaagaaaaaatatcaagagaaagatatcaatgcatcagaaaatggaagtgtcatggatgaagcaaacttagaatccttaaataaaaataaacattttgtcccttctgctggggcagatagtgaaacacattgttaaggggagaaaaaaagccacttctgcttctgtgtttccaaacagcattgcattgattcagtaagatgttatttttgaggagttcctggtcctttcactaagaatttccacatcttttatggtggaagtataaataagcctatgaacttataataaaacaaactgtaggtagaaaaaatgagagtactcattgttacattatagctacatatttgtggttaaggttagactatatgatccatacaaattaaagtgagagacatggttactgtgtaataaaagaaaaaatacttgttcaggtaattctaattcttaataaaacaaatgagtatcatacaggtagaggttaaaaaggaggagctagattcatatcctaagtaaagagaaatgcctagtgtctattttattaaacaaacaaacacagagtttgaactataatactaaggcctgaagtctagcttggatatatgctacaataatatctgttactcacataaaattatatatttcacagactttatcaatgtataattaacaattatcttgtttaagtaaatttagaatacatttaagtattgtggaagaaataaagacattccaatatttgcaaaaaaaaaaaaaaa

SEQ ID NO: 55978 - DNA, 1019 bp, Homo sapiens
agtgtttgataaagacagctcctcttaggaagaactgtcatccccaaacacatagagagacactctctgtctctcgattacaatcatgatttccagaatggagaagatgacgatgatgatgaagatattgattatgtttgctcttggaatgaactactggtcttgctcaggtttcccagtgtacgactacgatccatcctccttaagggatgccctcagtgcctctgtggtaaaagtgaattcccagtcactgagtccgtatctgtttcgggcattcagaagctcattaaaaagagttgaggtcctagatgagaacaacttggtcatgaatttagagttcagcatccgggagactacatgcaggaaggattctggagaagatcccgctacatgtgccttccagagggactactatgtgtccacagctgtttgcagaagcaccgtgaaggtatctgcccagcaggtgcagggcgtgcatgctcgctgcagctggtcctcctccacgtctgagtcttacagcagcgaagagatgatttttggggacatgttgggatctcataaatggagaaacaattatctatttggtctcatttcagacgagtccataagtgaacaattttatgatcggtcacttgggatcatgagaagggtattgcctcctggaaacagaaggtacccaaaccaccggcacagagcaagaataaatactgactttgagtaacggccttgaggtgtccctcgcccttttggtttgttcaaggagctgctgctttgcatagctgctctagtgtctggtatcatcggatctggttttgaataattcccaggagtcctgggtccctggcctccaaagctggaatgtgaacgcatgccacggtggtctgaccctcacactccttttctcttaacagcaaaatgcaatggaaggaagaaaagttccaacaaagaatgattttgtgaattctgtgatttttcttctgatcagtttcaatctgtaataaatgccttatttttcctgt

SEQ ID NO: 55979 - DNA, 2464 bp, Homo sapiens
tccataaaggggttgcgggggccgcgctctcttctgggagggcagcggccaccggcgaggaacacggcgcgatgcaggttcagtgccagcagagcccagtgctggcaggcagcgccactttggtcgcccttggggcactggccttgtacgtcgcgaagccctccggctacgggaagcacacggagagcctgaagccggcggctacccgcctgccagcccgcgccgcctggttcctgcaggagctgccttccttcgcggtgcccgcggggatcctcgcccggcagcccctctccctcttcgggccacctgggacggtacttctgggcctcttctgcctacattacttccacaggacatttgtgtactcactgctcaatcgagggaggccttatccagctatactcattctcagaggcactgccttctgcactggaaatggagtccttcaaggctactatctgatttactgtgctgaataccctgatgggtggtacacagacatacggtttagcttgggtgtcttcttatttattttgggaatgggaataaacattcatagtgactatatattgcgccagctcaggaagcctggagaaatcagctacaggattccacaaggtggcttgtttacgtatgtttctggagccaatttcctcggtgagatcattgaatggatcggctatgccctggccacttggtccctcccagcacttgcatttgcatttttctcactttgtttccttgggctgcgagcttttcaccaccataggttctacctcaagatgtttgaggactaccccaaatctcggaaagcccttattccattcatcttttaaaggaaccaaattaaaaaggagcagagctcccacaatgctgatgaaaactgtcaagctgctgaaactgtaattttcatgatataatagtcccgtatatatgtaatagtaggtatatatgtaatagtaggtctcctggcgttctgccagctggcctggggattctgagtggtgtctgcttagagtttactcctacccttccagggacccctatcctgatccccaactgaagcttcaaaaagccacttttccaaatggcgacagttgcttcttagctattgctctgagaaagtacaaacttctcctatgtctttcaccgggcaatccaagtacatgtggcttcatacccactccctgtcaatgcaggacaactctgtaatcaagaattttttgacttgaaggcagtacttatagaccttattaaaggtatgcattttatacatgtaacagagtagcagaaatttaaactctgaagccacaaagacccagagcaaacccactcccaaatgaaaaccccagtcatggcttcctttttcttggttaattaggaaagatgagaaattattaggtagaccttgaatacaggagccctctcctcatagtgctgaaaagatactgatgcattgacctcatttcaaatttgtgcagtgtcttagttgatgagtgcctctgttttccagaagatttcacaatccccggaaaactggtatggctattcttgaaggccaggttttaataaccacaaacaaaaaggcatgaacctgggtggcttatgagagagtagagaacaacatgaccctggatggctactaagaggatagagaacagttttacaatagacattgcaaactctcatgtttttggaaactagtggcaatatccaaataatgagtagtgtaaaacaaagagaattaatgatgaggttacatgctgcttgcctccaccagatgtccacaacaatatgaagtacagcagaagccccaagcaactttcctttcctggagcttcttccttgtagttctcaggacctgttcaagaaggtgtctcctaggggcagcctgaatgcctccctcaaaggacctgcaggcagagactgaaaattgcagacagaggggcacgtctgggcagaaaacctgttttgtttggctcagacatatagttttttttttttttacaaagtttcaaaaacttaaaaatcaggagattccttcataaaactctagcattctagtttcatttaaaaagttggaggatctgaacatacagagcccacatttccacaccagaactggaactacgtagctagtaagcatttgagtttgcaaactcttgtgaaggggtcaccccagcatgagtgctgagatatggactctctaaggaaggggccgaacgcttgtaattggaatacatggaaatatttgtcttctcaggcctatgtttgcggaatgcattgtcaatatttagcaaactgttttgacaaatgagcaccagtggtactaagcacagaaactcactatataagtcacataggaaacttgaaaggtctgaggatgatgtagattactgaaaaatgcaaattgcaatcatataaataagtgtttttgttgttcattaaatacctttaaatcatg

SEQ ID NO: 55980 - DNA, 1712 bp, Homo sapiens
aaggtcaatgatagcatctgcctagagtcaaacctccgtgcttctcagacagtgccttttcaccatgagtgggtgcccatttttaggaaacaactttggatatacttttaaaaaactccccgtagaaggcagcgaagaagacaaatcacaaactggtgtgaatagagccagcaaaggaggtcttatctatgggaactacctgcatttggaaaaagttttgaatgcacaagaactgcaaagtgaaacaaaaggaaataaaatccatgatgaacatctttttatcataactcatcaagcttatgaactctggtttaagcaaatcctctgggagttggattctgttcgagagatctttcagaatggccatgtcagagatgaaaggaacatgcttaaggttgtttctcggatgcaccgagtgtcagtgatcctgaaactgctggtgcagcagttttccattctggagacgatgacagccttggacttcaatgacttcagagagtacttatctccagcatcaggcttccagagtttgcaattccgactattagaaaacaagataggtgttcttcagaacatgagagtcccttataacagaagacattatcgtgataacttcaaaggagaagaaaatgaactgctacttaaatctgagcaggaaaagacacttctggaattagtggaggcatggctggaaagaactccaggtttagagccacatggatttaacttctggggaaagcttgaaaaaaatatcaccagaggcctggaagaggaattcataaggattcaggctaaagaagagtctgaagaaaaagaggaacaggtggctgaatttcagaagcaaaaagaggtgctactgtccttatttgatgagaaacgtcatgaacatctccttagtaaaggtgaaagacggctgtcatacagagcacttcagggagcattgatgatatatttttacagggaagagcctaggttccaggtgccttttcagttgctgacttctcttatggacatagattcactgatgaccaaatggagatataaccatgtgtgcatggtgcacagaatgctgggcagcaaagctggcaccggtggttcctcaggctatcactacctgcgatcaactgtgagtgataggtacaaggtatttgtagatttatttaatctttcaacatacctgattccccgacactggataccgaagatgaacccaaccattcacaaatttctatatacagcagaatactgtgatagctcctacttcagcagtgatgaatcagattaaaatcgtctgcaaaatctatgaagaatactggtttcacagcctattttttattttctatggattttcataaatacagtttgaatatatgtatgcatatattgttcagcaccacgatgctctgatttaattctagaaacaatttgattacctcttgtttgtgacaagactaagcattaagatgagaaagaatacatttaaatagtaacattgtacatagggtgttttcctattaaaaatcagtttcccctgagacttaatgtaaccacttaatgtaatcactatctcattgtttcatctttataaacttgtaaacttcatctatttcaaatattttatgcagtacattatattattctgtacaaaggctttcaaacaaaatttttaaaataataaagtattaatctttcaaaaaaaaaaaaaaaaaaaa

SEQ ID NO: 55981 - DNA, 708 bp, Homo sapiens
actcaccgcctgtccttcctgacacctcaccatgtgtacgggaaaatgtgcccgctgtgtggggctctccctcattaccctctgcctcgtctgcattgtggccaacgccctcctgctggtacctaatggggagacctcctggaccaacaccaaccatctcagcttgcaagtctggctcatgggcggcttcattggcgggggcctaatggtactgtgtccggggattgcagccgttcgggcagggggcaagggctgctgtggtgctgggtgctgtggaaaccgctgcaggatgctgcgctcggtcttctcctcggcgttcggggtgcttggtgccatctactgcctctcggtgtctggagctgggctccgaaatggacccagatgcttaatgaacggcgagtggggctaccacttcgaagacaccgcgggagcttacttgctcaaccgcactctatgggatcggtgcgaggcgccccctcgcgtggtcccctggaatgtgacgctcttctcgctgctggtggccgcctcctgcctggagatagtactgtgtgggatccagctggtgaacgcgaccattggtgtcttctgcggcgattgcaggaaaaaacaggacacacctcactgaggctccactgaccgccgggttacacctgctccttcctggacgctcactcccttgctcgctagaataaactgctttgcgctctc

SEQ ID NO: 55982 - DNA, 3212 bp, Homo sapiens
cttgagccagacccagtccagctctggtgcctgccctctggtgcgagctgacctgagatgcacttccctcctctgtgagctgtctcggcacccacttgcagtcactgccgcctgatgttgttactcttccactccaaaaggatgcccgtggccgaggccccccaggtggctggcgggcagggggacggaggtgatggcgaggaagcggagccggaggggatgttcaaggcctgtgaggactccaagagaaaagcccggggctacctccgcctggtgcccctgtttgtgctgctggccctgctcgtgctggcttcggcgggggtgctactctggtatttcctagggtacaaggcggaggtgatggtcagccaggtgtactcaggcagtctgcgtgtactcaatcgccacttctcccaggatcttacccgccgggaatctagtgccttccgcagtgaaaccgccaaagcccagaagatgctcaaggagctcatcaccagcacccgcctgggaacttactacaactccagctccgtctattcctttggggagggacccctcacctgcttcttctggttcattctccaaatccccgagcaccgccggctgatgctgagccccgaggtggtgcaggcactgctggtggaggagctgctgtccacagtcaacagctcggctgccgtcccctacagggccgagtacgaagtggaccccgagggcctagtgatcctggaagccagtgtgaaagacatagctgcattgaattccacgctgggttgttaccgctacagctacgtgggccagggccaggtcctccggctgaaggggcctgaccacctggcctccagctgcctgtggcacctgcagggccccaaggacctcatgctcaaactccggctggagtggacgctggcagagtgccgggaccgactggccatgtatgacgtggccgggcccctggagaagaggctcatcacctcggtgtacggctgcagccgccaggagcccgtggtggaggttctggcgtcgggggccatcatggcggtcgtctggaagaagggcctgcacagctactacgaccccttcgtgctctccgtgcagccggtggtcttccaggcctgtgaagtgaacctgacgctggacaacaggctcgactcccagggcgtcctcagcaccccgtacttccccagctactactcgccccaaacccactgctcctggcacctcacggtgccctctctggactacggcttggccctctggtttgatgcctatgcactgaggaggcagaagtatgatttgccgtgcacccagggccagtggacgatccagaacaggaggctgtgtggcttgcgcatcctgcagccctacgccgagaggatccccgtggtggccacggccgggatcaccatcaacttcacctcccagatctccctcaccgggcccggtgtgcgggtgcactatggcttgtacaaccagtcggacccctgccctggagagttcctctgttctgtgaatggactctgtgtccctgcctgtgatggggtcaaggactgccccaacggcctggatgagagaaactgcgtttgcagagccacattccagtgcaaagaggacagcacatgcatctcactgcccaaggtctgtgatgggcagcctgattgtctcaacggcagcgacgaagagcagtgccaggaaggggtgccatgtgggacattcaccttccagtgtgaggaccggagctgcgtgaagaagcccaacccgcagtgtgatgggcggcccgactgcagggacggctcggatgaggagcactgtgactgtggcctccagggcccctccagccgcattgttggtggagctgtgtcctccgagggtgagtggccatggcaggccagcctccaggttcggggtcgacacatctgtgggggggccctcatcgctgaccgctgggtgataacagctgcccactgcttccaggaggacagcatggcctccacggtgctgtggaccgtgttcctgggcaaggtgtggcagaactcgcgctggcctggagaggtgtccttcaaggtgagccgcctgctcctgcacccgtaccacgaagaggacagccatgactacgacgtggcgctgctgcagctcgaccacccggtggtgcgctcggccgccgtgcgccccgtctgcctgcccgcgcgctcccacttcttcgagcccggcctgcactgctggattacgggctggggcgccttgcgcgagggcggccccatcagcaacgctctgcagaaagtggatgtgcagttgatcccacaggacctgtgcagcgaggtctatcgctaccaggtgacgccacgcatgctgtgtgccggctaccgcaagggcaagaaggatgcctgtcagggtgactcaggtggtccgctggtgtgcaaggcactcagtggccgctggttcctggcggggctggtcagctggggcctgggctgtggccggcctaactacttcggcgtctacacccgcatcacaggtgtgatcagctggatccagcaagtggtgacctgaggaactgcccccctgcaaagcagggcccacctcctggactcagagagcccagggcaactgccaagcagggggacaagtattctggcggggggtgggggagagagcaggccctgtggtggcaggaggtggcatcttgtctcgtccctgatgtctgctccagtgatggcaggaggatggagaagtgccagcagctgggggtcaagacgtcccctgaggacccaggcccacacccagcccttctgcctcccaattctctctcctccgtccccttcctccactgctgcctaatgcaaggcagtggctcagcagcaagaatgctggttctacatcccgaggagtgtctgaggtgcgccccactctgtacagaggctgtttgggcagccttgcctccagagagcagattccagcttcggaagcccctggtctaacttgggatctgggaatggaaggtgctcccatcggaggggaccctcagagccctggagactgccaggtgggcctgctgccactgtaagccaaaaggtggggaagtcctgactccagggtccttgccccacccctgcctgccacctgggccctcacagcccagaccctcactgggaggtgagctcagctgccctttggaataaagctgcctgatcaaaaaaaaaaaaaaaaaaaaa

SEQ ID NO: 55983 - DNA, 1249 bp, Homo sapiens
gggtagctgcggccgcagcagcggcggcgggcatggcagaggcgcgatcccagccctcggcggggccgcagctcaacgcgctaccggaccactctccgttgctgcagccgggcctggcggcgctgcggcgccgggcccgggaagctggcgtcccgctcgcgccgctgccgctcaccgactccttcctgctgcggttcctgcgcgcccgggatttcgatctggacctggcctggcggttactaaaaaactattataagtggagagcagaatgtccagaaataagtgcagatctacaccctagaagtattattggcctcctaaaggctggctaccatggagtcctgagatccagggatcccactggcagcaaagttcttatttacagaatcgcacactgggaccccaaagtttttacagcttatgacgtatttcgagtaagtctaatcacatccgagcttattgtacaggaggtagaaactcagcggaatggaatcaaggctatctttgatctggaaggttggcagttttctcatgcttttcaaatcactccatccgtagccaagaagattgctgctgtacttacggattcatttccattgaaagttcgtggcatccatttgataaatgaaccagtaattttccatgctgtcttttccatgatcaaaccattcctgactgaaaaaattaaggaacggattcacatgcatgggaacaactacaaacaaagcttgcttcagcatttcccagacattcttcctctggaatatggtggtgaagaattctccatggaggacatttgtcaggaatggacaaattttataatgaagtctgaagattatctcagcagcatttctgagagcattcaatgagaagttatgtcatgtgaatggcttcctaactaaaaatacatgagtgatatccaacctggttaaatgaatgaaagaaaaggagcaaatcttttaaactaatgcttgcctgaactttaaaaatgtagaaatcttctgacatgagcaacacaggtgtttggaaagattttttactttttaaatgcttttttctctacttttgaagtaattaaatgtcagtacattttaagagcataaaaatcggcgattttgtacttgaagagaacatgaaagttattgctaaagtagctgctcatgtgcatctttgtatgtttctagaaagttatattttaaacaagttctctgattaaattggtttagaaaaaaatttagaaatattccgc

SEQ ID NO: 55984 - DNA, 971 bp, Homo sapiens
gattgcttgaggagagaagtatgtgatcagaaagcattctttgtctattaactcctgcccagcaaaagtgaaagaaaattcatgggagcatgcaagaacaaagagcacagcaaagctggacaaacacagcaatccaggcaggggatttccaactcaactctggtatgtaagctgcatgcaaagtcctttttctgtctctggtttctggccccttgtctgcagagatggctcccaatgcttcctgcctctgtgtgcatgtccgttccgaggaatgggatttaatgacctttgatgccaacccatatgacagcgtgaaaaaaatcaaagaacatgtccggtctaagaccaaggttcctgtgcaggaccaggttcttttgctgggctccaagatcttaaagccacggagaagcctctcatcttacggcattgacaaagagaagaccatccaccttaccctgaaagtggtgaagcccagtgatgaggagctgcccttgtttcttgtggagtcaggtgatgaggcaaagaggcacctcctccaggtgcgaaggtccagctcagtggcacaagtgaaagcaatgatcgagactaagacgggtataatccctgagacccagattgtgacttgcaatggaaagagactggaagatgggaagatgatggcagattacggcatcagaaagggcaacttactcttcctggcatcttattgtattggagggtgaccaccctgggcatggggtgttggcaggggtcaaaaagcttatttcttttaatctcttactcaacgaacacatcttctgatgatttcccaaaattaatgagaatgagatgagtagagtaagatttgggtgggatgggtaggatgaagtatattgcccaactctatgtttctttgattctaacacaattaattaagtgacatgatttttactaatgtattactgagactagtaaataaatttttaagccaa

SEQ ID NO: 55985 - DNA, 2357 bp, Homo sapiens
aggagcaaaggcgccatggctgtggagtcccagggcggacgcccacttgtcctgggcctgctgctgtgtgtgctgggcccagtggtgtcccatgctgggaagatactgttgatcccagtggatggcagccactggctgagcatgcttggggccatccagcagctgcagcagaggggacatgaaatagttgtcctagcacctgacgcctcgttgtacatcagagacggagcattttacaccttgaagacgtaccctgtgccattccaaagggaggatgtgaaagagtcttttgttagtctcgggcataatgtttttgagaatgattctttcctgcagcgtgtgatcaaaacatacaagaaaataaaaaaggactctgctatgcttttgtctggctgttcccacttactgcacaacaaggagctcatggcctccctggcagaaagcagctttgatgtcatgctgacggaccctttccttccttgcagccccatcgtggcccagtacctgtctctgcccactgtattcttcttgcatgcactgccatgcagcctggaatttgaggctacccagtgccccaacccattctcctacgtgcccaggcctctctcctctcattcagatcacatgaccttcctgcagcgggtgaagaacatgctcattgccttttcacagaactttctgtgcgacgtggtttattccccgtatgcaacccttgcctcagaattccttcagagagaggtgactgtccaggacctattgagctctgcatctgtctggctgtttagaagtgactttgtgaaggattaccctaggcccatcatgcccaatatggtttttgttggtggaatcaactgccttcaccaaaatccactatcccaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattct

SEQ ID NO: 55986 - DNA, 2399 bp, Homo sapiens
atagcagcttagaatcccagctgctggctcgggctgcagttctctcatggctcgcgcagggtggaccagccccgttcctttatgtgtgtgtctactgctgacctgtggctttgccgaggcagggaagctgctggtagtgcccatggatgggagtcactggttcaccatgcagtcggtggtggagaaacttatcctcagggggcatgaggtggttgtagtcatgccagaggtgagttggcaactggaaagatcactgaattgcacagtgaagacttactcaacctcgtacactctggaagatcagaaccgggaattcatggttttcgcccatgctcaatggaaagcacaggcacaaagtatattttctctattaatgagttcatccagtggttttcttgacttatttttttcgcattgcaggagtttgtttaatgaccgaaaattagtagaatacttaaaggagagttcttttgatgcagtgtttctggatccttttgatacctgtggcttaattgttgctaaatatttctccctcccctctgtggtcttcaccaggggaatattttgccaccatcttgaagaaggtgcacagtgccctgctcctctttcctatgtccccaatgatctcttagggttctcagatgccatgactttcaaggagagagtatggaaccacatcgtgcacttggaggaccatttattttgccagtatctttttagaaatgccctagaaatagcctctgaaattctccaaacccctgtcacggcatatgatctctacagtcacacatcaatttggttgttgcgaacggactttgttttggactatcccaaacccgtgatgcccaacatgatcttcattggtggtatcaactgtcatcagggaaagccattgcctatggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattctatttaaaaaaaaaaaaaaaa

SEQ ID NO: 55987 - DNA, 2345 bp, Homo sapiens
atggccacaggactccaggttcccctgccgtggctggccacaggactgctgcttctcctcagtgtccagccctgggctgagagtggaaaggtgttggtggtgcccattgatggcagccactggctcagcatgcgggaggtcttgcgggagctccatgccagaggccaccaggcagtggtcctcaccccagaggtgaatatgcacatcaaagaagagaactttttcaccctgacaacctatgccatttcgtggacccaggatgaatttgatcgccatgtgctgggccacactcaactgtactttgaaacagaacattttctgaagaaatttttcagaagtatggcaatgttgaacaatatgtctttggtctatcataggtcttgtgtggagctactacataatgaggccctgatcaggcacctgaatgctacttcctttgatgtggttttaacagaccccgttaacctctgcgcggcagtgctggctaagtacctgtcgattcctactgtgttttttttgaggaacattccatgtgatttagactttaagggcacacagtgtccaaacccttcctcctatattcctagattactaacaaccaattcagaccacatgacattcatgcaaagggtcaagaacatgctctaccctctggccctgtcctacatttgccatgctttttctgctccttatgcaagccttgcctctgagctttttcagagagaggtgtcagtggtggatattctcagtcatgcatctgtgtggctgttccgaggggactttgtgatggactaccccaggccaatcatgcccaacatggtcttcattgggggcatcaactgtgccaacaggaagccactatctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattct

SEQ ID NO: 55988 - DNA, 2374 bp, Homo sapiens
acagtcagctgtcggtggcttctgctgagatggccagaggactccaggttcccctgccgcggctggccacaggactgctgctcctcctcagtgtccagccctgggctgagagtggaaaggtgttggtggtgcccactgatggcagcccctggctcagcatgcgggaggccttgcgggagctccatgccagaggccaccaggcggtggtcctcaccccagaggtgaatatgcacatcaaagaagagaaatttttcaccctgacagcctatgctgttccatggacccagaaggaatttgatcgcgttacgctgggctacactcaagggttctttgaaacagaacatcttctgaagagatattctagaagtatggcaattatgaacaatgtatctttggcccttcataggtgttgtgtggagctactgcataatgaggccctgatcaggcacctgaatgctacttcctttgatgtggttttaacagaccccgttaacctctgtggggcggtgctggctaagtacctgtcgattcctgctgtgtttttttggaggtacattccatgtgacttagactttaagggcacacagtgtccaaatccttcctcctatattcctaagttactaacgaccaattcagaccacatgacattcctgcaaagggtcaagaacatgctctaccctctggccctgtcctacatttgccatactttttctgccccttatgcaagtcttgcctctgagctttttcagagagaggtgtcagtggtggatcttgtcagctatgcatccgtgtggctgttccgaggggactttgtgatggactaccccaggccgatcatgcccaacatggtcttcattgggggcatcaactgtgccaacgggaagccactatctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattct

SEQ ID NO: 55989 - DNA, 2345 bp, Homo sapiens
atggccacaggactccaggttcccctgccgcagctggccacaggactgctgcttctcctcagtgtccagccctgggctgagagtgggaaggtgctggtggtgcccactgatggcagccactggctcagcatgcgggaggccttgcgggacctccatgcgagaggccaccaggtggtggtcctcaccctggaggtgaatatgtacatcaaagaagagaactttttcaccctgacaacgtatgccatttcatggacccaggacgaatttgatcgccttttgctgggtcacactcaatcgttctttgaaacagaacatcttctgatgaaattttctagaagaatggcaattatgaacaatatgtctttgatcatacataggtcttgtgtggagctactgcataatgaggccctgatcaggcacctgcatgctacttcctttgatgtggttctaacagacccctttcacctctgcgcggcggtgctggctaagtacctgtcgattcctgctgtgtttttcttgaggaacattccatgtgatttagactttaagggcacacagtgtccaaacccttcctcctatattcctagattactaacgaccaattcagaccacatgacattcctgcaaagggtcaagaacatgctctaccctctggccctgtcctacctttgccatgctgtttctgctccttatgcaagccttgcctctgagctttttcagagagaggtgtcagtggtggatcttgtcagccatgcatctgtgtggctgttccgaggggactttgtgatggattaccccaggccgatcatgcccaacatggtcttcattgggggcatcaactgtgccaacgggaagccactatctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattct

SEQ ID NO: 55990 - DNA, 2435 bp, Homo sapiens
gaaaagcagtggtttgtttagggaaaatacctaggagccctgtgatttggagagtgaaaactctttattaccgttgttactttaactctttccaggatggcctgcctccttcgctcatttcagagaatttctgcaggggttttcttcttagcactttggggcatggttgtaggtgacaagctgctggtggtccctcaggacggaagccactggcttagtatgaaggatatagttgaggttctcagtgaccggggtcatgagattgtagtggtggtgcctgaagttaatttgcttttgaaagaatccaaatactacacaagaaaaatctatccagtgccgtatgaccaagaagagctgaagaaccgttaccaatcatttggaaacaatcactttgctgagcgatcattcctaactgctcctcagacagagtacaggaataacatgattgttattggcctgtacttcatcaactgccagagcctcctgcaggacagggacaccctgaacttctttaaggagagcaagtttgatgctcttttcacagacccagccttaccctgtggggtgatcctggctgagtatttgggcctaccatctgtgtacctcttcaggggttttccgtgttccctggagcatacattcagcagaagcccagaccctgtgtcctacattcccaggtgctacacaaagttttcagaccacatgactttttcccaacgagtggccaacttccttgttaatttgttggagccctatctattttattgtctgttttcaaagtatgaagaactcgcatcagctgtcctcaagagagatgtggatataatcaccttatatcagaaggtctctgtttggctgttaagatatgactttgtgcttgaatatcctaggccggtcatgcccaacatggtcttcattggaggtatcaactgtaagaagaggaaagacttgtctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattct

SEQ ID NO: 55991 - DNA, 1691 bp, Homo sapiens
agaaacctgaagctcaggagaggagtcactcccctggcagatgggtggctgggccagaagcagataccaggctttctgactcctgctctaggattctcaccacgtactggctagacttatacttctcaaatcttaatttcctaaaggccggtcatgcccaacatggtcttcattggaggtatcaactgtaagaagaggaaagacttgtctcaggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattct

SEQ ID NO: 55992 - DNA, 2333 bp, Homo sapiens
atggctcgtgcagggtggactggcctccttcccctatatgtgtgtctactgctgacctgtggctttgccaaggcagggaagctgctggtagtgcccatggatgggagccactggttcaccatgcagtcggtggtggagaaactcatcctcagggggcatgaggtggtcgtagtcatgccagaggtgagttggcaactgggaagatcactgaattgcacagtgaagacttactcaacctcatacactctggaggatcaggaccgggagttcatggtttttgccgatgctcgctggacggcaccattgcgaagtgcattttctctattaacaagttcatccaatggtatttttgacttatttttttcaaattgcaggagtttgtttaatgaccgaaaattagtagaatacttaaaggagagttgttttgatgcagtgtttctcgatccttttgatgcctgtggcttaattgttgccaaatatttctccctcccctctgtggtcttcgccaggggaatattttgccactatcttgaagaaggtgcacagtgccctgctcctctttcctatgtccccagacttctcttagggttctcagacgccatgactttcaaggagagagtatggaaccacatcatgcacttggaggaacatttattttgcccctattttttcaaaaatgtcttagaaatagcctctgaaattctccaaacccctgtcacggcatatgatctctacagccacacatcaatttggttgttgcgaactgactttgttttggagtatcccaaacccgtgatgcccaatatgatcttcattggtggtatcaactgtcatcagggaaagccagtgcctatggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattct

SEQ ID NO: 55993 - DNA, 2396 bp, Homo sapiens
cttccgcctactgtatcatagcagcttagaatcccagctgctggctcgggctgcagttctctcatggctcgcacagggtggaccagccccattcccctatgtgtttctctgctgctgacctgtggctttgctgaggcagggaagctgctggtagtgcccatggatgggagtcactggttcaccatgcagtcggtggtggagaaacttatcctcagggggcatgaggtggttgtagtcatgccagaggtgagttggcaactgggaaaatcactgaattgcacagtgaagacttactcaacctcatacactctggaggatctggaccgggaattcatggatttcgccgatgctcaatggaaagcacaagtacgaagtttgttttctctatttctgagttcatccaatggtttttttaacttatttttttcgcattgcaggagtttgtttaatgaccgaaaattagtagaatacttaaaggagagttcttttgatgcggtgtttcttgatccttttgatgcctgtggcttaattgttgccaaatatttctccctcccctctgtggtcttcgccaggggaatagcttgccactatcttgaagaaggtgcacagtgccctgctcctctttcctatgtccccagaattctcttagggttctcagatgccatgactttcaaggagagagtacggaaccacatcatgcacttggaggaacatttattttgccagtatttttccaaaaatgccctagaaatagcctctgaaattctccaaacacctgtcacagcatatgatctctacagccacacatcaatttggttgttgcgaacagactttgttttggactatcccaaacccgtgatgcccaatatgatcttcattggtggtatcaactgccatcagggaaagccattgcctatggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattct

SEQ ID NO: 55994 - DNA, 2395 bp, Homo sapiens
agattcccagctgcttgctctcagctgcagttctctgatggcttgcacagggtggaccagcccccttcctctatgtgtgtgtctgctgctgacctgtggctttgccgaggcagggaagctactggtagtgcccatggatgggagccactggttcaccatgaggtcggtggtggagaaactcattctcagggggcatgaggtggttgtagtcatgccagaggtgagttggcaactgggaagatcactgaattgcacagtgaagacttattcaacttcatataccctggaggatctggaccgggagttcaaggcttttgcccatgctcaatggaaagcacaagtacgaagtatatattctctattaatgggttcatacaatgacatttttgacttatttttttcaaattgcaggagtttgtttaaagacaaaaaattagtagaatacttaaaggagagttcttttgatgcagtgtttctcgatccttttgataactgtggcttaattgttgccaaatatttctccctcccctccgtggtcttcgccaggggaatactttgccactatcttgaagaaggtgcacagtgccctgctcctctttcctatgtccccagaattctcttagggttctcagatgccatgactttcaaggagagagtacggaaccacatcatgcacttggaggaacatttattatgccaccgttttttcaaaaatgccctagaaatagcctctgaaattctccaaacacctgttacggagtatgatctctacagccacacatcaatttggttgttgcgaacggactttgttttggactatcccaaacccgtgatgcccaacatgatcttcattggtggtatcaactgccatcagggaaagccgttgcctatggaatttgaagcctacattaatgcttctggagaacatggaattgtggttttctctttgggatcaatggtctcagaaattccagagaagaaagctatggcaattgctgatgctttgggcaaaatccctcagacagtcctgtggcggtacactggaacccgaccatcgaatcttgcgaacaacacgatacttgttaagtggctaccccaaaacgatctgcttggtcacccgatgacccgtgcctttatcacccatgctggttcccatggtgtttatgaaagcatatgcaatggcgttcccatggtgatgatgcccttgtttggtgatcagatggacaatgcaaagcgcatggagactaagggagctggagtgaccctgaatgttctggaaatgacttctgaagatttagaaaatgctctaaaagcagtcatcaatgacaaaagttacaaggagaacatcatgcgcctctccagccttcacaaggaccgcccggtggagccgctggacctggccgtgttctgggtggagtttgtgatgaggcacaagggcgcgccacacctgcgccccgcagcccacgacctcacctggtaccagtaccattccttggacgtgattggtttcctcttggccgtcgtgctgacagtggccttcatcacctttaaatgttgtgcttatggctaccggaaatgcttggggaaaaaagggcgagttaagaaagcccacaaatccaagacccattgagaagtgggtgggaaataaggtaaaattttgaaccattccctagtcatttccaaacttgaaaacagaatcagtgttaaattcattttattcttattaaggaaatactttgcataaattaatcagccccagagtgctttaaaaaattctcttaaataaaaataatagactcgctagtcagtaaagatatttgaatatgtatcgtgccccctctggtgtctttgatcaggatgacatgtgccatttttcagaggacgtgcagacaggctggcattctagattacttttcttactctgaaacatggcctgtttgggagtgcgggattcaaaggtggtcccacggctgcccctactgcaaatggcagttttaatcttatcttttggcttctgcagatggttgcaattgatccttaaccaataatggtcagtcctcatctctgtcgtgcttcataggtgccaccttgtgtgtttaaagaagggaagctttgtacctttagagtgtaggtgaaatgaatgaatggcttggagtgcactgagaacagcatatgatttcttgctttggggaaaaagaatgatgctatgaaattggtgggtggtgtatttgagaagataatcattgcttatgtcaaatggagctgaatttgataaaaacccaaaatacagctatgaagtgctgggcaagtttactttttttctgatgtttcctacaactaaaaataaattaataaatttatataaattctatttaaaaaaaaaaaaaaaaaaaaa

SEQ ID NO: 55995 - DNA, 1722 bp, Homo sapiens
tgcaccaggatgactctgaaatggacttcagttcttctgctgatacatctcagttgttactttagctctgggagttgtggaaaagtgctggtgtgggccgcagaatacagccattggatgaatatgaagacaatcctgaaagagcttgttcagagaggtcatgaggtgactgtactggcatcttcagcttccattctttttgatcccaatgatgcatccactcttaaatttgaagtttatcctacatctttaactaaaactgaatttgagaatatcatcatgcaacaggttaagagatggtcagacattcgaaaagatagcttttggttatatttttcacaagaacaagaaatcctgtgggaattatatgacatatttagaaacttctgtaaagatgtagtttcaaataagaaagttatgaaaaaactacaagagtcaagatttgacatcgtttttgcagatgctgtttttccctgtggtgagctgctggctgcgctacttaacatacggtttgtgtacagtctccgctttactcctggctacacaattgaaaggcacagtggaggactgattttccctccttcctacatacctattgttatgtcaaaattaagtgatcaaatgactttcatggagagggtaaaaaatatgatctatgtgctttattttgacttttggttccaaatgtctgatatgaagaagtgggatcagttttacagtgaagttttaggaagacccactaccttatttgagacaatgggaaaagctgacatatggcttatgcgaaactcctggagttttcaatttcctcatccattcttaccaaacgttgattttgttggaggattccactgcaaacctgccaaacccctacctaaggaaatggaggagtttgtacagagctctggagaaaatggtgttgtggtgttttctctggggtcagtgataagtaacatgacagcagaaagggccaatgtaattgcaacagcccttgccaagatcccacaaaaggttctgtggagatttgacgggaataaaccagatgccttaggtctcaatactcggctgtacaagtggataccccagaatgaccttctaggtcatccaaaaaccagagcttttataactcatggtggagccaatggcatctatgaggcaatctaccatgggatccctatggtgggcattccattgttttttgatcaacctgataacattgctcacatgaaggccaagggagcagctgttagattggacttcaacacaatgtcgagtacagacctgctgaatgcactgaagacagtaattaatgatcctttatataaagagaatattatgaaattatcaagaattcaacatgatcaaccagtaaagcccctggatcgagcagtcttctggattgaatttgtcatgccccacaaaggagccaaacaccttcgagttgcagcccatgacctcacctggttccagtaccactctttggatgtgattgggtttctgctggcctgtgtggcaactgtgatatttatcatcacaaagttttgtctgttttgtttctggaagtttgctagaaaagggaagaagggaaaaagagattagttatgtctgacatttgaagctggaaaaccagatagataggacaacttcagtttattccagcaagaaagaaaagattgttatgcaagatttctttcttcctgtgacaaaaaaaaaaaaaaaaaa

SEQ ID NO: 55996 - DNA, 1851 bp, Homo sapiens
ggatggctctgaagtggacttcagttcttctgctgatacatctcggttgttactttagctctgggagttgtggaaaggtgctggtgtggaccggtgaatacagccattggatgaatatgaagacaatcctgaaagagcttgttcagagaggtcatgaggtgactgtactggcatcttcagcttccattctttttgatcccaatgacgcattcactcttaaactcgaagtttatcctacatctttaactaaaactgaatttgagaatatcatcatgcaacaggttaagagatggtcagacattcaaaaagatagcttttggttatatttttcacaagaacaagaaatcctgtgggaatttcatgacatatttagaaacttctgtaaagatgtagtttcaaataagaaagttatgaaaaaactacaagagtcaagatttgacatcatttttgcagatgctttttttccttgtggtgagctgctggctgcgctacttaacataccgtttgtgtacagtctctgcttcactcctggctacacaattgaaaggcacagtggaggactgattttccctccttcctacatacctgttgttatgtcaaaattaagtgatcaaatgactttcatggagagggtaaaaaacatgatctatgtgctttattttgacttttggttccaaatgtgtgatatgaagaagtgggatcagttttacagtgaagttttaggaagacccactaccttatttgagacaatggggaaagctgacatatggcttatgcgaaactcctggagttttcaatttcctcatccattcttaccaaacattgattttgttggaggactccactgcaaacctgccaaacccctacctaaggaaatggaggaatttgtacagagctctggtgaaaatggtgttgtggtgttttctctggggtcagtgataagtaacatgacagcagaaagggccaacgtaattgcaacagcccttgccaagatcccacaaaaggttctgtggagatttgatgggaataaaccagatgccttaggtctcaatactcggctgtataagtggataccccagaatgaccttctaggtcttccaaaaaccagagcttttataactcatggtggagccaatggcatctatgaggcaatctaccatgggatccctatggtaggcattccattgttttgggatcaacctgataacattgctcacatgaaggccaagggagcagctgttagactggacttccacacaatgtcgagtacagacctgctgaatgcactgaagacagtaattaatgatccttcatataaagagaatgttatgaaattatcaataattcaacatgatcaaccagtaaagcccctgcatcgagcagtcttctggattgaatttgtgatgtgccacaaaggagccaaacaccttcgagttgcagcccgtgacctcacctggttccagtaccactctttggatgtgattgggtttctgctggcctgtgtggcaactgtgatatttgtcgtcacaaagttttgtctgttttgtttctggaagtttgctagaaaagggaagaagggaaaaagagattagttatgtctgacatttgaagctggaaaaccagatagatgggttgacatcagtttattccagcaagaaagaaaagattgttatgcaagatttctttcttcctgtgacaaaaaaaaaaacttttcaaaatctaccttgtcaagtaaaaatttgtttttcagagatttaccacccaggtaatggttagaaatattctgtggcaatgaagaaaacactagggaaaataaaaaataatataaagccaaaaaaaaaaaaaaaaaaa

SEQ ID NO: 55997 - DNA, 3127 bp, Homo sapiens
agtgctggcctctgcctccatctcagtcacacatgtctagcctccaggcgctgtgctctggcctgcccctgcggcccctcccagagaaccggggacgccaggctggggtgccccatgcccctgtcaggacccccagcctcagccctgtggagaaacagctggcgctgaggaacgccctgcgctacttccccccggatgtccaggagctgctggccccagagtttgcccaggagctgcaactgtacggacacatctacatgtaccggttttgccccgacattgaaatgagggcctacccgattgagcagtacccctgccagacgaaagtggctgccgccatcatgcacatgattatgaacaacctggatcctgccgtggcccagtttccccaggagctggtgacctatggaggaaatgggcaggtgttcagcaactgggctcagttctggctgaccatgttctacttgtcgaagatgacagaggagcagactttggtcatgtacagtgggcacccacttggcctctttcccagcagccgcagtgccccacggctcgtcatcaccaatgggatggtcattcccaactactcctcccggacggagtatgagaagctctttgccttgggggttacaatgtacggccagatgacagcaggtagctactgctacatcggtccccagggaatcgttcatggcactgtgctcaccgtgttgaatgctgcacgtcggtacctgggcatcgaggacttggctgggaaggtctttgtcacctctgggctcggcggaatgagtggggctcaggccaaggccgcagtcatcgtggggtgcatcggtgtgatagcagaggtggataaagcagcccttgagaaacgccacaggcagggctggctgatggaagtgactgacagcttggaccgctgcatccagaggctcagggaagcaaggaaaaaaaaggaggtgctcagccttggttaccatggcaacgtggtggctctttgggagcgcctggtccacgaattggacacgacgggggagtgcttggtggacctggggtcagatcagacatcctgccacaacccgttcaatggcggctactaccctgtgcagctcagcttcacggaggcccagagcctcatggcctccaaccctgctgtgttcaaggacctggtccaggaaagcctgaggaggcaagtctcagccatcaacaggttggccgaggagaagttcttcttctgggactacggcaatgccttcctcttggaggcccagagagcaggagcggatgtggagaagaaaggtgctggcaggacagagttccgctacccttcctatgtgcagcacatcatgggggacatattctcccagggatttgggcctttccgctgggtgtgcacatcgggggacccccaggacctggcggtcacagacgaactggccacatctgtgctggaggaagccattgctgatggagtgaaggtgtctgtgaagctgcagtacatggacaacatccgctggatccgggaggccgccaggcaccggctggtggtgggctcccaggcaaggatcttgtactcagaccagaagggccgcgtggccatcgctgtggccattaaccaggccatcgcctgcaggaggatcaaggcgccggtggtcctgagccgagatcaccatgacgtgagcggcaccgacagcccctttagggagacctccaacatttacgacggctctgccttctgtgcagacatggctgtgcagaacttcgtgggagatgcctgtcgcggagccacctgggtcgcccttcacaacggagggggcgtgggctggggtgaggtgatcaacgggggattcggcctcgtgctggacggtaccccggaggccgaggggagagccaggctgatgctcagctgggatgtctccaatggtgtggcccggcgctgctggtcagggaaccagaaggcctatgagatcatctgccagaccatgcaggagaacagcaccttggtggtgacactgcctcacaaggtggaggacgagcgggtgctccagcaggccctgcagctctgagggagccaggagtcgcggcccctgcctcccttcctccctggcgatcctcacctgcccagccatggcacacacccttcctgcacacccgcactacctgcacttctcgcacatcctcacgtggcccttatggtgccctgtgcagggtgccaccacagcctcattttacagacagccccctgaggcccagagacatgcagctctctgtccacaaccatgccacttgcatgggagccctgaaggctgtcaaagtccatttagggccaagtcccaagcctgcccgggggccctgcggtgaacactggtcaagctctctccggctgggatgatcacaccctctgcttcctggccacctgccagcctccatgcaactctgtctgtctgctgcccatctgctgtctgtgcaagcaacttctggaccctggcaccctgggctgctggcctggaggagttcgggaaggaggatagaccaggaaataaagggtcaacagagctgtgtgctgcactgtgggctggtgggacgggcaggccgggtctgccctaaggataaatgatcacttactggggaagaaatgagagagcaggggcacccccctaggccagcacagcctgaggggtacagcaaaggggaccctttgctggcccctgaggctggagtctggcaccccttccccaatcccatagcccggtaatgactgggtccagagcctcgtgagaggtcaccgggatgggggaagtggcctctgtcagggccagggctcatgaatctcattctcttagctgggcgtgcaacagaccaacagataactcatcctaaacagagaaatgagaaagagtctgtgggtgggcctctgagggccacagaaaaccagacaccccacatgtctgtggattggagaggggcaggccactgccctctccaggaccaagccgggttcttggtccccaccctccctgcactccgcatctcctccccagcagccattctcccctttcccttgtgaacaaaagcctagttttgtgtgggcagcaatatagggtaaataaaaccacctgattctccagcc

SEQ ID NO: 55998 - protein, 495 aa, Homo sapiens
MSMLVVFLLLWGVTWGPVTEAAIFYETQPSLWAESESLLKPLANVTLTCQAHLETPDFQLFKNGVAQEPVHLDSPAIKHQFLLTGDTQGRYRCRSGLSTGWTQLSKLLELTGPKSLPAPWLSMAPVSWITPGLKTTAVCRGVLRGVTFLLRREGDHEFLEVPEAQEDVEATFPVHQPGNYSCSYRTDGEGALSEPSATVTIEELAAPPPPVLMHHGESSQVLHPGNKVTLTCVAPLSGVDFQLRRGEKELLVPRSSTSPDRIFFHLNAVALGDGGHYTCRYRLHDNQNGWSGDSAPVELILSDETLPAPEFSPEPESGRALRLRCLAPLEGARFALVREDRGGRRVHRFQSPAGTEALFELHNISVADSANYSCVYVDLKPPFGGSAPSERLELHVDGPPPRPQLRATWSGAVLAGRDAVLRCEGPIPDVTFELLREGETKAVKTVRTPGAAANLELIFVGPQHAGNYRCRYRSWVPHTFESELSDPVELLVAES

SEQ ID NO: 55999 - protein, 399 aa, Homo sapiens
MGRKSLYLLIVGILIAYYIYTPLPDNVEEPWRMMWINAHLKTIQNLATFVELLGLHHFMDSFKVVGSFDEVPPTSDENVTVTETKFNNILVRVYVPKRKSEALRRGLFYIHGGGWCVGSAALSGYDLLSRWTADRLDAVVVSTNYRLAPKYHFPIQFEDVYNALRWFLRKKVLAKYGVNPERIGISGDSAGGNLAAAVTQQLLDDPDVKIKLKIQSLIYPALQPLDVDLPSYQENSNFLFLSKSLMVRFWSEYFTTDRSLEKAMLSRQHVPVESSHLFKFVNWSSLLPERFIKGHVYNNPNYGSSELAKKYPGFLDVRAAPLLADDNKLRGLPLTYVITCQYDLLRDDGLMYVTRLRNTGVQVTHNHVEDGFHGAFSFLGLKISHRLINQYIEWLKENL

SEQ ID NO: 56000 - protein, 500 aa, Homo sapiens
MASMLLAQRLACSFQHSYRLLVPGSRHISQAAAKVDVEFDYDGPLMKTEVPGPRSQELMKQLNIIQNAEAVHFFCNYEESRGNYLVDVDGNRMLDLYSQISSVPIGYSHPALLKLIQQPQNASMFVNRPALGILPPENFVEKLRQSLLSVAPKGMSQLITMACGSCSNENALKTIFMWYRSKERGQRGFSQEELETCMINQAPGCPDYSILSFMGAFHGRTMGCLATTHSKAIHKIDIPSFDWPIAPFPRLKYPLEEFVKENQQEEARCLEEVEDLIVKYRKKKKTVAGIIVEPIQSEGGDNHASDDFFRKLRDIARKHGCAFLVDEVQTGGGCTGKFWAHEHWGLDDPADVMTFSKKMMTGGFFHKEEFRPNAPYRIFNTWLGDPSKNLLLAEVINIIKREDLLNNAAHAGKALLTGLLDLQARYPQFISRVRGRGTFCSFDTPDDSIRNKLILIARNKGVVLGGCGDKSIRFRPTLVFRDHHAHLFLNIFSDILADFK

SEQ ID NO: 56001 - protein, 500 aa, Homo sapiens; identical to SEQ ID NO: 56000

SEQ ID NO: 56002 - protein, 1279 aa, Homo sapiens
MDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKAREGRTTIVIAHRLSTVRNADVIAGFEDGVIVEQGSHSELMKKEGVYFKLVNMQTSGSQIQSEEFELNDEKAATRMAPNGWKSRLFRHSTQKNLKNSQMCQKSLDVETDGLEANVPPVSFLKVLKLNKTEWPYFVVGTVCAIANGGLQPAFSVIFSEIIAIFGPGDDAVKQQKCNIFSLIFLFLGIISFFTFFLQGFTFGKAGEILTRRLRSMAFKAMLRQDMSWFDDHKNSTGALSTRLATDAAQVQGATGTRLALIAQNIANLGTGIIISFIYGWQLTLLLLAVVPIIAVSGIVEMKLLAGNAKRDKKELEAAGKIATEAIENIRTVVSLTQERKFESMYVEKLYGPYRNSVQKAHIYGITFSISQAFMYFSYAGCFRFGAYLIVNGHMRFRDVILVFSAIVFGAVALGHASSFAPDYAKAKLSAAHLFMLFERQPLIDSYSEEGLKPDKFEGNITFNEVVFNYPTRANVPVLQGLSLEVKKGQTLALVGSSGCGKSTVVQLLERFYDPLAGTVLLDGQEAKKLNVQWLRAQLGIVSQEPILFDCSIAENIAYGDNSRVVSQDEIVSAAKAANIHPFIETLPHKYETRVGDKGTQLSGGQKQRIAIARALIRQPQILLLDEATSALDTESEKVVQEALDKAREGRTCIVIAHRLSTIQNADLIVVFQNGRVKEHGTHQQLLAQKGIYFSMVSVQAGTQNL

SEQ ID NO: 56003 - protein, 1286 aa, Homo sapiens
MDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKAREGRTTIVIAHRLSTVRNADVIAGFEDGVIVEQGSHSELMKKEGVYFKLVNMQTSGSQIQSEEFELNDEKAATRMAPNGWKSRLFRHSTQKNLKNSQMCQKSLDVETDGLEANVPPVSFLKVLKLNKTEWPYFVVGTVCAIANGGLQPAFSVIFSEIIAIFGPGDDAVKQQKCNIFSLIFLFLGIISFFTFFLQGFTFGKAGEILTRRLRSMAFKAMLRQDMSWFDDHKNSTGALSTRLATDAAQVQGATGTRLALIAQNIANLGTGIIISFIYGWQLTLLLLAVVPIIAVSGIVEMKLLAGNAKRDKKELEAAGKIATEAIENIRTVVSLTQERKFESMYVEKLYGPYRNSVQKAHIYGITFSISQAFMYFSYAGCFRFGAYLIVNGHMRFRDVILVFSAIVFGAVALGHASSFAPDYAKAKLSAAHLFMLFERQPLIDSYSEEGLKPDKFEGNITFNEVVFNYPTRANVPVLQGLSLEVKKGQTLALVGSSGCGKSTVVQLLERFYDPLAGTVFVDFGFQLLDGQEAKKLNVQWLRAQLGIVSQEPILFDCSIAENIAYGDNSRVVSQDEIVSAAKAANIHPFIETLPHKYETRVGDKGTQLSGGQKQRIAIARALIRQPQILLLDEATSALDTESEKVVQEALDKAREGRTCIVIAHRLSTIQNADLIVVFQNGRVKEHGTHQQLLAQKGIYFSMVSVQAGTQNL

SEQ ID NO: 56004 - protein, 1232 aa, Homo sapiens
MDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKAREGRTTIVIAHRLSTVRNADVIAGFEDGVIVEQGSHSELMKKEGVYFKLVNMQTSGSQIQSEEFELNDEKAATRMAPNGWKSRLFRHSTQKNLKNSQMCQKSLDVETDGLEANVPPVSFLKVLKLNKTEWPYFVVGTVCAIANGGLQPAFSVIFSEIIAIFGPGDDAVKQQKCNIFSLIFLFLGIISFFTFFLQGFTFGKAGEILTRRLRSMAFKAMLRQDMSWFDDHKNSTGALSTRLATDAAQVQGATGTRLALIAQNIANLGTGIIISFIYGWQLTLLLLAVVPIIAVSGIVEMKLLAGNAKRDKKELEAAGKIATEAIENIRTVVSLTQERKFESMYVEKLYGPYRVFSAIVFGAVALGHASSFAPDYAKAKLSAAHLFMLFERQPLIDSYSEEGLKPDKFEGNITFNEVVFNYPTRANVPVLQGLSLEVKKGQTLALVGSSGCGKSTVVQLLERFYDPLAGTVLLDGQEAKKLNVQWLRAQLGIVSQEPILFDCSIAENIAYGDNSRVVSQDEIVSAAKAANIHPFIETLPHKYETRVGDKGTQLSGGQKQRIAIARALIRQPQILLLDEATSALDTESEKVVQEALDKAREGRTCIVIAHRLSTIQNADLIVVFQNGRVKEHGTHQQLLAQKGIYFSMVSVQAGTQNL

SEQ ID NO: 56005 - protein, 1545 aa, Homo sapiens
MLEKFCNSTFWNSSFLDSPEADLPLCFEQTVLVWIPLGFLWLLAPWQLLHVYKSRTKRSSTTKLYLAKQVFVGFLLILAAIELALVLTEDSGQATVPAVRYTNPSLYLGTWLLVLLIQYSRQWCVQKNSWFLSLFWILSILCGTFQFQTLIRTLLQGDNSNLAYSCLFFISYGFQILILIFSAFSENNESSNNPSSIASFLSSITYSWYDSIILKGYKRPLTLEDVWEVDEEMKTKTLVSKFETHMKRELQKARRALQRRQEKSSQQNSGARLPGLNKNQSQSQDALVLEDVEKKKKKSGTKKDVPKSWLMKALFKTFYMVLLKSFLLKLVNDIFTFVSPQLLKLLISFASDRDTYLWIGYLCAILLFTAALIQSFCLQCYFQLCFKLGVKVRTAIMASVYKKALTLSNLARKEYTVGETVNLMSVDAQKLMDVTNFMHMLWSSVLQIVLSIFFLWRELGPSVLAGVGVMVLVIPINAILSTKSKTIQVKNMKNKDKRLKIMNEILSGIKILKYFAWEPSFRDQVQNLRKKELKNLLAFSQLQCVVIFVFQLTPVLVSVVTFSVYVLVDSNNILDAQKAFTSITLFNILRFPLSMLPMMISSMLQASVSTERLEKYLGGDDLDTSAIRHDCNFDKAMQFSEASFTWEHDSEATVRDVNLDIMAGQLVAVIGPVGSGKSSLISAMLGEMENVHGHITIKGTTAYVPQQSWIQNGTIKDNILFGTEFNEKRYQQVLEACALLPDLEMLPGGDLAEIGEKGINLSGGQKQRISLARATYQNLDIYLLDDPLSAVDAHVGKHIFNKVLGPNGLLKGKTRLLVTHSMHFLPQVDEIVVLGNGTIVEKGSYSALLAKKGEFAKNLKTFLRHTGPEEEATVHDGSEEEDDDYGLISSVEEIPEDAASITMRRENSFRRTLSRSSRSNGRHLKSLRNSLKTRNVNSLKEDEELVKGQKLIKKEFIETGKVKFSIYLEYLQAIGLFSIFFIILAFVMNSVAFIGSNLWLSAWTSDSKIFNSTDYPASQRDMRVGVYGALGLAQGIFVFIAHFWSAFGFVHASNILHKQLLNNILRAPMRFFDTTPTGRIVNRFAGDISTVDDTLPQSLRSWITCFLGIISTLVMICMATPVFTIIVIPLGIIYVSVQMFYVSTSRQLRRLDSVTRSPIYSHFSETVSGLPVIRAFEHQQRFLKHNEVRIDTNQKCVFSWITSNRWLAIRLELVGNLTVFFSALMMVIYRDTLSGDTVGFVLSNALNITQTLNWLVRMTSEIETNIVAVERITEYTKVENEAPWVTDKRPPPDWPSKGKIQFNNYQVRYRPELDLVLRGITCDIGSMEKIGVVGRTGAGKSSLTNCLFRILEAAGGQIIIDGVDIASIGLHDLREKLTIIPQDPILFSGSLRMNLDPFNNYSDEEIWKALELAHLKSFVASLQLGLSHEVTEAGGNLSIGQRQLLCLGRALLRKSKILVLDEATAAVDLETDNLIQTTIQNEFAHCTVITIAHRLHTIMDSDKVMVLDNGKIIECGSPEELLQIPGPFYFMAKEAGIENVNSTKF

SEQ ID NO: 56006 - protein, 432 aa, Homo sapiens
MEGLAVRLLRGSRLLRRNFLTCLSSWKIPPHVSKSSQSEALLNITNNGIHFAPLQTFTDEEMMIKSSVKKFAQEQIAPLVSTMDENSKMEKSVIQGLFQQGLMGIEVDPEYGGTGASFLSTVLVIEELAKVDASVAVFCEIQNTLINTLIRKHGTEEQKATYLPQLTTEKVGSFCLSEAGAGSDSFALKTRADKEGDYYVLNGSKMWISSAEHAGLFLVMANVDPTIGYKGITSFLVDRDTPGLHIGKPENKLGLRASSTCPLTFENVKVPEANILGQIGHGYKYAIGSLNEGRIGIAAQMLGLAQGCFDYTIPYIKERIQFGKRLFDFQGLQHQVAHVATQLEAARLLTYNAARLLEAGKPFIKEASMAKYYASEIAGQTTSKCIEWMGGVGYTKDYPVEKYFRDAKIGTIYEGASNIQLNTIAKHIDAEY

SEQ ID NO: 56007 - protein, 586 aa, Homo sapiens
MESNHKSGDGLSGTQKEAALRALVQRTGYSLVQENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEILSEMKKVTEGVVDVIVYPSAADKTKNRGFAFVEYESHRAAAMARRKLLPGRIQLWGHGIAVDWAEPEVEVDEDTMSSVKILYVRNLMLSTSEEMIEKEFNNIKPGAVERVKKIRDYAFVHFSNREDAVEAMKALNGKVLDGSPIEVTLAKPVDKDSYVRYTRGTGGRGTMLQGEYTYSLGQVYDPTTTYLGAPVFYAPQTYAAIPSLHFPATKGHLSNRAIIRAPSVRGAAGVRGLGGRGYLAYTGLGRGYQVKGDKREDKLYDILPGMELTPMNPVTLKPQGIKLAPQILEEICQKNNWGQPVYQLHSAIGQDQRQLFLYKITIPALASQNPAIHPFTPPKLSAFVDEAKTYAAEYTLQTLGIPTDGGDGTMATAAAAATAFPGYAVPNATAPVSAAQLKQAVTLGQDLAAYTTYEVYPTFAVTARGDGYGTF

SEQ ID NO: 56008 - protein, 594 aa, Homo sapiens
MESNHKSGDGLSGTQKEAALRALVQRTGYSLVQENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEILSEMKKVTEGVVDVIVYPSAADKTKNRGFAFVEYESHRAAAMARRKLLPGRIQLWGHGIAVDWAEPEVEVDEDTMSSVKILYVRNLMLSTSEEMIEKEFNNIKPGAVERVKKIRDYAFVHFSNREDAVEAMKALNGKVLDGSPIEVTLAKPVDKDSYVRYTRGTGGRGTMLQGEYTYSLGQVYDPTTTYLGAPVFYAPQTYAAIPSLHFPATKGHLSNRAIIRAPSVREIYMNVPVGAAGVRGLGGRGYLAYTGLGRGYQVKGDKREDKLYDILPGMELTPMNPVTLKPQGIKLAPQILEEICQKNNWGQPVYQLHSAIGQDQRQLFLYKITIPALASQNPAIHPFTPPKLSAFVDEAKTYAAEYTLQTLGIPTDGGDGTMATAAAAATAFPGYAVPNATAPVSAAQLKQAVTLGQDLAAYTTYEVYPTFAVTARGDGYGTF

SEQ ID NO: 56009 - protein, 594 aa, Homo sapiens
MEAVCLGTCPEPEASMSTAIPGLKKGNNALQSIILQTLLEKENGQRKYGGPPPGWDAAPPERGCEIFIGKLPRDLFEDELIPLCEKIGKIYEMRMMMDFNGNNRGYAFVTFSNKVEAKNAIKQLNNYEIRNGRLLGVCASVDNCRLFVGGIPKTKKREEILSEMKKVTEGVVDVIVYPSAADKTKNRGFAFVEYESHRAAAMARRKLLPGRIQLWGHGIAVDWAEPEVEVDEDTMSSVKILYVRNLMLSTSEEMIEKEFNNIKPGAVERVKKIRDYAFVHFSNREDAVEAMKALNGKVLDGSPIEVTLAKPVDKDSYVRYTRGTGGRGTMLQGEYTYSLGQVYDPTTTYLGAPVFYAPQTYAAIPSLHFPATKGHLSNRAIIRAPSVRGAAGVRGLGGRGYLAYTGLGRGYQVKGDKREDKLYDILPGMELTPMNPVTLKPQGIKLAPQILEEICQKNNWGQPVYQLHSAIGQDQRQLFLYKITIPALASQNPAIHPFTPPKLSAFVDEAKTYAAEYTLQTLGIPTDGGDGTMATAAAAATAFPGYAVPNATAPVSAAQLKQAVTLGQDLAAYTTYEVYPTFAVTARGDGYGTF

SEQ ID NO: 56010 - protein, 555 aa, Homo sapiens
MERPAPGEVVMSQAIQPAHATARGELSAGQLLKWIDTTACLAAEKHAGVSCVTASVDDIQFEETARVGQVITIKAKVTRAFSTSMEISIKVMVQDMLTGIEKLVSVAFSTFVAKPVGKEKIHLKPVTLLTEQDHVEHNLAAERRKVRLQHEDTFNNLMKESSKFDDLIFDEEEGAVSTRGTSVQSIELVLPPHANHHGNTFGGQIMAWMETVATISASRLCWAHPFLKSVDMFKFRGPSTVGDRLVFTAIVNNTFQTCVEVGVRVEAFDCQEWAEGRGRHINSAFLIYNAADDKENLITFPRIQPISKDDFRRYRGAIARKRIRLGRKYVISHKEEVPLCIHWDISKQASLSDSNVEALKKLAAKRGWEVTSTVEKIKIYTLEEHDVLSVWVEKHVGSPAHLAYRLLSDFTKRPLWDPHFVSCEVIDWVSEDDQLYHITCPILNDDKPKDLVVLVSRRKPLKDGNTYTVAVKSVILPSVPPSPQYIRSEIICAGFLIHAIDSNSCIVSYFNHMSASILPYFAGNLGGWSKSIEETAASCIQFLENPPDDGFVSTF

SEQ ID NO: 56011 - protein, 375 aa, Homo sapiens
MSTAGKVIKCKAAVLWELKKPFSIEEVEVAPPKAHEVRIKMVAVGICGTDDHVVSGTMVTPLPVILGHEAAGIVESVGEGVTTVKPGDKVIPLAIPQCGKCRICKNPESNYCLKNDVSNPQGTLQDGTSRFTCRRKPIHHFLGISTFSQYTVVDENAVAKIDAASPLEKVCLIGCGFSTGYGSAVNVAKVTPGSTCAVFGLGGVGLSAIMGCKAAGAARIIAVDINKDKFAKAKELGATECINPQDYKKPIQEVLKEMTDGGVDFSFEVIGRLDTMMASLLCCHEACGTSVIVGVPPDSQNLSMNPMLLLTGRTWKGAILGGFKSKECVPKLVADFMAKKFSLDALITHVLPFEKINEGFDLLHSGKSIRTILMF

SEQ ID NO: 56012 - protein, 375 aa, Homo sapiens
MSTAGKVIKCKAAVLWELKKPFSIEEVEVAPPKAHEVRIKMVAAGICRSDEHVVSGNLVTPLPVILGHEAAGIVESVGEGVTTVKPGDKVIPLFTPQCGKCRICKNPESNYCLKNDLGNPRGTLQDGTRRFTCSGKPIHHFVGVSTFSQYTVVDENAVAKIDAASPLEKVCLIGCGFSTGYGSAVKVAKVTPGSTCAVFGLGGVGLSVVMGCKAAGAARIIAVDINKDKFAKAKELGATECINPQDYKKPIQEVLKEMTDGGVDFSFEVIGRLDTMMASLLCCHEACGTSVIVGVPPDSQNLSINPMLLLTGRTWKGAIFGGFKSKESVPKLVADFMAKKFSLDALITNILPFEKINEGFDLLRSGKSIRTVLTF

SEQ ID NO: 56013 - protein, 380 aa, Homo sapiens
MGTKGKVIKCKAAIAWEAGKPLCIEEVEVAPPKAHEVRIQIIATSLCHTDATVIDSKFEGLAFPVIVGHEAAGIVESIGPGVTNVKPGDKVIPLYAPLCRKCKFCLSPLTNLCGKISNLKSPASDQQLMEDKTSRFTCKGKPVYHFFGTSTFSQYTVVSDINLAKIDDDANLERVCLLGCGFSTGYGAAINNAKVTPGSTCAVFGLGGVGLSAVMGCKAAGASRIIGIDINSEKFVKAKALGATDCLNPRDLHKPIQEVIIELTKGGVDFALDCAGGSETMKAALDCTTAGWGSCTFIGVAAGSKGLTIFPEELIIGRTINGTFFGGWKSVDSIPKLVTDYKNKKFNLDALVTHTLPFDKISEAFDLMNQGKSVRTILIF

SEQ ID NO: 56014 - protein, 368 aa, Homo sapiens
MSTTGQVIRCKAAILWKPGAPFSIEEVEVAPPKAKEVRIKVVATGLCGTEMKVLGSKHLDLLYPTILGHEGAGIVESIGEGVSTVKPGDKVITLFLPQCGECTSCLNSEGNFCIQFKQSKTQLMSDGTSRFTCKGKSIYHFGNTSTFCEYTVIKEISVAKIDAVAPLEKVCLISCGFSTGFGAAINTAKVTPGSTCAVFGLGGVGLSVVMGCKAAGAARIIGVDVNKEKFKKAQELGATECLNPQDLKKPIQEVLFDMTDAGIDFCFEAIGNLDVLAAALASCNESYGVCVVVGVLPASVQLKISGQLFFSGRSLKGSVFGGWKSRQHIPKLVADYMAEKLNLDPLITHTLNLDKINEAVELMKTGKW

SEQ ID NO: 56015 - protein, 609 aa, Homo sapiens
MKWVESIFLIFLLNFTESRTLHRNEYGIASILDSYQCTAEISLADLATIFFAQFVQEATYKEVSKMVKDALTAIEKPTGDEQSSGCLENQLPAFLEELCHEKEILEKYGHSDCCSQSEEGRHNCFLAHKKPTPASIPLFQVPEPVTSCEAYEEDRETFMNKFIYEIARRHPFLYAPTILLWAARYDKIIPSCCKAENAVECFQTKAATVTKELRESSLLNQHACAVMKNFGTRTFQAITVTKLSQKFTKVNFTEIQKLVLDVAHVHEHCCRGDVLDCLQDGEKIMSYICSQQDTLSNKITECCKLTTLERGQCIIHAENDEKPEGLSPNLNRFLGDRDFNQFSSGEKNIFLASFVHEYSRRHPQLAVSVILRVAKGYQELLEKCFQTENPLECQDKGEEELQKYIQESQALAKRSCGLFQKLGEYYLQNAFLVAYTKKAPQLTSSELMAITRKMAATAATCCQLSEDKLLACGEGAADIIIGHLCIRHEMTPVNPGVGQCCTSSYANRRPCFSSLVVDETYVPPAFSDDKFIFHKDLCQAQGVALQTMKQEFLINLVKQKPQITEEQLEAVIADFSGLLEKCCQGQEQEVCFAEEGQKLISKTRAALGV

SEQ ID NO: 56016 - protein, 485 aa, Homo sapiens
MRKRAPQSEMAPAGVSLRATILCLLAWAGLAAGDRVYIHPFHLVIHNESTCEQLAKANAGKPKDPTFIPAPIQAKTSPVDEKALQDQLVLVAAKLDTEDKLRAAMVGMLANFLGFRIYGMHSELWGVVHGATVLSPTAVFGTLASLYLGALDHTADRLQAILGVPWKDKNCTSRLDAHKVLSALQAVQGLLVAQGRADSQAQLLLSTVVGVFTAPGLHLKQPFVQGLALYTPVVLPRSLDFTELDVAAEKIDRFMQAVTGWKTGCSLMGASVDSTLAFNTYVHFQGKMKGFSLLAEPQEFWVDNSTSVSVPMLSGMGTFQHWSDIQDNFSVTQVPFTESACLLLIQPHYASDLDKVEGLTFQQNSLNWMKKLSPRTIHLTMPQLVLQGSYDLQDLLAQAELPAILHTELNLQKLSNDRIRVGEVLNSIFFELEADEREPTESTQQLNKPEVLEVTLNRPFLFAVYDQSATALHFLGRVANPLSTA

SEQ ID NO: 56017 - protein, 392 aa, Homo sapiens
MASHKLLVTPPKALLKPLSIPNQLLLGPGPSNLPPRIMAAGGLQMIGSMSKDMYQIMDEIKEGIQYVFQTRNPLTLVISGSGHCALEAALVNVLEPGDSFLVGANGIWGQRAVDIGERIGARVHPMTKDPGGHYTLQEVEEGLAQHKPVLLFLTHGESSTGVLQPLDGFGELCHRYKCLLLVDSVASLGGTPLYMDRQGIDILYSGSQKALNAPPGTSLISFSDKAKKKMYSRKTKPFSFYLDIKWLANFWGCDDQPRMYHHTIPVISLYSLRESLALIAEQGLENSWRQHREAAAYLHGRLQALGLQLFVKDPALRLPTVTTVAVPAGYDWRDIVSYVIDHFDIEIMGGLGPSTGKVLRIGLLGCNATRENVDRVTEALRAALQHCPKKKL

SEQ ID NO: 56018 - protein, 367 aa, Homo sapiens
MKSLVLLLCLAQLWGCHSAPHGPGLIYRQPNCDDPETEEAALVAIDYINQNLPWGYKHTLNQIDEVKVWPQQPSGELFEIEIDTLETTCHVLDPTPVARCSVRQLKEHAVEGDCDFQLLKLDGKFSVVYAKCDSSPDSAEDVRKVCQDCPLLAPLNDTRVVHAAKAALAAFNAQNNGSNFQLEEISRAQLVPLPPSTYVEFTVSGTDCVAKEATEAAKCNLLAEKQYGFCKATLSEKLGGAEVAVTCTVFQTQPVTSQPQPEGANEAVPTPVVDPDAPPSPPLGAPGLPPAGSPPDSHVLLAAPPGHQLHRAHYDLRHTFMGVVSLGSPSGEVSHPRKTRTVVQPSVGAAAGPVVPPCPGRIRHFKV

SEQ ID NO: 56019 - protein, 323 aa, Homo sapiens
MDPKYQRVELNDGHFMPVLGFGTYAPPEVPRNRAVEVTKLAIEAGFRHIDSAYLYNNEEQVGLAIRSKIADGSVKREDIFYTSKLWCTFFQPQMVQPALESSLKKLQLDYVDLYLLHFPMALKPGETPLPKDENGKVIFDTVDLSATWEVMEKCKDAGLAKSIGVSNFNCRQLEMILNKPGLKYKPVCNQVECHPYLNQSKLLDFCKSKDIVLVAHSALGTQRHKLWVDPNSPVLLEDPVLCALAKKHKQTPALIALRYQLQRGVVVLAKSYNEQRIRENIQVFEFQLTSEDMKVLDGLNRNYRYVVMDFLMDHPDYPFSDEY

SEQ ID NO: 56020 - protein, 352 aa, Homo sapiens
MRSLGALLLLLSACLAVSAGPVPTPPDNIQVQENFNISRIYGKWYNLAIGSTCPWLKKIMDRMTVSTLVLGEGATEAEISMTSTRWRKGVCEETSGAYEKTDTDGKFLYHKSKWNITMESYVVHTNYDEYAIFLTKKFSRHHGPTITAKLYGRAPQLRETLLQDFRVVAQGVGIPEDSIFTMADRGECVPGEQEPEPILIPRVRRAVLPQEEEGSGGGQLVTEVTKKEDSCQLGYSAGPCMGMTSRYFYNGTSMACETFQYGGCMGNGNNFVTEKECLQTCRTVAACNLPIVRGPCRAFIQLWAFDAVKGKCVLFPYGGCQGNGNKFYSEKECREYCGVPGDGDEELLRFSN

SEQ ID NO: 56021 - protein, 426 aa, Homo sapiens
MAGGHSLLLENAQQVVLVCARGERFLARDALRSLAVLEGASLVVGKDGFIKAIGPADVIQRQFSGETFEEIIDCSGKCILPGLVDAHTHPVWAGERVHEFAMKLAGATYMEIHQAGGGIHFTVERTRQATEEELFRSLQQRLQCMMRAGTTLVECKSGYGLDLETELKMLRVIERARRELDIGISATYCGAHSVPKGKTATEAADDIINNHLPKLKELGRNGEIHVDNIDVFCEKGVFDLDSTRRILQRGKDIGLQINFHGDELHPMKAAELGAELGAQAISHLEEVSDEGIVAMATARCSAILLPTTAYMLRLKQPRARKMLDEGVIVALGSDFNPNAYCFSMPMVMHLACVNMRMSMPEALAAATINAAYALGKSHTHGSLEVGKQGDLIIINSSRWEHLIYQFGGHHELIEYVIAKGKLIYKT

SEQ ID NO: 56022 - protein, 147 aa, Homo sapiens
MVMGLGVLLLVFVLGLGLTPPTLAQDNSRYTHFLTQHYDAKPQGRDDRYCESIMRRRGLTSPCKDINTFIHGNKRSIKAICENKNGNPHRENLRISKSSFQVTTCKLHGGSPWPPCQYRATAGFRNVVVACENGLPVHLDQSIFRRP

SEQ ID NO: 56023 - protein, 267 aa, Homo sapiens
MKAAVLTLAVLFLTGSQARHFWQQDEPPQSPWDRVKDLATVYVDVLKDSGRDYVSQFEGSALGKQLNLKLLDNWDSVTSTFSKLREQLGPVTQEFWDNLEKETEGLRQEMSKDLEEVKAKVQPYLDDFQKKWQEEMELYRQKVEPLRAELQEGARQKLHELQEKLSPLGEEMRDRARAHVDALRTHLAPYSDELRQRLAARLEALKENGGARLAEYHAKATEHLSTLSEKAKPALEDLRQGLLPVLESFKVSFLSALEEYTKKLNTQ

SEQ ID NO: 56024 - protein, 100 aa, Homo sapiens
MKLLAATVLLLTICSLEGALVRRQAKEPCVESLVSQYFQTVTDYGKDLMEKVKSPELQAEAKSYFEKSKEQLTPLIKKAGTELVNFLSYFVELGTQPATQ

SEQ ID NO: 56025 - protein, 366 aa, Homo sapiens
MASMAAVLTWALALLSAFSATQARKGFWDYFSQTSGDKGRVEQIHQQKMAREPATLKDSLEQDLNNMNKFLEKLRPLSGSEAPRLPQDPVGMRRQLQEELEEVKARLQPYMAEAHELVGWNLEGLRQQLKPYTMDLMEQVALRVQELQEQLRVVGEDTKAQLLGGVDEAWALLQGLQSRVVHHTGRFKELFHPYAESLVSGIGRHVQELHRSVAPHAPASPARLSRCVQVLSRKLTLKAKALHARIQQNLDQLREELSRAFAGTGTEEGAGPDPQMLSEEVRQRLQAFRQDTYLQIAAFTRAIDQETEEVQQQLAPPPPGHSAFAPEFQQTDSGKVLSKLQARLDDLWEDITHSLHDQGHSHLGDP

SEQ ID NO: 56026 - protein, 101 aa, Homo sapiens
MGTRLLPALFLVLLVLGFEVQGTQQPQQDEMPSPTFLTQVKESLSSYWESAKTAAQNLYEKTYLPAVDEKLRDLYSKSTAAMSTYTGIFTDQVLSVLKGEE

SEQ ID NO: 56027 - protein, 326 aa, Homo sapiens
MTGLCGYSAPDMRGLRLIMIPVELLLCYLLLHPVDATSYGKQTNVLMHFPLSLESQTPSSDPLSCQFLHPKSLPGFSHMAPLPKFLVSLALRNALEEAGCQADVWALQLQLYRQGGVNATQVLIQHLRGLQKGRSTERNVSVEALASALQLLAREQQSTGRVGRSLPTEDCENEKEQAVHNVVQLLPGVGTFYNLGTALYYATQNCLGKARERGRDGAIDLGYDLLMTMAGMSGGPMGLAISAALKPALRSGVQQLIQYYQDQKDANISQPETTKEGLRAISDVSDLEETTTLASFISEVVSSAPYWGWAIIKSYDLDPGAGSLEI

SEQ ID NO: 56028 - protein, 345 aa, Homo sapiens
MISPVLILFSSFLCHVAIAGRTCPKPDDLPFSTVVPLKTFYEPGEEITYSCKPGYVSRGGMRKFICPLTGLWPINTLKCTPRVCPFAGILENGAVRYTTFEYPNTISFSCNTGFYLNGADSAKCTEEGKWSPELPVCAPIICPPPSIPTFATLRVYKPSAGNNSLYRDTAVFECLPQHAMFGNDTITCTTHGNWTKLPECREVKCPFPSRPDNGFVNYPAKPTLYYKDKATFGCHDGYSLDGPEEIECTKLGNWSAMPSCKASCKLPVKKATVVYQGERVKIQEKFKNGMLHGDKVSFFCKNKEKKCSYTEDAQCIDGTIEVPKCFKEHSSLAFWKTDASDVKPC

SEQ ID NO: 56029 - protein, 188 aa, Homo sapiens
MFHQIWAALLYFYGIILNSIYQCPEHSQLTTLGVDGKEFPEVHLGQWYFIAGAAPTKEELATFDPVDNIVFNMAAGSAPMQLHLRATIRMKDGLCVPRKWIYHLTEGSTDLRTEGRPDMKTELFSSSCPGGIMLNETGQGYQRFLLYNRSPHPPEKCVEEFKSLTSCLDSKAFLLTPRNQEACELSNN

SEQ ID NO: 56030 - protein, 291 aa, Homo sapiens
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 56031 - protein, 311 aa, Homo sapiens
MAKDFQDIQQLSSEENDHPFHQGEGPGTRRLNPRRGNPFLKGPPPAQPLAQRLCSMVCFSLLALSFNILLLVVICVTGSQSEGHRGAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 56032 - protein, 311 aa, Homo sapiens; identical to SEQ ID NO: 56031

SEQ ID NO: 56033 - protein, 287 aa, Homo sapiens
MAKDFQDIQQLSSEENDHPFHQGPPPAQPLAQRLCSMVCFSLLALSFNILLLVVICVTGSQSAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 56034 - protein, 292 aa, Homo sapiens
MAKDFQDIQQLSSEENDHPFHQGPPPAQPLAQRLCSMVCFSLLALSFNILLLVVICVTGSQSEGHRGAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 56035 - protein, 418 aa, Homo sapiens
MIQLTATPVSALVDEPVHIRATGLIPFQMVSFQASLEDENGDMFYSQAHYRANEFGEVDLNHASSLGGDYMGVHPMGLFWSLKPEKLLTRLLKRDVMNRPFQVQVKLYDLELIVNNKVASAPKASLTLERWYVAPGVTRIKVREGRLRGALFLPPGEGLFPGVIDLFGGLGGLLEFRASLLASRGFASLALAYHNYEDLPRKPEVTDLEYFEEAANFLLRHPKVFGSGVGVVSVCQGVQIGLSMAIYLKQVTATVLINGTNFPFGIPQVYHGQIHQPLPHSAQLISTNALGLLELYRTFETTQVGASQYLFPIEEAQGQFLFIVGEGDKTINSKAHAEQAIGQLKRHGKNNWTLLSYPGAGHLIEPPYSPLCCASTTHDLRLHWGGEVIPHAAAQEHAWKEIQRFLRKHLIPDVTSQL

SEQ ID NO: 56036 - protein, 602 aa, Homo sapiens
MHSKVTIICIRFLFWFLLLCMLIGKSHTEDDIIIATKNGKVRGMNLTVFGGTVTAFLGIPYAQPPLGRLRFKKPQSLTKWSDIWNATKYANSCCQNIDQSFPGFHGSEMWNPNTDLSEDCLYLNVWIPAPKPKNATVLIWIYGGGFQTGTSSLHVYDGKFLARVERVIVVSMNYRVGALGFLALPGNPEAPGNMGLFDQQLALQWVQKNIAAFGGNPKSVTLFGESAGAASVSLHLLSPGSHSLFTRAILQSGSFNAPWAVTSLYEARNRTLNLAKLTGCSRENETEIIKCLRNKDPQEILLNEAFVVPYGTPLSVNFGPTVDGDFLTDMPDILLELGQFKKTQILVGVNKDEGTAFLVYGAPGFSKDNNSIITRKEFQEGLKIFFPGVSEFGKESILFHYTDWVDDQRPENYREALGDVVGDYNFICPALEFTKKFSEWGNNAFFYYFEHRSSKLPWPEWMGVMHGYEIEFVFGLPLERRDNYTKAEEILSRSIVKRWANFAKYGNPNETQNNSTSWPVFKSTEQKYLTLNTESTRIMTKLRAQQCRFWTSFFPKVLEMTGNIDEAEWEWKAGFHRWNNYMMDWKNQFNDYTSKKESCVGL

SEQ ID NO: 56037 - protein, 343 aa, Homo sapiens
MLATRLSRPLSRLPGKTLSACDRENGARRPLLLGSTSFIPIGRRTYASAAEPVGSKAVLVTGCDSGFGFSLAKHLHSKGFLVFAGCLMKDKGHDGVKELDSLNSDRLRTVQLNVCSSEEVEKVVEIVRSSLKDPEKGMWGLVNNAGISTFGEVEFTSLETYKQVAEVNLWGTVRMTKSFLPLIRRAKGRVVNISSMLGRMANPARSPYCITKFGVEAFSDCLRYEMYPLGVKVSVVEPGNFIAATSLYSPESIQAIAKKMWEELPEVVRKDYGKKYFDEKIAKMETYCSSGSTDTSPVIDAVTHALTATTPYTRYHPMDYYWWLRMQIMTHLPGAISDMIYIR

SEQ ID NO: 56038 - protein, 343 aa, Homo sapiens; identical to SEQ ID NO: 56037

SEQ ID NO: 56039 - protein, 343 aa, Homo sapiens; identical to SEQ ID NO: 56037

SEQ ID NO: 56040 - protein, 406 aa, Homo sapiens
MPPVGGKKAKKGILERLNAGEIVIGDGGFVFALEKRGYVKAGPWTPEAAVEHPEAVRQLHREFLRAGSNVMQTFTFYASEDKLENRGNYVLEKISGQEVNEAACDIARQVADEGDALVAGGVSQTPSYLSCKSETEVKKVFLQQLEVFMKKNVDFLIAEYFEHVEEAVWAVETLIASGKPVAATMCIGPEGDLHGVPPGECAVRLVKAGASIIGVNCHFDPTISLKTVKLMKEGLEAAQLKAHLMSQPLAYHTPDCNKQGFIDLPEFPFGLEPRVATRWDIQKYAREAYNLGVRYIGGCCGFEPYHIRAIAEELAPERGFLPPASEKHGSWGSGLDMHTKPWVRARARKEYWENLRIASGRPYNPSMSKPDGWGVTKGTAELMQQKEATTEQQLKELFEKQKFKSQ

SEQ ID NO: 56041 - protein, 308 aa, Homo sapiens
MDFVAGAIGGVCGVAVGYPLDTVKVRIQTEPKYTGIWHCVRDTYHRERVWGFYRGLSLPVCTVSLVSSVSFGTYRHCLAHICRLRYGNPDAKPTKADITLSGCASGLVRVFLTSPTEVAKVRLQTQTQAQKQQRRLSASGPLAVPPMCPVPPACPEPKYRGPLHCLATVAREEGLCGLYKGSSALVLRDGHSFATYFLSYAVLCEWLSPAGHSRPDVPGVLVAGGCAGVLAWAVATPMDVIKSRLQADGQGQRRYRGLLHCMVTSVREEGPRVLFKGLVLNCCRAFPVNMVVFVAYEAVLRLARGLLT

SEQ ID NO: 56042 - protein, 597 aa, Homo sapiens
MHPPKTPSGALHRKRKMAAWPFSRLWKVSDPILFQMTLIAALLPAVLGNCGPPPTLSFAAPMDITLTETRFKTGTTLKYTCLPGYVRSHSTQTLTCNSDGEWVYNTFCIYKRCRHPGELRNGQVEIKTDLSFGSQIEFSCSEGFFLIGSTTSRCEVQDRGVGWSHPLPQCEIVKCKPPPDIRNGRHSGEENFYAYGFSVTYSCDPRFSLLGHASISCTVENETIGVWRPSPPTCEKITCRKPDVSHGEMVSGFGPIYNYKDTIVFKCQKGFVLRGSSVIHCDADSKWNPSPPACEPNSCINLPDIPHASWETYPRPTKEDVYVVGTVLRYRCHPGYKPTTDEPTTVICQKNLRWTPYQGCEALCCPEPKLNNGEITQHRKSRPANHCVYFYGDEISFSCHETSRFSAICQGDGTWSPRTPSCGDICNFPPKIAHGHYKQSSSYSFFKEEIIYECDKGYILVGQAKLSCSYSHWSAPAPQCKALCRKPELVNGRLSVDKDQYVEPENVTIQCDSGYGVVGPQSITCSGNRTWYPEVPKCEWETPEGCEQVLTGKRLMQCLPNPEDVKMALEVYKLSLEIEQLELQRDSARQSTLDKEL

SEQ ID NO: 56043 - protein, 252 aa, Homo sapiens
MFFWCACCLMVAWRVSASDAEHCPELPPVDNSIFVAKEVEGQILGTYVCIKGYHLVGKKTLFCNASKEWDNTTTECRLGHCPDPVLVNGEFSSSGPVNVSDKITFMCNDHYILKGSNRSQCLEDHTWAPPFPICKSRDCDPPGNPVHGYFEGNNFTLGSTISYYCEDRYYLVGVQEQQCVDGEWSSALPVCKLIQEAPKPECEKALLAFQESKNLCEAMENFMQQLKESGMTMEELKYSLELKKAELKAKLL

SEQ ID NO: 56044 - protein, 251 aa, Homo sapiens
MFFWCACCLMVAWRVSASDEHCPELPPVDNSIFVAKEVEGQILGTYVCIKGYHLVGKKTLFCNASKEWDNTTTECRLGHCPDPVLVNGEFSSSGPVNVSDKITFMCNDHYILKGSNRSQCLEDHTWAPPFPICKSRDCDPPGNPVHGYFEGNNFTLGSTISYYCEDRYYLVGVQEQQCVDGEWSSALPVCKLIQEAPKPECEKALLAFQESKNLCEAMENFMQQLKESGMTMEELKYSLELKKAELKAKLL

SEQ ID NO: 56045 - protein, 252 aa, Homo sapiens; identical to SEQ ID NO: 56043

SEQ ID NO: 56046 - protein, 251 aa, Homo sapiens; identical to SEQ ID NO: 56044

SEQ ID NO: 56047 - protein, 252 aa, Homo sapiens; identical to SEQ ID NO: 56043

SEQ ID NO: 56048 - protein, 1676 aa, Homo sapiens
MGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYFYNKVVTEADVYITFGIREDLKDDQKEMMQTAMQNTMLINGIAQVTFDSETAVKELSYYSLEDLNNKYLYIAVTVIESTGGFSEEAEIPGIKYVLSPYKLNLVATPLFLKPGIPYPIKVQVKDSLDQLVGGVPVTLNAQTIDVNQETSDLDPSKSVTRVDDGVASFVLNLPSGVTVLEFNVKTDAPDLPEENQAREGYRAIAYSSLSQSYLYIDWTDNHKALLVGEHLNIIVTPKSPYIDKITHYNYLILSKGKIIHFGTREKFSDASYQSINIPVTQNMVPSSRLLVYYIVTGEQTAELVSDSVWLNIEEKCGNQLQVHLSPDADAYSPGQTVSLNMATGMDSWVALAAVDSAVYGVQRGAKKPLERVFQFLEKSDLGCGAGGGLNNANVFHLAGLTFLTNANADDSQENDEPCKEILRPRRTLQKKIEEIAAKYKHSVVKKCCYDGACVNNDETCEQRAARISLGPRCIKAFTECCVVASQLRANISHKDMQLGRLHMKTLLPVSKPEIRSYFPESWLWEVHLVPRRKQLQFALPDSLTTWEIQGVGISNTGICVADTVKAKVFKDVFLEMNIPYSVVRGEQIQLKGTVYNYRTSGMQFCVKMSAVEGICTSESPVIDHQGTKSSKCVRQKVEGSSSHLVTFTVLPLEIGLHNINFSLETWFGKEILVKTLRVVPEGVKRESYSGVTLDPRGIYGTISRRKEFPYRIPLDLVPKTEIKRILSVKGLLVGEILSAVLSQEGINILTHLPKGSAEAELMSVVPVFYVFHYLETGNHWNIFHSDPLIEKQKLKKKLKEGMLSIMSYRNADYSYSVWKGGSASTWLTAFALRVLGQVNKYVEQNQNSICNSLLWLVENYQLDNGSFKENSQYQPIKLQGTLPVEARENSLYLTAFTVIGIRKAFDICPLVKIDTALIKADNFLLENTLPAQSTFTLAISAYALSLGDKTHPQFRSIVSALKREALVKGNPPIYRFWKDNLQHKDSSVPNTGTARMVETTAYALLTSLNLKDINYVNPVIKWLSEEQRYGGGFYSTQDTINAIEGLTEYSLLVKQLRLSMDIDVSYKHKGALHNYKMTDKNFLGRPVEVLLNDDLIVSTGFGSGLATVHVTTVVHKTSTSEEVCSFYLKIDTQDIEASHYRGYGNSDYKRIVACASYKPSREESSSGSSHAVMDISLPTGISANEEDLKALVEGVDQLFTDYQIKDGHVILQLNSIPSSDFLCVRFRIFELFEVGFLSPATFTVYEYHRPDKQCTMFYSTSNIKIQKVCEGAACKCVEADCGQMQEELDLTISAETRKQTACKPEIAYAYKVSITSITVENVFVKYKATLLDIYKTGEAVAEKDSEITFIKKVTCTNAELVKGRQYLIMGKEALQIKYNFSFRYIYPLDSLTWIEYWPRDTTCSSCQAFLANLDEFAEDIFLNGC

SEQ ID NO: 56049 - protein, 934 aa, Homo sapiens
MARRSVLYFILLNALINKGQACFCDHYAWTQWTSCSKTCNSGTQSRHRQIVVDKYYQENFCEQICSKQETRECNWQRCPINCLLGDFGPWSDCDPCIEKQSKVRSVLRPSQFGGQPCTEPLVAFQPCIPSKLCKIEEADCKNKFRCDSGRCIARKLECNGENDCGDNSDERDCGRTKAVCTRKYNPIPSVQLMGNGFHFLAGEPRGEVLDNSFTGGICKTVKSSRTSNPYRVPANLENVGFEVQTAEDDLKTDFYKDLTSLGHNENQQGSFSSQGGSSFSVPIFYSSKRSENINHNSAFKQAIQASHKKDSSFIRIHKVMKVLNFTTKAKDLHLSDVFLKALNHLPLEYNSALYSRIFDDFGTHYFTSGSLGGVYDLLYQFSSEELKNSGLTEEEAKHCVRIETKKRVLFAKKTKVEHRCTTNKLSEKHEGSFIQGAEKSISLIRGGRSEYGAALAWEKGSSGLEEKTFSEWLESVKENPAVIDFELAPIVDLVRNIPCAVTKRNNLRKALQEYAAKFDPCQCAPCPNNGRPTLSGTECLCVCQSGTYGENCEKQSPDYKSNAVDGQWGCWSSWSTCDATYKRSRTRECNNPAPQRGGKRCEGEKRQEEDCTFSIMENNGQPCINDDEEMKEVDLPEIEADSGCPQPVPPENGFIRNEKQLYLVGEDVEISCLTGFETVGYQYFRCLPDGTWRQGDVECQRTECIKPVVQEVLTITPFQRLYRIGESIELTCPKGFVVAGPSRYTCQGNSWTPPISNSLTCEKDTLTKLKGHCQLGQKQSGSECICMSPEEDCSHHSEDLCVFDTDSNDYFTSPACKFLAEKCLNNQQLHFLHIGSCQDGRQLEWGLERTRLSSNSTKKESCGYDTCYDWEKCSASTSKCVCLLPPQCFKGGNQLYCVKMGSSTSEKTLNICEVGTIRCANRKMEILHPGKCLA

SEQ ID NO: 56050 - protein, 584 aa, Homo sapiens
MFAVVFFILSLMTCQPGVTAQEKVNQRVRRAATPAAVTCQLSNWSEWTDCFPCQDKKYRHRSLLQPNKFGGTICSGDIWDQASCSSSTTCVRQAQCGQDFQCKETGRCLKRHLVCNGDQDCLDGSDEDDCEDVRAIDEDCSQYEPIPGSQKAALGYNILTQEDAQSVYDASYYGGQCETVYNGEWRELRYDSTCERLYYGDDEKYFRKPYNFLKYHFEALADTGISSEFYDNANDLLSKVKKDKSDSFGVTIGIGPAGSPLLVGVGVSHSQDTSFLNELNKYNEKKFIFTRIFTKVQTAHFKMRKDDIMLDEGMLQSLMELPDQYNYGMYAKFINDYGTHYITSGSMGGIYEYILVIDKAKMESLGITSRDITTCFGGSLGIQYEDKINVGGGLSGDHCKKFGGGKTERARKAMAVEDIISRVRGGSSGWSGGLAQNRSTITYRSWGRSLKYNPVVIDFEMQPIHEVLRHTSLGPLEAKRQNLRRALDQYLMEFNACRCGPCFNNGVPILEGTSCRCQCRLGSLGAACEQTQTEGAKADGSWSCWSSWSVCRAGIQERRRECDNPAPQNGGASCPGRKVQTQAC

SEQ ID NO: 56051 - protein, 591 aa, Homo sapiens
MKNSRTWAWRAPVELFLLCAALGCLSLPGSRGERPHSFGSNAVNKSFAKSRQMRSVDVTLMPIDCELSSWSSWTTCDPCQKKRYRYAYLLQPSQFHGEPCNFSDKEVEDCVTNRPCGSQVRCEGFVCAQTGRCVNRRLLCNGDNDCGDQSDEANCRRIYKKCQHEMDQYWGIGSLASGINLFTNSFEGPVLDHRYYAGGCSPHYILNTRFRKPYNVESYTPQTQGKYEFILKEYESYSDFERNVTEKMASKSGFSFGFKIPGIFELGISSQSDRGKHYIRRTKRFSHTKSVFLHARSDLEVAHYKLKPRSLMLHYEFLQRVKRLPLEYSYGEYRDLFRDFGTHYITEAVLGGIYEYTLVMNKEAMERGDYTLNNVHACAKNDFKIGGAIEEVYVSLGVSVGKCRGILNEIKDRNKRDTMVEDLVVLVRGGASEHITTLAYQELPTADLMQEWGDAVQYNPAIIKVKVEPLYELVTATDFAYSSTVRQNMKQALEEFQKEVSSCHCAPCQGNGVPVLKGSRCDCICPVGSQGLACEVSYRKNTPIDGKWNCWSNWSSCSGRRKTRQRQCNNPPPQNGGSPCSGPASETLDCS

SEQ ID NO: 56052 - protein, 202 aa, Homo sapiens
MLPPGTATLLTLLLAAGSLGQKPQRPRRPASPISTIQPKANFDAQQFAGTWLLVAVGSACRFLQEQGHRAEATTLHVAPQGTAMAVSTFRKLDGICWQVRQLYGDTGVLGRFLLQARGARGAVHVVVAETDYQSFAVLYLERAGQLSVKLYARSLPVSDSVLSGFEQRVQEAHLTEDQIFYFPKYGFCEAADQFHVLDEVRR

SEQ ID NO: 56053 - protein, 559 aa, Homo sapiens
MSACRSFAVAICILEISILTAQYTTSYDPELTESSGSASHIDCRMSPWSEWSQCDPCLRQMFRSRSIEVFGQFNGKRCTDAVGDRRQCVPTEPCEDAEDDCGNDFQCSTGRCIKMRLRCNGDNDCGDFSDEDDCESEPRPPCRDRVVEESELARTAGYGINILGMDPLSTPFDNEFYNGLCNRDRDGNTLTYYRRPWNVASLIYETKGEKNFRTEHYEEQIEAFKSIIQEKTSNFNAAISLKFTPTETNKAEQCCEETASSISLHGKGSFRFSYSKNETYQLFLSYSSKKEKMFLHVKGEIHLGRFVMRNRDVVLTTTFVDDIKALPTTYEKGEYFAFLETYGTHYSSSGSLGGLYELIYVLDKASMKRKGVELKDIKRCLGYHLDVSLAFSEISVGAEFNKDDCVKRGEGRAVNITSENLIDDVVSLIRGGTRKYAFELKEKLLRGTVIDVTDFVNWASSINDAPVLISQKLSPIYNLVPVKMKNAHLKKQNLERAIEDYINEFSVRKCHTCQNGGTVILMDGKCLCACPFKFEGIACEISKQKISEGLPALEFPNEK

SEQ ID NO: 56054 - protein, 305 aa, Homo sapiens
MLGRNTWKTSAFSFLVEQMWAPLWSRSMRPGRWCSQRSCAWQTSNNTLHPLWTVPVSVPGGTRQSPINIQWRDSVYDPQLKPLRVSYEAASCLYIWNTGYLFQVEFDDATEASGISGGPLENHYRLKQFHFHWGAVNEGGSEHTVDGHAYPAELHLVHWNSVKYQNYKEAVVGENGLAVIGVFLKLGAHHQTLQRLVDILPEIKHKDARAAMRPFDPSTLLPTCWDYWTYAGSLTTPPLTESVTWIIQKEPVEVAPSQLSAFRTLLFSALGEEEKMMVNNYRPLQPLMNRKVWASFQATNEGTRS

SEQ ID NO: 56055 - protein, 120 aa, Homo sapiens
MKVSEAALSLLVLILIITSASRSQPKVPEWVNTPSTCCLKYYEKVLPRRLVVGYRKALNCHLPAIIFVTKRNREVCTNPNDDWVQEYIKDPNLPLLPTRNLSTVKIITAKNGQPQLLNSQ

SEQ ID NO: 56056 - protein, 567 aa, Homo sapiens
MWLRAFILATLSASAAWGHPSSPPVVDTVHGKVLGKFVSLEGFAQPVAIFLGIPFAKPPLGPLRFTPPQPAEPWSFVKNATSYPPMCTQDPKAGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMQLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 56057 - protein, 568 aa, Homo sapiens
MWLRAFILATLSASAAWAGHPSSPPVVDTVHGKVLGKFVSLEGFAQPVAIFLGIPFAKPPLGPLRFTPPQPAEPWSFVKNATSYPPMCTQDPKAGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMQLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 56058 - protein, 566 aa, Homo sapiens
MWLRAFILATLSASAAWGHPSSPPVVDTVHGKVLGKFVSLEGFAQPVAIFLGIPFAKPPLGPLRFTPPQPAEPWSFVKNATSYPPMCTQDPKAGQLLSELFTNRKENIPLKLSEDCLYLNIYTPADLTKKNRLPVMVWIHGGGLMVGAASTYDGLALAAHENVVVVTIQYRLGIWGFFSTGDEHSRGNWGHLDQVAALRWVQDNIASFGGNPGSVTIFGESAGGESVSVLVLSPLAKNLFHRAISESGVALTSVLVKKGDVKPLAEQIAITAGCKTTTSAVMVHCLRQKTEEELLETTLKMKFLSLDLQGDPRESQPLLGTVIDGMLLLKTPEELQAERNFHTVPYMVGINKQEFGWLIPMLMSYPLSEGQLDQKTAMSLLWKSYPLVCIAKELIPEATEKYLGGTDDTVKKKDLFLDLIADVMFGVPSVIVARNHRDAGAPTYMYEFQYRPSFSSDMKPKTVIGDHGDELFSVFGAPFLKEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 56059 - protein, 525 aa, Homo sapiens
MSGNWVHPGQILIWAIWVLAAPTKGPSAEGPQRNTRLGWIQGKQVTVLGSPVPVNVFLGVPFAAPPLGSLRFTNPQPASPWDNLREATSYPNLCLQNSEWLLLDQHMLKVHYPKFGVSEDCLYLNIYAPAHADTGSKLPVLVWFPGGAFKTGSASIFDGSALAAYEDVLVVVVQYRLGIFGFFTTWDQHAPGNWAFKDQVAALSWVQKNIEFFGGDPSSVTIFGESAGAISVSSLILSPMAKGLFHKAIMESGVAIIPYLEAHDYEKSEDLQVVAHFCGNNASDSEALLRCLRTKPSKELLTLSQKTKSFTRVVDGAFFPNEPLDLLSQKAFKAIPSIIGVNNHECGFLLPMKEAPEILSGSNKSLALHLIQNILHIPPQYLHLVANEYFHDKHSLTEIRDSLLDLLGDVFFVVPALITARYHREGATEEEKLLSRKMMKYWATFARTGNPNGNDLSLWPAYNLTEQYLQLDLNMSLGQRLKEPRVDFWTSTIPLILSASDMLHSPLSSLTFLSLLQPFFFFCAP

SEQ ID NO: 56060 - protein, 270 aa, Homo sapiens
MWLLVSVILISRISSVGGEAMFCDFPKINHGILYDEEKYKPFSQVPTGEVFYYSCEYNFVSPSKSFWTRITCAEEGWSPTPKCLRLCFFPFVENGHSESSGQTHLEGDTVQIICNTGYRLQNNENNISCVERGWSTPPKCRSTISAEKCGPPPPIDNGDITSFLLSVYAPGSSVEYQCQNLYQLEGNNQITCRNGQWSEPPKCLDPCVISQEIMEKYNIKLKWTNQQKLYSRTGDIVEFVCKSGYHPTKSHSFRAMCQNGKLVYPSCEEK

SEQ ID NO: 56061 - protein, 569 aa, Homo sapiens
MLLLFSVILISWVSTVGGEGTLCDFPKIHHGFLYDEEDYNPFSQVPTGEVFYYSCEYNFVSPSKSFWTRITCTEEGWSPTPKCLRMCSFPFVKNGHSESSGLIHLEGDTVQIICNTGYSLQNNEKNISCVERGWSTPPICSFTKGECHVPILEANVDAQPKKESYKVGDVLKFSCRKNLIRVGSDSVQCYQFGWSPNFPTCKGQVRSCGPPPQLSNGEVKEIRKEEYGHNEVVEYDCNPNFIINGPKKIQCVDGEWTTLPTCVEQVKTCGYIPELEYGYVQPSVPPYQHGVSVEVNCRNEYAMIGNNMITCINGIWTELPMCVATHQLKRCKIAGVNIKTLLKLSGKEFNHNSRIRYRCSDIFRYRHSVCINGKWNPEVDCTEKREQFCPPPPQIPNAQNMTTTVNYQDGEKVAVLCKENYLLPEAKEIVCKDGRWQSLPRCVESTAYCGPPPSINNGDTTSFPLSVYPPGSTVTYRCQSFYKLQGSVTVTCRNKQWSEPPRCLDPCVVSEENMNKNNIQLKWRNDGKLYAKTGDAVEFQCKFPHKAMISSPPFRAICQEGKFEYPICE

SEQ ID NO: 56062 - protein, 583 aa, Homo sapiens
MKLLHVFLLFLCFHLRFCKVTYTSQEDLVEKKCLAKKYTHLSCDKVFCQPWQRCIEGTCVCKLPYQCPKNGTAVCATNRRSFPTYCQQKSLECLHPGTKFLNNGTCTAEGKFSVSLKHGNTDSEGIVEVKLVDQDKTMFICKSSWSMREANVACLDLGFQQGADTQRRFKLSDLSINSTECLHVHCRGLETSLAECTFTKRRTMGYQDFADVVCYTQKADSPMDDFFQCVNGKYISQMKACDGINDCGDQSDELCCKACQGKGFHCKSGVCIPSQYQCNGEVDCITGEDEVGCAGFASVAQEETEILTADMDAERRRIKSLLPKLSCGVKNRMHIRRKRIVGGKRAQLGDLPWQVAIKDASGITCGGIYIGGCWILTAAHCLRASKTHRYQIWTTVVDWIHPDLKRIVIEYVDRIIFHENYNAGTYQNDIALIEMKKDGNKKDCELPRSIPACVPWSPYLFQPNDTCIVSGWGREKDNERVFSLQWGEVKLISNCSKFYGNRFYEKEMECAGTYDGSIDACKGDSGGPLVCMDANNVTYVWGVVSWGENCGKPEFPGFYTKVANYFDWISYHVGRPFISQYNV

SEQ ID NO: 56063 - protein, 627 aa, Homo sapiens
MELGGPGAPRLLPPLLLLLGTGLLRASSHVETRAHAEERLLKKLFSGYNKWSRPVANISDVVLVRFGLSIAQLIDVDEKNQMMTTNVWVKQEWHDYKLRWDPADYENVTSIRIPSELIWRPDIVLYNNADGDFAVTHLTKAHLFHDGRVQWTPPAIYKSSCSIDVTFFPFDQQNCTMKFGSWTYDKAKIDLVNMHSRVDQLDFWESGEWVIVDAVGTYNTRKYECCAEIYPDITYAFVIRRLPLFYTINLIIPCLLISCLTVLVFYLPSECGEKITLCISVLLSLTVFLLLITEIIPSTSLVIPLIGEYLLFTMIFVTLSIVITVFVLNVHHRSPRTHTMPTWVRRVFLDIVPRLLLMKRPSVVKDNCRRLIESMHKMASAPRFWPEPEGEPPATSGTQSLHPPSPSFCVPLDVPAEPGPSCKSPSDQLPPQQPLEAEKASPHPSPGPCRPPHGTQAPGLAKARSLSVQHMSSPGEAVEGGVRCRSRSIQYCVPRDDAAPEADGQAAGALASRNTHSAELPPPDQPSPCKCTCKKEPSSVSPSATVKTRSTKAPPPHLPLSPALTRAVEGVQYIADHLKAEDTDFSVKEDWKYVAMVIDRIFLWMFIIVCLLGTVGLFLPPWLAGMI

SEQ ID NO: 56064 - protein, 239 aa, Homo sapiens
MASTAVQLLGFLLSFLGMVGTLITTILPHWRRTAHVGTNILTAVSYLKGLWMECVWHSTGIYQCQIYRSLLALPQDLQAARALMVISCLLSGIACACAVIGMKCTRCAKGTPAKTTFAILGGTLFILAGLLCMVAVSWTTNDVVQNFYNPLLPSGMKFEIGQALYLGFISSSLSLIGGTLLCLSCQDEAPYRPYQAPPRATTTTANTAPAYQPPAAYKDNRAPSVTSATHSGYRLNDYV

SEQ ID NO: 56065 - protein, 239 aa, Homo sapiens; identical to SEQ ID NO: 56064

SEQ ID NO: 56066 - protein, 277 aa, Homo sapiens
MNGFASLLRRNQFILLVLFLLQIQSLGLDIDSRPTAEVCATHTISPGPKGDDGEKGDPGEEGKHGKVGRMGPKGIKGELGDMGDRGNIGKTGPIGKKGDKGEKGLLGIPGEKGKAGTVCDCGRYRKFVGQLDISIARLKTSMKFVKNVIAGIRETEEKFYYIVQEEKNYRESLTHCRIRGGMLAMPKDEAANTLIADYVAKSGFFRVFIGVNDLEREGQYMFTDNTPLQNYSNWNEGEPSDPYGHEDCVEMLSSGRWNDTECHLTMYFVCEFIKKKK

SEQ ID NO: 56067 - protein, 1065 aa, Homo sapiens
MKILILGIFLFLCSTPAWAKEKHYYIGIIETTWDYASDHGEKKLISVDTEHSNIYLQNGPDRIGRLYKKALYLQYTDETFRTTIEKPVWLGFLGPIIKAETGDKVYVHLKNLASRPYTFHSHGITYYKEHEGAIYPDNTTDFQRADDKVYPGEQYTYMLLATEEQSPGEGDGNCVTRIYHSHIDAPKDIASGLIGPLIICKKDSLDKEKEKHIDREFVVMFSVVDENFSWYLEDNIKTYCSEPEKVDKDNEDFQESNRMYSVNGYTFGSLPGLSMCAEDRVKWYLFGMGNEVDVHAAFFHGQALTNKNYRIDTINLFPATLFDAYMVAQNPGEWMLSCQNLNHLKAGLQAFFQVQECNKSSSKDNIRGKHVRHYYIAAEEIIWNYAPSGIDIFTKENLTAPGSDSAVFFEQGTTRIGGSYKKLVYREYTDASFTNRKERGPEEEHLGILGPVIWAEVGDTIRVTFHNKGAYPLSIEPIGVRFNKNNEGTYYSPNYNPQSRSVPPSASHVAPTETFTYEWTVPKEVGPTNADPVCLAKMYYSAVDPTKDIFTGLIGPMKICKKGSLHANGRQKDVDKEFYLFPTVFDENESLLLEDNIRMFTTAPDQVDKEDEDFQESNKMHSMNGFMYGNQPGLTMCKGDSVVWYLFSAGNEADVHGIYFSGNTYLWRGERRDTANLFPQTSLTLHMWPDTEGTFNVECLTTDHYTGGMKQKYTVNQCRRQSEDSTFYLGERTYYIAAVEVEWDYSPQREWEKELHHLQEQNVSNAFLDKGEFYIGSKYKKVVYRQYTDSTFRVPVERKAEEEHLGILGPQLHADVGDKVKIIFKNMATRPYSIHAHGVQTESSTVTPTLPGETLTYVWKIPERSGAGTEDSACIPWAYYSTVDQVKDLYSGLIGPLIVCRRPYLKVFNPRRKLEFALLFLVFDENESWYLDDNIKTYSDHPEKVNKDDEEFIESNKMHAINGRMFGNLQGLTMHVGDEVNWYLMGMGNEIDLHTVHFHGHSFQYKHRGVYSSDVFDIFPGTYQTLEMFPRTPGIWLLHCHVTDHIHAGMETTYTVLQNEDTKSG

SEQ ID NO: 56068 - protein, 423 aa, Homo sapiens
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKVSGKEQTAKNAIWIDCGIHAREWISPAFCLWFIGHITQFYGIIGQYTNLLRLVDFYVMPVVNVDGYDYSWKKNRMWRKNRSFYANNHCIGTDLNRNFASKHWCEEGASSSSCSETYCGLYPESEPEVKAVASFLRRNINQIKAYISMHSYSQHIVFPYSYTRSKSKDHEELSLVASEAVRAIEKTSKNTRYTHGHGSETLYLAPGGGDDWIYDLGIKYSFTIELRDTGTYGFLLPERYIKPTCREAFAAVSKIAWHVIRNV

SEQ ID NO: 56069 - protein, 360 aa, Homo sapiens
MKLCSLAVLVPIVLFCEQHVFAFQSGQVLAALPRTSRQVQVLQNLTTTYEIVLWQPVTADLIVKKKQVHFFVNASDVDNVKAHLNVSGIPCSVLLADVEDLIQQQISNDTVSPRASASYYEQYHSLNEIYSWIEFITERHPDMLTKIHIGSSFEKYPLYVLKVSGKEQAAKNAIWIDCGIHAREWISPAFCLWFIGHNRMWRKNRSFYANNHCIGTDLNRNFASKHWCEEGASSSSCSETYCGLYPESEPEVKAVASFLRRNINQIKAYISMHSYSQHIVFPYSYTRSKSKDHEELSLVASEAVRAIEKISKNTRYTHGHGSETLYLAPGGGDDWIYDLGIKYSFTSNPPVEKLLPLSLK

SEQ ID NO: 56070 - protein, 458 aa, Homo sapiens
MSDLLSVFLHLLLLFKLVAPVTFRHHRYDDLVRTLYKVQNECPGITRVYSIGRSVEGRHLYVLEFSDHPGIHEPLEPEVKYVGNMHGNEALGRELMLQLSEFLCEEFRNRNQRIVQLIQDTRIHILPSMNPDGYEVAAAQGPNKPGYLVGRNNANGVDLNRNFPDLNTYIYYNEKYGGPNHHLPLPDNWKSQVEPETRAVIRWMHSFNFVLSANLHGGAVVANYPYDKSFEHRVRGVRRTASTPTPDDKLFQKLAKVYSYAHGWMFQGWNCGDYFPDGITNGASWYSLSKGMQDFNYLHTNCFEITLELSCDKFPPEEELQREWLGNREALIQFLEQVHQGIKGMVLDENYNNLANAVISVSGINHDVTSGDHGDYFRLLLPGIYTVSATAPGYDPETVTVTVGPAEPTLVNFHLKRSIPQVSPVRRAPSRRHGVRAKVQPQARKKEMEMRQLQRGPA

SEQ ID NO: 56071 - protein, 545 aa, Homo sapiens
MLPGAWLLWTSLLLLARPAQPCPMGCDCFVQEVFCSDEELATVPLDIPPYTKNIIFVETSFTTLETRAFGSNPNLTKVVFLNTQLCQFRPDAFGGLPRLEDLEVTGSSFLNLSTNIFSNLTSLGKLTLNFNMLEALPEGLFQHLAALESLHLQGNQLQALPRRLFQPLTHLKTLNLAQNLLAQLPEELFHPLTSLQTLKLSNNALSGLPQGVFGKLGSLQELFLDSNNISELPPQVFSQLFCLERLWLQRNAITHLPLSIFASLGNLTFLSLQWNMLRVLPAGLFAHTPCLVGLSLTHNQLETVAEGTFAHLSNLRSLMLSYNAITHLPAGIFRDLEELVKLYLGSNNLTALHPALFQNLSKLELLSLSKNQLTTLPEGIFDTNYNLFNLALHGNPWQCDCHLAYLFNWLQQYTDRLLNIQTYCAGPAYLKGQVVPALNEKQLVCPVTRDHLGFQVTWPDESKAGGSWDLAVQERAARSQCTYSNPEGTVVLACDQAQCRWLNVQLSPWQGSLGLQYNASQEWDLRSSCGSLRLTVSIEARAAGP

SEQ ID NO: 56072 - protein, 545 aa, Homo sapiens [sequence omitted]

SEQ ID NO: 56073 - protein, 2017 aa, Homo sapiens
MSLGLAGAQEVELTLETVIQTLESSVLCQEKGLGARDLAQDAQITSLPALIREIVTRNLSQPESPVLLPATEMASLLSLQEENQLLQQELSRVEDLLAQSRAERDELAIKYNAVSERLEQALRLEPGELETQEPRGLVRQSVELRRQLQEEQASYRRKLQAYQEGQQRQAQLVQRLQGKILQYKKRCSELEQQLLERSGELEQQRLRDTEHSQDLESALIRLEEEQQRSASLAQVNAMLREQLDQAGSANQALSEDIRKVTNDWTRCRKELEHREAAWRREEESFNAYFSNEHSRLLLLWRQVVGFRRLVSEVKMFTERDLLQLGGELARTSRAVQEAGLGLSTGLRLAESRAEAALEKQALLQAQLEEQLRDKVLREKDLAQQQMQSDLDKADLSARVTELGLAVKRLEKQNLEKDQVNKDLTEKLEALESLRLQEQAALETEDGEGLQQTLRDLAQAVLSDSESGVQLSGSERTADASNGSLRGLSGQRTPSPPRRSSPGRGRSPRRGPSPACSDSSTLALIHSALHKRQLQVQDMRGRYEASQDLLGTLRKQLSDSESERRALEEQLQRLRDKTDGAMQAHEDAQREVQRLRSANELLSREKSNLAHSLQVAQQQAEELRQEREKLQAAQEELRRQRDRLEEEQEDAVQDGARVRRELERSHRQLEQLEGKRSVLAKELVEVREALSRATLQRDMLQAEKAEVAEALTKAEAGRVELELSMTKLRAEEASLQDSLSKLSALNESLAQDKLDLNRLVAQLEEEKSALQGRQRQAEQEATVAREEQERLEELRLEQEVARQGLEGSLRVAEQAQEALEQQLPTLRHERSQLQEQLAQLSRQLSGREQELEQARREAQRQVEALERAAREKEALAKEHAGLAVQLVAAEREGRTLSEEATRLRLEKEALEGSLFEVQRQLAQLEARREQLEAEGQALLLAKETLTGELAGLRQQIIATQEKASLDKELMAQKLVQAEREAQASLREQRAAHEEDLQRLQREKEAAWRELEAERAQLQSQLQREQEELLARLEAEKEELSEEIAALQQERDEGLLLAESEKQQALSLKESEKTALSEKLMGTRHSLATISLEMERQKRDAQSRQEQDRSTVNALTSELRDLRAQREEAAAAHAQEVRRLQEQARDLGKQRDSCLREAEELRTQLRLLEDARDGLRRELLEAQRKLRESQEGREVQRQEAGELRRSLGEGAKEREALRRSNEELRSAVKKAESERISLKLANEDKEQKLALLEEARTAVGKEAGELRTGLQEVERSRLEARRELQELRRQMKMLDSENTRLGRELAELQGRLALGERAEKESRRETLGLRQRLLKGEASLEVMRQELQVAQRKLQEQEGEFRTRERRLLGSLEEARGTEKQQLDHARGLELKLEAARAEAAELGLRLSAAEGRAQGLEAELARVEVQRRAAEAQLGGLRSALRRGLGLGRAPSPAPRPVPGSPARDAPAEGSGEGLNSPSTLECSPGSQPPSPGPATSPASPDLDPEAVRGALREFLQELRSAQRERDELRTQTSALNRQLAEMEAERDSATSRARQLQKAVAESEEARRSVDGRLSGVQAELALQEESVRRSERERRATLDQVATLERSLQATESELRASQEKISKMKANETKLEGDKRRLKEVLDASESRTVKLELQRRSLEGELQRSRLGLSDREAQAQALQDRVDSLQRQVADSEVKAGTLQLTVERLNGALAKVEESEGALRDKVRGLTEALAQSSASLNSTRDKNLHLQKALTACEHDRQVLQERLDAARQALSEARKQSSSLGEQVQTLRGEVADLELQRVEAEGQLQQLREVLRQRQEGEAAALNTVQKLQDERRLLQERLGSLQRALAQLEAEKREVERSALRLEKDRVALRRTLDKVEREKLRSHEDTVRLSAEKGRLDRTLTGAELELAEAQRQIQQLEAQVVVLEQSHSPAQLEVDAQQQQLELQQEVERLRSAQAQTERTLEARERAHRQRVRGLEEQVSTLKGQLQQELRRSSAPFSPPSGPPEK

SEQ ID NO: 56074 - protein, 224 aa, Homo sapiens
MEKLLCFLVLTSLSHAFGQTDMSRKAFVFPKESDTSYVSLKAPLTKPLKAFTVCLHFYTELSSTRGYSIFSYATKRQDNEILIFWSKDIGYSFTVGGSEILFEVPEVTVAPVHICTSWESASGIVEFWVDGKPRVRKSLKKGYTVGAEASIILGQEQDSFGGNFEGSQSLVGDIGNVNMWDFVLSPDEINTIYLGGPFSPNVLNWRALKYEVQGEVFTKPQLWP

SEQ ID NO: 56075 - protein, 516 aa, Homo sapiens
MALSQSVPFSATELLLASAIFCLVFWVLKGLRPRVPKGLKSPPEPWGWPLLGHVLTLGKNPHLALSRMSQRYGDVLQIRIGSTPVLVLSRLDTIRQALVRQGDDFKGRPDLYTSTLITDGQSLTFSTDSGPVWAARRRLAQNALNTFSIASDPASSSSCYLEEHVSKEAKALISRLQELMAGPGHFDPYNQVVVSVANVIGAMCFGQHFPESSDEMLSLVKNTHEFVETASSGNPLDFFPILRYLPNPALQRFKAFNQRFLWFLQKTVQEHYQDFDKNSVRDITGALFKHSKKGPRASGNLIPQEKIVNLVNDIFGAGFDTVTTAISWSLMYLVTKPEIQRKIQKELDTVIGRERRPRLSDRPQLPYLEAFILETFRHSSFLPFTIPHSTTRDTTLNGFYIPKKCCVFVNQWQVNHDPELWEDPSEFRPERFLTADGTAINKPLSEKMMLFGMGKRRCIGEVLAKWEIFLFLAILLQQLEFSVPPGVKVDLTPIYGLTMKHARCEHVQARLRFSIN

SEQ ID NO: 56076 - protein, 497 aa, Homo sapiens
MGLPALLASALCTFVLPLLLFLAAIKLWDLYCVSGRDRSCALPLPPGTMGFPFFGETLQMVLQRRKFLQMKRRKYGFIYKTHLFGRPTVRVMGADNVRRILLGEHRLVSVHWPASVRTILGSGCLSNLHDSSHKQRKKVIMRAFSREALECYVPVITEEVGSSLEQWLSCGERGLLVYPEVKRLMFRIAMRILLGCEPQLAGDGDSEQQLVEAFEEMTRNLFSLPIDVPFSGLYRGMKARNLIHARIEQNIRAKICGLRASEAGQGCKDALQLLIEHSWERGERLDMQALKQSSTELLFGGHETTASAATSLITYLGLYPHVLQKVREELKSKGLLCKSNQDNKLDMEILEQLKYIGCVIKETLRLNPPVPGGFRVALKTFELNGYQIPKGWNVIYSICDTHDVAEIFTNKEEFNPDRFMLPHPEDASRFSFIPFGGGLRSCVGKEFAKILLKIFTVELARHCDWQLLNGPPTMKTSPTVYPVDNLPARFTHFHGEI

SEQ ID NO: 56077 - protein, 428 aa, Homo sapiens
MKRRKYGFIYKTHLFGRPTVRVMGADNVRRILLGEHRLVSVHWPASVRTILGSGCLSNLHDSSHKQRKKVIMRAFSREALECYVPVITEEVGSSLEQWLSCGERGLLVYPEVKRLMFRIAMRILLGCEPQLAGDGDSEQQLVEAFEEMTRNLFSLPIDVPFSGLYRGMKARNLIHARIEQNIRAKICGLRASEAGQGCKDALQLLIEHSWERGERLDMQALKQSSTELLFGGHETTASAATSLITYLGLYPHVLQKVREELKSKGLLCKSNQDNKLDMEILEQLKYIGCVIKETLRLNPPVPGGFRVALKTFELNGYQIPKGWNVIYSICDTHDVAEIFTNKEEFNPDRFMLPHPEDASRFSFIPFGGGLRSCVGKEFAKILLKIFTVELARHCDWQLLNGPPTMKTSPTVYPVDNLPARFTHFHGEI

SEQ ID NO: 56078 - protein, 494 aa, Homo sapiens
MLASGLLLVTLLACLTVMVLMSVWRQRKSRGKLPPGPTPLPFIGNYLQLNTEQMYNSLMKISERYGPVFTIHLGPRRVVVLCGHDAVKEALVDQAEEFSGRGEQATFDWLFKGYGVAFSNGERAKQLRRFSIATLRGFGVGKRGIEERIQEEAGFLIDALRGTHGANIDPTFFLSRTVSNVISSIVFGDRFDYEDKEFLSLLRMMLGSFQFTATSTGQLYEMFSSVMKHLPGPQQQAFKELQGLEDFIAKKVEHNQRTLDPNSPRDFIDSFLIRMQEEEKNPNTEFYLKNLVMTTLNLFFAGTETVSTTLRYGFLLLMKHPEVEAKVHEEIDRVIGKNRQPKFEDRAKMPYTEAVIHEIQRFGDMLPMGLAHRVNKDTKFRDFFLPKGTEVFPMLGSVLRDPRFFSNPRDFNPQHFLDKKGQFKKSDAFVPFSIGKRYCFGEGLARMELFLFFTTIMQNFRFKSPQSPKDIDVSPKHVGFATIPRNYTMSFLPR

SEQ ID NO: 56079 - protein, 494 aa, Homo sapiens
MLASGMLLVALLVCLTVMVLMSVWQQRKSKGKLPPGPTPLPFIGNYLQLNTEQMYNSLMKISERYGPVFTIHLGPRRVVVLCGHDAVREALVDQAEEFSGRGEQATFDWVFKGYGVVFSNGERAKQLRRFSIATLRDFGVGKRGIEERIQEEAGFLIDALRGTGGANIDPTFFLSRTVSNVISSIVFGDRFDYKDKEFLSLLRMMLGIFQFTSTSTGQLYEMFSSVMKHLPGPQQQAFQLLQGLEDFIAKKVEHNQRTLDPNSPRDFIDSFLIRMQEEEKNPNTEFYLKNLVMTTLNLFIGGTETVSTTLRYGFLLLMKHPEVEAKVHEEIDRVIGKNRQPKFEDRAKMPYMEAVIHEIQRFGDVIPMSLARRVKKDTKFRDFFLPKGTEVFPMLGSVLRDPSFFSNPQDFNPQHFLNEKGQFKKSDAFVPFSIGKRNCFGEGLARMELFLFFTTVMQNFRLKSSQSPKDIDVSPKHVGFATIPRNYTMSFLPR

SEQ ID NO: 56080 - protein, 494 aa, Homo sapiens
MLASGLLLVALLACLTVMVLMSVWQQRKSRGKLPPGPTPLPFIGNYLQLNTEHICDSIMKFSECYGPVFTIHLGPRRVVVLCGHDAVREALVDQAEEFSGRGEQATFDWVFKGYGVAFSNGERAKQLLRFAIATLRDFGVGKRGIEERIQEESGFLIEAIRSTHGANIDPTFFLSRTVSNVISSIVFGDRFDYEDKEFLSLLSMMLGIFQFTSTSTGQLYEMFSSVMKHLPGPQQQAFKLLQGLEDFIAKKVEHNQRTLDPNSPQDFIDSFLIHMQEEEKNPNTEFYLKNLMMSTLNLFIAGTETVSTTLRYGFLLLMKHPEVEAKVHEEIDRVIGKNRQPKFEDRTKMPYMEAVIHEIQRFGDVIPMSLARRVKKDTKFRDFFLPKGTEVFPMLGSVLRDPSFFSNPQDFNPQHFLDDKGQFKKSDAFVPFSIGKRNCFGEGLARMELFLFFTTVMQNFRLKSSQSPKDIDVSPKHVVFATIPRNYTMSFLPR

SEQ ID NO: 56081 - protein, 443 aa, Homo sapiens
MLASGLLLVALLACLTVMVLMSVWQQRKSRGKLPPGPTPLPFIGNYLQLNTEHICDSIMKVSQGVAFSNGERAKQLLRFAIATLRDFGVGKRGIEERIQEESGFLIEAIRSTHGANIDPTFFLSRTVSNVISSIVFGDRFDYEDKEFLSLLSMMLGIFQFTSTSTGQLYEMFSSVMKHLPGPQQQAFKLLQGLEDFIAKKVEHNQRTLDPNSPQDFIDSFLIHMQEEEKNPNTEFYLKNLMMSTLNLFIAGTETVSTTLRYGFLLLMKHPEVEAKVHEEIDRVIGKNRQPKFEDRTKMPYMEAVIHEIQRFGDVIPMSLARRVKKDTKFRDFFLPKGTEVFPMLGSVLRDPSFFSNPQDFNPQHFLDDKGQFKKSDAFVPFSIGKRNCFGEGLARMELFLFFTTVMQNFRLKSSQSPKDIDVSPKHVVFATIPRNYTMSFLPR

SEQ ID NO: 56082 - protein, 491 aa, Homo sapiens
MELSVLLFLALLTGLLLLLVQRHPNTHDRLPPGPRPLPLLGNLLQMDRRGLLKSFLRFREKYGDVFTVHLGPRPVVMLCGVEAIREALVDKAEAFSGRGKIAMVDPFFRGYGVIFANGNRWKVLRRFSVTTMRDFGMGKRSVEERIQEEAQCLIEELRKSKGALMDPTFLFQSITANIICSIVFGKRFHYQDQEFLKMLNLFYQTFSLISSVFGQLFELFSGFLKYFPGAHRQVYKNLQEINAYIGHSVEKHRETLDPSAPKDLIDTYLLHMEKEKSNAHSEFSHQNLNLNTLSLFFAGTETTSTTLRYGFLLMLKYPHVAERVYREIEQVIGPHRPPELHDRAKMPYTEAVIYEIQRFSDLLPMGVPHIVTQHTSFRGYIIPKDTEVFLILSTALHDPHYFEKPDAFNPDHFLDANGALKKTEAFIPFSLGKRICLGEGIARAELFLFFTTILQNFSMASPVAPEDIDLTPQECGVGKIPPTYQIRFLPR

SEQ ID NO: 56083 - protein, 490 aa, Homo sapiens
MDPAVALVLCLSCLFLLSLWRQSSGRGRLPSGPTPLPIIGNILQLDVKDMSKSLTNFSKVYGPVFTVYFGLKPIVVLHGYEAVKEALIDHGEEFSGRGSFPVAEKVNKGLGILFSNGKRWKEIRRFCLMTLRNFGMGKRSIEDRVQEEARCLVEELRKTNASPCDPTFILGCAPCNVICSVIFHDRFDYKDQRFLNLMEKFNENLRILSSPWIQVCNNFPALIDYLPGSHNKIAENFAYIKSYVLERIKEHQESLDMNSARDFIDCFLIKMEQEKHNQQSEFTVESLIATVTDMFGAGTETTSTTLRYGLLLLLKYPEVTAKVQEEIECVVGRNRSPCMQDRSHMPYTDAVVHEIQRYIDLLPTNLPHAVTCDVKFKNYLIPKGTTIITSLTSVLHNDKEFPNPEMFDPGHFLDKSGNFKKSDYFMPFSAGKRMCMGEGLARMELFLFLTTILQNFNLKSQVDPKDIDITPIANAFGRVPPLYQLCFIPV

SEQ ID NO: 56084 - protein, 490 aa, Homo sapiens
MDPFVVLVLCLSCLLLLSIWRQSSGRGKLPPGPTPLPVIGNILQIDIKDVSKSLTNLSKIYGPVFTLYFGLERMVVLHGYEVVKEALIDLGEEFSGRGHFPLAERANRGFGIVFSNGKRWKEIRRFSLMTLRNFGMGKRSIEDRVQEEARCLVEELRKTKASPCDPTFILGCAPCNVICSIIFQKRFDYKDQQFLNLMEKLNENIRIVSTPWIQICNNFPTIIDYFPGTHNKLLKNLAFMESDILEKVKEHQESMDINNPRDFIDCFLIKMEKEKQNQQSEFTIENLVITAADLLGAGTETTSTTLRYALLLLLKHPEVTAKVQEEIERVIGRNRSPCMQDRGHMPYTDAVVHEVQRYIDLIPTSLPHAVTCDVKFRNYLIPKGTTILTSLTSVLHDNKEFPNPEMFDPRHFLDEGGNFKKSNYFMPFSAGKRICVGEGLARMELFLFLTFILQNFNLKSLIDPKDLDTTPVVNGFASVPPFYQLCFIPV

SEQ ID NO: 56085 - protein, 490 aa, Homo sapiens
MEPFVVLVLCLSFMLLFSLWRQSCRRRKLPPGPTPLPIIGNMLQIDVKDICKSFTNFSKVYGPVFTVYFGMNPIVVFHGYEAVKEALIDNGEEFSGRGNSPISQRITKGLGIISSNGKRWKEIRRFSLTNLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFMDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKGTTIMALLTSVLHDDKEFPNPNIFDPGHFLDKNGNFKKSDYFMPFSAGKRICAGEGLARMELFLFLTTILQNFNLKSVDDLKNLNTTAVTKGIVSLPPSYQICFIPV

SEQ ID NO: 56086 - protein, 393 aa, Homo sapiens
MEPFVVLVLCLSFMLLFSLWRQSCRRRKLPPGPTPLPIIGNMLQIDVKDICKSFTNFSKVYGPVFTVYFGMNPIVVFHGYEAVKEALIDNGEEFSGRGNSPISQRITKGLGIISSNGKRWKEIRRFSLTNLRNFGMGKRSIEDRVQEEAHCLVEELRKTKASPCDPTFILGCAPCNVICSVVFQKRFDYKDQNFLTLMKRFNENFRILNSPWIQVCNNFPLLIDCFPGTHNKVLKNVALTRSYIREKVKEHQASLDVNNPRDFMDCFLIKMEQEKDNQKSEFNIENLVGTVADLFVAGTETTSTTLRYGLLLLLKHPEVTAKVQEEIDHVIGRHRSPCMQDRSHMPYTDAVVHEIQRYSDLVPTGVPHAVTTDTKFRNYLIPKSFDNKIMLAA

SEQ ID NO: 56087 - protein, 497 aa, Homo sapiens
MGLEALVPLAVIVAIFLLLVDLMHRRQRWAARYPPGPLPLPGLGNLLHVDFQNTPYCFDQLRRRFGDVFSLQLAWTPVVVLNGLAAVREALVTHGEDTADRPPVPITQILGFGPRSQGVFLARYGPAWREQRRFSVSTLRNLGLGKKSLEQWVTEEAACLCAAFANHSGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLCIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVTPSPYELCAVPR

SEQ ID NO: 56088 - protein, 446 aa, Homo sapiens
MGLEALVPLAVIVAIFLLLVDLMHRRQRWAARYPPGPLPLPGLGNLLHVDFQNTPYCFDQLRRRFGDVFSLQLAWTPVVVLNGLAAVREALVTHGEDTADRPPVPITQILGFGPRSQGRPFRPNGLLDKAVSNVIASLTCGRRFEYDDPRFLRLLDLAQEGLKEESGFLREVLNAVPVLLHIPALAGKVLRFQKAFLTQLDELLTEHRMTWDPAQPPRDLTEAFLAEMEKAKGNPESSFNDENLCIVVADLFSAGMVTTSTTLAWGLLLMILHPDVQRRVQQEIDDVIGQVRRPEMGDQAHMPYTTAVIHEVQRFGDIVPLGVTHMTSRDIEVQGFRIPKGTTLITNLSSVLKDEAVWEKPFRFHPEHFLDAQGHFVKPEAFLPFSAGRRACLGEPLARMELFLFFTSLLQHFSFSVPTGQPRPSHHGVFAFLVTPSPYELCAVPR

SEQ ID NO: 56089 - protein, 503 aa, Homo sapiens
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKEMVPIIAQYGDVLVRNLRREAETGKPVTLKDVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKKDVEINGMFIPKGVVVMIPSYALHRDPKYWTEPEKFLPERFSKKNKDNIDPYIYTPFGSGPRNCIGMRFALMNMKLALIRVLQNFSFKPCKETQIPLKLSLGGLLQPEKPVVLKVESRDGTVSGA

SEQ ID NO: 56090 - protein, 503 aa, Homo sapiens
MDLIPNLAVETWLLLAVSLILLYLYGTRTHGLFKKLGIPGPTPLPFLGNALSFRKGYWTFDMECYKKYRKVWGIYDCQQPMLAITDPDMIKTVLVKECYSVFTNRRPFGPVGFMKNAISIAEDEEWKRIRSLLSPTFTSGKLKEMVPIIAQYGDVLVRNLRREAETGKPVTLKHVFGAYSMDVITSTSFGVSIDSLNNPQDPFVENTKKLLRFNPLDPFVLSIKVFPFLTPILEALNITVFPRKVISFLTKSVKQIKEGRLKETQKHRVDFLQLMIDSQNSKDSETHKALSDLELMAQSIIFIFAGYETTSSVLSFIIYELATHPDVQQKVQKEIDTVLPNKAPPTYDTVLQLEYLDMVVNETLRLFPVAMRLERVCKKDVEINGMFIPKGVVVMIPSYVLHHDPKYWTEPEKFLPERFSKKNKDNIDPYIYTPFGSGPRNCIGMRFALVNMKLALVRVLQNFSFKPCKETQIPLKLRFGGLLLTEKPIVLKAESRDETVSGA

SEQ ID NO: 56091 - protein, 501 aa, Homo sapiens
MVLWGPVLGALLVVIAGYLCLPGMLRQRRPWEPPLDKGTVPWLGHAMAFRKNMFEFLKRMRTKHGDVFTVQLGGQYFTFVMDPLSFGPILKDTQRKLDFGQYAKKLVLKVFGYRSVQGDHEMIHSASTKHLRGDGLKDLNETMLDSLSFVMLTSKGWSLDASCWHEDSLFRFCYYILFTAGYLSLFGYTKDKEQDLLQAGELFMEFRKFDLLFPRFVYSLLWPREWLEVGRLQRLFHKMLSVSHSQEKEGISNWLGNMLQFLREQGVPSAMQDKFNFMMLWASQGNTGPTSFWALLYLLKHPEAIRAVREEATQVLGEARLETKQSFAFKLGALQHTPVLDSVVEETLRLRAAPTLLRLVHEDYTLKMSSGQEYLFRHGDILALFPYLSVHMDPDIHPEPTVFKYDRFLNPNGSRKVDFFKTGKKIHHYTMPWGSGVSICPGRFFALSEVKLFILLMVTHFDLELVDPDTPLPHVDPQRWGFGTMQPSHDVRFRYRLHPTE

SEQ ID NO: 56092 - protein, 347 aa, Homo sapiens
MRVVVIGAGVIGLSTALCIHERYHSVLQPLHIKVYADRFTPLTTTDVAAGLWQPYLSDPNNPQEADWSQQTFDYLLSHVHSPNAENLGLFLISGYNLFHEAIPDPSWKDTVLGFRKLTPRELDMFPDYGYGWFHTSLILEGKNYLQWLTERLTERGVKFFQRKVESFEEVAREGADVIVNCTGVWAGALQRDPLLQPGRGQIMKVDAPWMKHFILTHDPERGIYNSPYIIPGTQTVTLGGIFQLGNWSELNNIQDHNTIWEGCCRLEPTLKNARIIGERTGFRPVRPQIRLEREQLRTGPSNTEVIHNYGHGGYGLTIHWGCALEAAKLFGRILEEKKLSRMPPSHL

SEQ ID NO: 56093 - protein, 94 aa, Homo sapiens
MRTLAILAAILLVALQAQAEPLQARADEVAAAPEQIAADIPEVVVSLAWDESLAPKHPGSRKNMDCYCRIPACIAGERRYGTCIYQGRLWAFCC

SEQ ID NO: 56094 - protein, 249 aa, Homo sapiens
  MOD_RES 126: Xaa = Selenocysteine
MGLPQPGLWLKRLWVLLEVAVHVVVGKVLLILFPDRVKRNILAMGEKTGMTRNPHFSHDNWIPTFFSTQYFWFVLKVRWQRLEDTTELGGLAPNCPVVRLSGQRCNIWEFMQGNRPLVLNFGSCTXPSFMFKFDQFKRLIEDFSSIADFLVIYIEEAHASDGWAFKNNMDIRNHQNLQDRLQAAHLLLARSPQCPVVVDTMQNQSSQLYAALPERLYIIQEGRILYKGKSGPWNYNPEEVRAVLEKLHS

SEQ ID NO: 56095 - protein, 185 aa, Homo sapiens
  MOD_RES 62: Xaa = Selenocysteine
MGLPQPGLWLKRLWVLLEVAVHVVVGKVLLILFPDRVKRNILAMGEKTGNRPLVLNFGSCTXPSFMFKFDQFKRLIEDFSSIADFLVIYIEEAHASDGWAFKNNMDIRNHQNLQDRLQAAHLLLARSPQCPVVVDTMQNQSSQLYAALPERLYIIQEGRILYKGKSGPWNYNPEEVRAVLEKLHS

SEQ ID NO: 56096 - protein, 866 aa, Homo sapiens
MLRPGAQLLRGLLLRSCPLQGSPGRPRSVCGREGEEKPPLSAETQWKDRAETVIIGGGCVGVSLAYHLAKAGMKDVVLLEKSELTAGSTWHAAGLTTYFHPGINLKKIHYDSIKLYEKLEEETGQVVGFHQPGSIRLATTPVRVDEFKYQMTRTGWHATEQYLIEPEKIQEMFPLLNMNKVLAGLYNPGDGHIDPYSLTMALAAGARKCGALLKYPAPVTSLKARSDGTWDVETPQGSMRANRIVNAAGFWAREVGKMIGLEHPLIPVQHQYVVTSTISEVKALKRELPVLRDLEGSYYLRQERDGLLFGPYESQEKMKVQDSWVTNGVPPGFGKELFESDLDRIMEHIKAAMEMVPVLKKADIINVVNGPITYSPDILPMVGPHQGVRNYWVAIGFGYGIIHAGGVGKYLSDWILHGEPPFDLIELDPNRYGKWTTTQYTEAKARESYGFNNIVGYPKEERFAGRPTQRVSGLYQRLESKCSMGFHAGWEQPHWFYKPGQDTQYRPSFRRTNWFEPVGSEYKQVMQRVAVTDLSPFGKFNIKGQDSIRLLDHLFANVIPKVGFTNISHMLTPKGRVYAELTVSHQSPGEFLLITGSGSELHDLRWIEEEAVKGGYDVEIKNITDELGVLGVAGPQARKVLQKLTSEDLSDDVFKFLQTKSLKVSNIPVTAIRISYTGELGWELYHRREDSVALYDAIMNAGQEEGIDNFGTYAMNALRLEKAFRAWGLEMNCDTNPLEAGLEYFVKLNKPADFIGKQALKQIKAKGLKRRLVCLTLATDDVDPEGNESIWYNGKVVGNTTSGSYSYSIQKSLAFAYVPVQLSEVGQQVEVELLGKNYPAVIIQEPLVLTEPTRNRLQKKGGKDKT

SEQ ID NO: 56097 - protein, 387 aa, Homo sapiens
MAAIPALDPEAEPSMDVILVGSSELSSSVSPGTGRDLIAYEVKANQRNIEDICICCGSLQVHTQHPLFEGGICAPCKDKFLDALFLYDDDGYQSYCSICCSGETLLICGNPDCTRCYCFECVDSLVGPGTSGKVHAMSNWVCYLCLPSSRSGLLQRRRKWRSQLKAFYDRESENPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSSRHWALVSEEELSLLAQNKQSSKLAAKWPTKLVKNCFLPLREYFKYFSTELTSSL

SEQ ID NO: 56098 - protein, 386 aa, Homo sapiens
MAAIPALDPEAEPSMDVILVGSSELSSSVSPGTGRDLIAYEVKANQRNIEDICICCGSLQVHTQHPLFEGGICAPCKDKFLDALFLYDDDGYQSYCSICCSGETLLICGNPDCTRCYCFECVDSLVGPGTSGKVHAMSNWVCYLCLPSSRSGLLQRRRKWRSQLKAFYDRESENPLEMFETVPVWRRQPVRVLSLFEDIKKELTSLGFLESGSDPGQLKHVVDVTDTVRKDVEEWGPFDLVYGATPPLGHTCDRPPSWYLFQFHRLLQYARPKPGSPRPFFWMFVDNLVLNKEDLDVASRFLEMEPVTIPDVHGGSLQNAVRVWSNIPAIRSRHWALVSEEELSLLAQNKQSSKLAAKWPTKLVKNCFLPLREYFKYFSTELTSSL

SEQ ID NO: 56099 - protein, 455 aa, Homo sapiens
MWLEILLTSVLGFAIYWFISRDKEETLPLEDGWWGPGTRSAAREDDSIRPFKVETSDEEIHDLHQRIDKFRFTPPLEDSCFHYGFNSNYLKKVISYWRNEFDWKKQVEILNRYPHFKTKIEGLDIHFIHVKPPQLPAGHTPKPLLMVHGWPGSFYEFYKIIPLLTDPKNHGLSDEHVFEVICPSIPGYGFSEASSKKGFNSVATARIFYKLMLRLGFQEFYIQGGDWGSLICTNMAQLVPSHVKGLHLNMALVLSNFSTLTLLLGQRFGRFLGLTERDVELLYPVKEKVFYSLMRESGYMHIQCTKPDTVGSALNDSPVGLAAYILEKFSTWTNTEFRYLEDGGLERKFSLDDLLTNVMLYWTTGTIISSQRFYKENLGQGWMTQKHERMKVYVPTGFSAFPFELLHTPEKWVRFKYPKLISYSYMVRGGHFAAFEEPELLAQDIRKFLSVLERQ

SEQ ID NO: 56100 - protein, 625 aa, Homo sapiens
MIFLYQVVHFILFTSVSGECVTQLLKDTCFEGGDITTVFTPSAKYCQVVCTYHPRCLLFTFTAESPSEDPTRWFTCVLKDSVTETLPRVNRTAAISGYSFKQCSHQISACNKDIYVDLDMKGINYNSSVAKSAQECQERCTDDVHCHFFTYATRQFPSLEHRNICLLKHTQTGTPTRITKLDKVVSGFSLKSCALSNLACIRDIFPNTVFADSNIDSVMAPDAFVCGRICTHHPGCLFFTFFSQEWPKESQRNLCLLKTSESGLPSTRIKKSKALSGFSLQSCRHSIPVFCHSSFYHDTDFLGEELDIVAAKSHEACQKLCTNAVRCQFFTYTPAQASCNEGKGKCYLKLSSNGSPTKILHGRGGISGYTLRLCKMDNECTTKIKPRIVGGTASVRGEWPWQVTLHTTSPTQRHLCGGSIIGNQWILTAAHCFYGVESPKILRVYSGILNQSEIKEDTSFFGVQEIIIHDQYKMAESGYDIALLKLETTVNYTDSQRPICLPSKGDRNVIYTDCWVTGWGYRKLRDKIQNTLQKAKIPLVTNEECQKRYRGHKITHKMICAGYREGGKDACKGDSGGPLSCKHNEVWHLVGITSWGEGCAQRERPGVYTNVVEYVDWILEKTQAV

SEQ ID NO: 56101 - protein, 571 aa, Homo sapiens
MIFLYQVVHFILFTSVSGECVTQLLKDTCFEGGDITTVFTPSAKYCQVVCTYHPRCLLFTFTAESPSEDPTRWFTCVLKDSVTETLPRVNRTAAISGYSFKQCSHQISNICLLKHTQTGTPTRITKLDKVVSGFSLKSCALSNLACIRDIFPNTVFADSNIDSVMAPDAFVCGRICTHHPGCLFFTFFSQEWPKESQRNLCLLKTSESGLPSTRIKKSKALSGFSLQSCRHSIPVFCHSSFYHDTDFLGEELDIVAAKSHEACQKLCTNAVRCQFFTYTPAQASCNEGKGKCYLKLSSNGSPTKILHGRGGISGYTLRLCKMDNECTTKIKPRIVGGTASVRGEWPWQVTLHTTSPTQRHLCGGSIIGNQWILTAAHCFYGVESPKILRVYSGILNQSEIKEDTSFFGVQEIIIHDQYKMAESGYDIALLKLETTVNYTDSQRPICLPSKGDRNVIYTDCWVTGWGYRKLRDKIQNTLQKAKIPLVTNEECQKRYRGHKITHKMICAGYREGGKDACKGDSGGPLSCKHNEVWHLVGITSWGEGCAQRERPGVYTNVVEYVDWILEKTQAV

SEQ ID NO: 56102 - protein, 615 aa, Homo sapiens
MRALLLLGFLLVSLESTLSIPPWEAPKEHKYKAEEHTVVLTVTGEPCHFPFQYHRQLYHKCTHKGRPGPQPWCATTPNFDQDQRWGYCLEPKKVKDHCSKHSPCQKGGTCVNMPSGPHCLCPQHLTGNHCQKEKCFEPQLLRFFHKNEIWYRTEQAAVARCQCKGPDAHCQRLASQACRTNPCLHGGRCLEVEGHRLCHCPVGYTGPFCDVDTKASCYDGRGLSYRGLARTTLSGAPCQPWASEATYRNVTAEQARNWGLGGHAFCRNPDNDIRPWCFVLNRDRLSWEYCDLAQCQTPTQAAPPTPVSPRLHVPLMPAQPAPPKPQPTTRTPPQSQTPGALPAKREQPPSLTRNGPLSCGQRLRKSLSSMTRVVGGLVALRGAHPYIAALYWGHSFCAGSLIAPCWVLTAAHCLQDRPAPEDLTVVLGQERRNHSCEPCQTLAVRSYRLHEAFSPVSYQHDLALLRLQEDADGSCALLSPYVQPVCLPSGAARPSETTLCQVAGWGHQFEGAEEYASFLQEAQVPFLSLERCSAPDVHGSSILPGMLCAGFLEGGTDACQGDSGGPLVCEDQAAERRLTLQGIISWGSGCGDRNKPGVYTDVAYYLAWIREHTVS

SEQ ID NO: 56103 - protein, 661 aa, Homo sapiens
MRLKNLTFIIILIISGELYAEEKPCGFPHVENGRIAQYYYTFKSFYFPMSIDKKLSFFCLAGYTTESGRQEEQTTCTTEGWSPEPRCFKKCTKPDLSNGYISDVKLLYKIQENMHYGCASGYKTTGGKDEEVVQCLSDGWSSQPTCRKEHETCLAPELYNGNYSTTQKTFKVKDKVQYECATGYYTAGGKKTEEVECLTYGWSLTPKCTKLKCSSLRLIENGYFHPVKQTYEEGDVVQFFCHENYYLSGSDLIQCYNFGWYPESPVCEGRRNRCPPPPLPINSKIQTHSTTYRHGEIVHIECELNFEIHGSAEIRCEDGKWTEPPKCIEGQEKVACEEPPFIENGAANLHSKIYYNGDKVTYACKSGYLLHGSNEITCNRGKWTLPPECVENNENCKHPPVVMNGAVADGILASYATGSSVEYRCNEYYLLRGSKISRCEQGKWSSPPVCLEPCTVNVDYMNRNNIEMKWKYEGKVLHGDLIDFVCKQGYDLSPLTPLSELSVQCNRGEVKYPLCTRKESKGMCTSPPLIKHGVIISSTVDTYENGSSVEYRCFDHHFLEGSREAYCLDGMWTTPPLCLEPCTLSFTEMEKNNLLLKWDFDNRPHILHGEYIEFICRGDTYPAELYITGSILRMQCDRGQLKYPRCIPRQSTLSYQEPLRT

SEQ ID NO: 56104 - protein, 461 aa, Homo sapiens
MQRVNMIMAESPGLITICLLGYLLSAECTVFLDHENANKILNRPKRYNSGKLEEFVQGNLERECMEEKCSFEEAREVFENTERTTEFWKQYVDGDQCESNPCLNGGSCKDDINSYECWCPFGFEGKNCELDVTCNIKNGRCEQFCKNSADNKVVCSCTEGYRLAENQKSCEPAVPFPCGRVSVSQTSKLTRAETVFPDVDYVNSTEAETILDNITQSTQSFNDFTRVVGGEDAKPGQFPWQVVLNGKVDAFCGGSIVNEKWIVTAAHCVETGVKITVVAGEHNIEETEHTEQKRNVIRIIPHHNYNAAINKYNHDIALLELDEPLVLNSYVTPICIADKEYTNIFLKFGSGYVSGWGRVFHKGRSALVLQYLRVPLVDRATCLRSTKFTIYNNMFCAGFHEGGRDSCQGDSGGPHVTEVEGTSFLTGIISWGEECAMKGKYGIYTKVSRYVNWIKEKTKLT

SEQ ID NO: 56105 - protein, 187 aa, Homo sapiens
MAAAGPMTGAAASRAATAAHCSGGSKVEAVRGAVQGAAGVKPPVAAAPSLLWLCPPGPPVLLDPLPSWTLCPPGPPSLLGPPGPPALLDPLSSWTPCPPGPPVCGPCSSPPSPTHDWTPRSAAGVWALGVLWASRCLGTITGSRAHTQPLLPEHTRGSRHPDESTVPAMVFRDGEGSLSSAGTLQPG

SEQ ID NO: 56106 - protein, 313 aa, Homo sapiens
MELDRAVGVLGAATLLLSFLGMAWALQAADTCPEVKMVGLEGSDKLTILRGCPGLPGAPGPKGEAGTNGKRGERGPPGPPGKAGPPGPNGAPGEPQPCLTGPRTCKDLLDRGHFLSGWHTIYLPDCRPLTVLCDMDTDGGGWTVFQRRVDGSVDFYRDWATYKQGFGSRLGEFWLGNDNIHALTAQGTSELRVDLVDFEDNYQFAKYRSFKVADEAEKYNLVLGAFVEGSAGDSLTFHNNQSFSTKDQDNDLNTGNCAVMFQGAWWYKNCHVSNLNGRYLRGTHGSFANGINWKSGKGYNYSYKVSEMKVRPA

SEQ ID NO: 56107 - protein, 275 aa, Homo sapiens
MELDRAVGVLGAATLLLSFLGMAWALQAADTCPGERGPPGPPGKAGPPGPNGAPGEPQPCLTGPRTCKDLLDRGHFLSGWHTIYLPDCRPLTVLCDMDTDGGGWTVFQRRVDGSVDFYRDWATYKQGFGSRLGEFWLGNDNIHALTAQGTSELRVDLVDFEDNYQFAKYRSFKVADEAEKYNLVLGAFVEGSAGDSLTFHNNQSFSTKDQDNDLNTGNCAVMFQGAWWYKNCHVSNLNGRYLRGTHGSFANGINWKSGKGYNYSYKVSEMKVRPA

SEQ ID NO: 56108 - protein, 382 aa, Homo sapiens
MGLLLPLALCILVLCCGAMSPPQLALNPSALLSRGCNDSDVLAVAGFALRDINKDRKDGYVLRLNRVNDAQEYRRGGLGSLFYLTLDVLETDCHVLRKKAWQDCGMRIFFESVYGQCKAIFYMNNPSRVLYLAAYNCTLRPVSKKKIYMTCPDCPSSIPTDSSNHQVLEAATESLAKYNNENTSKQYSLFKVTRASSQWVVGPSYFVEYLIKESPCTKSQASSCSLQSSDSVPVGLCKGSLTRTHWEKFVSVTCDFFESQAPATGSENSAVNQKPTNLPKVEESQQKNTPPTDSPSKAGPRGSVQYLPDLDDKNSQEKGPQEAFPVHLDLTTNPQGETLDISFLFLEPMEEKLVVLPFPKEKARTAECPGPAQNASPLVLPP

SEQ ID NO: 56109 - protein, 866 aa, Homo sapiens
MFSMRIVCLVLSVVGTAWTADSGEGDFLAEGGGVRGPRVVERHQSACKDSDWPFCSDEDWNYKCPSGCRMKGLIDEVNQDFTNRINKLKNSLFEYQKNNKDSHSLTTNIMEILRGDFSSANNRDNTYNRVSEDLRSRIEVLKRKVIEKVQHIQLLQKNVRAQLVDMKRLEVDIDIKIRSCRGSCSRALAREVDLKDYEDQQKQLEQVIAKDLLPSRDRQHLPLIKMKPVPDLVPGNFKSQLQKVPPEWKALTDMPQMRMELERPGGNEITRGGSTSYGTGSETESPRNPSSAGSWNSGSSGPGSTGNRNPGSSGTGGTATWKPGSSGPGSTGSWNSGSSGTGSTGNQNPGSPRPGSTGTWNPGSSERGSAGHWTSESSVSGSTGQWHSESGSFRPDSPGSGNARPNNPDWGTFEEVSGNVSPGTRREYHTEKLVTSKGDKELRTGKEKVTSGSTTTTRRSCSKTVTKTVIGPDGHKEVTKEVVTSEDGSDCPEAMDLGTLSGIGTLDGFRHRHPDEAAFFDTASTGKTFPGFFSPMLGEFVSETESRGSESGIFTNTKESSSHHPGIAEFPSRGKSSSYSKQFTSSTSYNRGDSTFESKSYKMADEAGSEADHEGTHSTKRGHAKSRPVRDCDDVLQTHPSGTQSGIFNIKLPGSSKIFSVYCDQETSLGGWLLIQQRMDGSLNFNRTWQDYKRGFGSLNDEGEGEFWLGNDYLHLLTQRGSVLRVELEDWAGNEAYAEYHFRVGSEAEGYALQVSSYEGTAGDALIEGSVEEGAEYTSHNNMQFSTFDRDADQWEENCAEVYGGGWWYNNCQAANLNGIYYPGGSYDPRNNSPYEIENGVVWVSFRGADYSLRAVRMKIRPLVTQ

SEQ ID NO: 56110 - protein, 644 aa, Homo sapiens
MFSMRIVCLVLSVVGTAWTADSGEGDFLAEGGGVRGPRVVERHQSACKDSDWPFCSDEDWNYKCPSGCRMKGLIDEVNQDFTNRINKLKNSLFEYQKNNKDSHSLTTNIMEILRGDFSSANNRDNTYNRVSEDLRSRIEVLKRKVIEKVQHIQLLQKNVRAQLVDMKRLEVDIDIKIRSCRGSCSRALAREVDLKDYEDQQKQLEQVIAKDLLPSRDRQHLPLIKMKPVPDLVPGNFKSQLQKVPPEWKALTDMPQMRMELERPGGNEITRGGSTSYGTGSETESPRNPSSAGSWNSGSSGPGSTGNRNPGSSGTGGTATWKPGSSGPGSTGSWNSGSSGTGSTGNQNPGSPRPGSTGTWNPGSSERGSAGHWTSESSVSGSTGQWHSESGSFRPDSPGSGNARPNNPDWGTFEEVSGNVSPGTRREYHTEKLVTSKGDKELRTGKEKVTSGSTTTTRRSCSKTVTKTVIGPDGHKEVTKEVVTSEDGSDCPEAMDLGTLSGIGTLDGFRHRHPDEAAFFDTASTGKTFPGFFSPMLGEFVSETESRGSESGIFTNTKESSSHHPGIAEFPSRGKSSSYSKQFTSSTSYNRGDSTFESKSYKMADEAGSEADHEGTHSTKRGHAKSRPVRGIHTSPLGKPSLSP

SEQ ID NO: 56111 - protein, 491 aa, Homo sapiens
MKRMVSWSFHKLKTMKHLLLLLLCVFLVKSQGVNDNEEGFFSARGHRPLDKKREEAPSLRPAPPPISGGGYRARPAKAAATQKKVERKAPDAGGCLHADPDLGVLCPTGCQLQEALLQQERPIRNSVDELNNNVEAVSQTSSSSFQYMYLLKDLWQKRQKQVKDNENVVNEYSSELEKHQLYIDETVNSNIPTNLRVLRSILENLRSKIQKLESDVSAQMEYCRTPCTVSCNIPVVSGKECEEIIRKGGETSEMYLIQPDSSVKPYRVYCDMNTENGGWTVIQNRQDGSVDFGRKWDPYKQGFGNVATNTDGKNYCGLPGEYWLGNDKISQLTRMGPTELLIEMEDWKGDKVKAHYGGFTVQNEANKYQISVNKYRGTAGNALMDGASQLMGENRTMTIHNGMFFSTYDRDNDGWLTSDPRKQCSKEDGGGWWYNRCHAANPNGRYYWGGQYTWDMAKHGTDDGVVWMNWKGSWYSMRKMSMKIRPFFPQQ

SEQ ID NO: 56112 - protein, 209 aa, Homo sapiens
MDSDETGFEHSGLWVSVLAGLLLGACQAHPIPDSSPLLQFGGQVRQRYLYTDDAQQTEAHLEIREDGTVGGAADQSPESLLQLKALKPGVIQILGVKTSRFLCQRPDGALYGSLHFDPEACSFRELLLEDGYNVYQSEAHGLPLHLPGNKSPHRDPAPRGPARFLPLPGLPPALPEPPGILAPQPPDVGSSDPLSMVGPSQGRSPSYAS

SEQ ID NO: 56113 - protein, 437 aa, Homo sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQAGDV

SEQ ID NO: 56114 - protein, 453 aa, Homo sapiens
MSWSLHPRNLILYFYALLFLSSTCVAYVATRDNCCILDERFGSYCPTTCGIADFLSTYQTKVDKDLQSLEDILHQVENKTSEVKQLIKAIQLTYNPDESSKPNMIDAATLKSRKMLEEIMKYEASILTHDSSIRYLQEIYNSNNQKIVNLKEKVAQLEAQCQEPCKDTVQIHDITGKDCQDIANKGAKQSGLYFIKPLKANQQFLVYCEIDGSGNGWTVFQKRLDGSVDFKKNWIQYKEGFGHLSPTGTTEFWLGNEKIHLISTQSAIPYALRVELEDWNGRTSTADYAMFKVGPEADKYRLTYAYFAGGDAGDAFDGFDFGDDPSDKFFTSHNGMQFSTWDNDNDKFEGNCAEQDGSGWWMNKCHAGHLNGVYYQGGTYSKASTPNGYDNGIIWATWKTRWYSMKKTTMKIIPFNRLTIGEGQQHHLGGAKQVRPEHPAETEYDSLYPEDDL

SEQ ID NO: 56115 - protein, 312 aa, Homo sapiens
MAKVFSFILVTTALTMGREISALEDCAQEQMRLRAQVRLLETRVKQQQVKIKQLLQENEVQFLDKGDENTVIDLGSKRQYADCSEIFNDGYKLSGFYKIKPLQSPAEFSVYCDMSDGGGWTVIQRRSDGSENFNRGWKDYENGFGNFVQKHGEYWLGNKNLHFLTTQEDYTLKIDLADFEKNSRYAQYKNFKVGDEKNFYELNIGEYSGTAGDSLAGNFHPEVQWWASHQRMKFSTWDRDHDNYEGNCAEEDQSGWWFNRCHSANLNGVYYSGPYTAKTDNGIVWYTWHGWWYSLKSVVMKIRPNDFIPNVI

SEQ ID NO: 56116 - protein, 312 aa, Homo sapiens; identical to SEQ ID NO: 56115

SEQ ID NO: 56117 - protein, 312 aa, Homo sapiens; identical to SEQ ID NO: 56115

SEQ ID NO: 56118 - protein, 312 aa, Homo sapiens; identical to SEQ ID NO: 56115

SEQ ID NO: 56119 - protein, 96 aa, Homo sapiens
MTPCLESFCQRAKDCKQNIPLPFLIQDWPLSESKPQGQDFWTPQPLQAAAPSHEFQQVALHPARTRLASRPQGGRLMSSREVGLRAPRCSCGKRKR

SEQ ID NO: 56120 - protein, 445 aa, Homo sapiens
MKNPEAQQDVSVSQGFRMLFYTMKPSETSFQTLEEVPDYVKKATPFFISLMLLELVVSWILKGKPPGRLDDALTSISAGVLSRLPSLFFRSIELTSYIYIWENYRLFNLPWDSPWTWYSAFLGVDFGYYWFHRMAHEVNIMWAGHQTHHSSEDYNLSTALRQSVLQIYTSWIFYSPLALFIPPSVYAVHLQFNLLYQFWIHTEVINNLGPLELILNTPSHHRVHHGRNRYCIDKNYAGVLIIWDKIFGTFEAENEKVVYGLTHPINTFEPIKVQFHHLFSIWTTFWATPGFFNKFSVIFKGPGWGPGKPRLGLSEEIPEVTGKEVPFSSSSSQLLKIYTVVQFALMLAFYEETFADTAALSQVTLLLRVCFIILTLTSIGFLLDQRPKAAIMETLRCLMFLMLYRFGHLKPLVPSLSSAFEIVFSICIAFWGVRSMKQLTSHPWK

SEQ ID NO: 56121 - protein, 579 aa, Homo sapiens
MRPWLRHLVLQALRNSRAFCGSHGKPAPLPVPQKIVATWEAISLGRQLVPEYFNFAHDVLDVWSRLEEAGHRPPNPAFWWVNGTGAEIKWSFEELGKQSRKAANVLGGACGLQPGDRMMLVLPRLPEWWLVSVACMRTGTVMIPGVTQLTEKDLKYRLQASRAKSIITSDSLAPRVDAISAECPSLQTKLLVSDSSRPGWLNFRELLREASTEHNCMRTKSRDPLAIYFTSGTTGAPKMVEHSQSSYGLGFVASGRRWVALTESDIFWNTTDTGWVKAAWTLFSAWPNGSCIFVHELPRVDAKVILNTLSKFPITTLCCVPTIFRLLVQEDLTRYQFQSLRHCLTGGEALNPDVREKWKHQTGVELYEGYGQSETVVICANPKGMKIKSGSMGKASPPYDVQIVDDEGNVLPPGEEGNVAVRIRPTRPFCFFNCYLDNPEKTAASEQGDFYITGDRARMDKDGYFWFMGRNDDVINSSSYRIGPVEVESALAEHPAVLESAVVSSPDPIRGEVVKAFIVLTPAYSSHDPEALTRELQEHVKRVTAPYKYPRKVAFVSELPKTVSGKIQRSKLRSQEWGK

SEQ ID NO: 56122 - protein, 532 aa, Homo sapiens
MGKKVAIIGAGVSGLASIRSCLEEGLEPTCFEKSNDIGGLWKFSDHAEEGRASIYKSVFSNSSKEMMCFPDFPFPDDFPNFMHNSKIQEYIIAFAKEKNLLKYIQFKTFVSSVNKHPDFATTGQWDVTTERDGKKESAVFDAVMVCSGHHVYPNLPKESFPGLNHFKGKCFHSRDYKEPGVFNGKRVLVVGLGNSGCDIATELSRTAEQVMISSRSGSWVMSRVWDNGYPWDMLLVTRFGTFLKNNLPTAISDWLYVKQMNARFKHENYGLMPLNGVLRKEPVFNDELPASILCGIVSVKPNVKEFTETSAIFEDGTIFEGIDCVIFATGYSFAYPFLDESIIKSRNNEIILFKGVFPPLLEKSTIAVIGFVQSLGAAIPTVDLQSRWAAQVIKGTCTLPSMEDMMNDINEKMEKKRKWFGKSETIQTDYIVYMDELSSFIGAKPNIPWLFLTDPKLAMEVYFGPCSPYQFRLVGPGQWPGARNAILTQWDRSLKPMQTRVVGRLQKPCFFFHWLKLFAIPILLIAVFLVLT

SEQ ID NO: 56123 - protein, 532 aa, Homo sapiens; identical to SEQ ID NO: 56122

SEQ ID NO: 56124 - protein, 357 aa, Homo sapiens
MEEGMNVLHDFGIQSTHYLQVNYQDSQDWFILVSVIADLRNAFYVLFPIWFHLQEAVGIKLLWVAVIGDWLNLVFKWILFGQRPYWWVLDTDYYSNTSVPLIKQFPVTCETGPGSPSGHAMGTAGVYYVMVTSTLSIFQGKIKPTYRFRCLNVILWLGFWAVQLNVCLSRIYLAAHFPHQVVAGVLSGIAVTETFSHIHSIYNASLKKYFLITFFLFSFAIGFYLLLKGLGVDLLWTLEKAQRWCEQPEWVHIDTTPFASLLKNLGTLFGLGLALNSSMYRESCKGKLSKWLPFRLSSIVASLVLLHVFDSLKPPSQVELVFYVLSFCKSAVVPLASVSVIPYCLAQVLGQPHKKSL

SEQ ID NO: 56125 - protein, 313 aa, Homo sapiens
MCTALSPKVRSGPGLSDMHQYSQWLASRHEANLLPMKEDLALWLTNLLGKEITAETFMEKLDNGALLCQLAETMQEKFKESMDANKPTKNLPLKKIPCKTSAPSGSFFARDNTANFLSWCRDLGVDETCLFESEGLVLHKQPREVCLCLLELGRIAARYGVEPPGLIKLEKEIEQEETLSAPSPSPSPSSKSSGKKSTGNLLDDAVKRISEDPPCKCPNKFCVERLSQGRYRVGEKILFIRMLHNKHVMVRVGGGWETFAGYLLKHDPCRMLQISRVDGKTSPIQSKSPTLKDMNPDNYLVVSASYKAKKEIK

SEQ ID NO: 56126 - protein, 313 aa, Homo sapiens; identical to SEQ ID NO: 56125

SEQ ID NO: 56127 - protein, 638 aa, Homo sapiens
MASEIHMPGPVCLIENTKGHLVVNSEALEILSAITQPVVVVAIVGLYRTGKSYLMNKLAGKNKGFPLGCTVKSETKGIWMWCVPHPSKPNHTLILLDTEGLGDMEKSDPKSDSWIFALAVLLSSSFVYNSMGTINHQALEQLHYVTELTELIRAKSCPRPDEVEDSSEFVSFFPDFIWTVRDFTLELKLDGHPITEDEYLENALKLISGKNPQIQNSNKPREWIRHFFPKQKCFVFDRPINDKKLLLHVEEVREDQLDSNFQMQSENFCSYIFTHAKTKTLREGILVTGNRLGMLVETYLDAINSGATPCLENAMAVLAQCENSAAVQRAANHYSQQMAQQVRFPTDTLQELLDVHAVCEREAIAVFMEYSFKDKSQEFQKKLVDTMEKKKEDFVLQNEEASAKYCQAELKRLSELLTESISRGTFFVPGGHNIYLEAKKKIEQDYTLVPRKGVKADEVLQSFLQSQVVIEESILQSDKALTAGEKAIAAKQAKKEAAEKEQELLRQKQKEQQQMMEAQERSFQENIAQLKKKMERERENYMRELRKMLSHKMKVLEELLTEGFKEIFESLNEEINRLKEQIEAAENEEPSVFSQILDVAGSIFIAALPGAAKLVDLGMKILSSLCNRLRNPGKKIIS

SEQ ID NO: 56128 - protein, 474 aa, Homo sapiens
MKRVLVLLLAVAFGHALERGRDYEKNKVCKEFSHLGKEDFTSLSLVLYSRKFPSGTFEQVSQLVKEVVSLTEACCAEGADPDCYDTRTSALSAKSCESNSPFPVHPGTAECCTKEGLERKLCMAALKHQPQEFPTYVEPTNDEICEAFRKDPKEYANQFMWEYSTNYGQAPLSLLVSYTKSYLSMVGSCCTSASPTVCFLKERLQLKHLSLLTTLSNRVCSQYAAYGEKKSRLSNLIKLAQKVPTADLEDVLPLAEDITNILSKCCESASEDCMAKELPEHTVKLCDNLSTKNSKFEDCCQEKTAMDVFVCTYFMPAAQLPELPDVELPTNKDVCDPGNTKVMDKYTFELSRRTHLPEVFLSKVLEPTLKSLGECCDVEDSTTCFNAKGPLLKKELSSFIDKGQELCADYSENTFTEYKKKLAERLKAKLPDATPTELAKLVNKHSDFASNCCSINSPPLYCDSEIDAELKNIL

SEQ ID NO: 56129 - protein, 477 aa, Homo sapiens
MPPCQPQRPLLLLLLLLACQPQVPSAQVMDFLFEKWKLYGDQCHHNLSLLPPPTELVCNRTFDKYSCWPDTPANTTANISCPWYLPWHHKVQHRFVFKRCGPDGQWVRGPRGQPWRDASQCQMDGEEIEVQKEVAKMYSSFQVMYTVGYSLSLGALLLALAILGGLSKLHCTRNAIHANLFASFVLKASSVLVIDGLLRTRYSQKIGDDLSVSTWLSDGAVAGCRVAAVFMQYGIVANYCWLLVEGLYLHNLLGLATLPERSFFSLYLGIGWGAPMLFVVPWAVVKCLFENVQCWTSNDNMGFWWILRFPVFLAILINFFIFVRIVQLLVAKLRARQMHHTDYKFRLAKSTLTLIPLLGVHEVVFAFVTDEHAQGTLRSAKLFFDLFLSSFQGLLVAVLYCFLNKEVQSELRRRWHRWRLGKVLWEERNTSNHRASSSPGHGPPSKELQFGRGGGSQDSSAETPLAGGLPRLAESPF

SEQ ID NO: 56130 - protein, 625 aa, Homo sapiens [sequence omitted]

SEQ ID NO: 56131 - protein, 283 aa, Homo sapiens
MNWTGLYTLLSGVNRHSTAIGRVWLSVIFIFRIMVLVVAAESVWGDEKSSFICNTLQPGCNSVCYDQFFPISHVRLWSLQLILVSTPALLVAMHVAHQQHIEKKMLRLEGHGDPLHLEEVKRHKVHISGTLWWTYVISVVFRLLFEAVFMYVFYLLYPGYAMVRLVKCDVYPCPNTVDCFVSRPTEKTVFTVFMLAASGICIILNVAEVVYLIIRACARRAQRRSNPPSRKGSGFGHRLSPEYKQNEINKLLSEQDGSLKDILRRSPGTGAGLAEKSDRCSAC

SEQ ID NO: 56132 - protein, 163 aa, Homo sapiens
MMLPLQGAQMLQMLEKSLRKSLPASLKVYGTVFHINHGNPFNLKAVVDKWPDFNTVVVCPQEQDMTDDLDHYTNTYQIYSKDPQNCQEFLGSPELINWKQHLQIQSSQPSLNEAIQNLAAIKSFKVKQTQRILYMAAETAKELTPFLLKSKILSPSGGKPKAM

SEQ ID NO: 56133 - protein, 333 aa, Homo sapiens
MFKLCSNKMVSQEGSEVELLVSPGARSEHGRYLQDPIVSIDLSEWLRIIEFLLQGLKVYGSVYHINHGNPFNMEVLVDSWPEYQMVIIRPQKQEMTDDMDSYTNVYRMFSKEPQKSEEVLKNCEIVNWKQRLQIQGLQESLGEGIRVATFSKSVKVEHSRALLLVTEDILKLNASSKSKLGSWAETGHPDDEFESETPNFKYAQLDVSYSGLVNDNWKRGKNERSLHYIKRCIEDLPAACMLGPEGVPVSWVTMDPSCEVGMAYSMEKYRRTGNMARVMVRYMKYLRQKNIPFYISVLEENEDSRRFVGQFGFFEASCEWHQWTCYPQNLVPF

SEQ ID NO: 56134 - protein, 222 aa, Homo sapiens
MAEKPKLHYSNIRGRMESIRWLLAAAGVEFEEKFIKSAEDLDKLRNDGYLMFQQVPMVEIDGMKLVQTRAILNYIASKYNLYGKDIKEKALIDMYIEGIADLGEMILLLPFTQPEEQDAKLALIQEKTKNRYFPAFEKVLKSHGQDYLVGNKLSRADIHLVELLYYVEELDSSLISSFPLLKALKTRISNLPTVKKFLQPGSPRKPPMDEKSLEESRKIFRF

SEQ ID NO: 56135 - protein, 703 aa, Homo sapiens
MLRGRSLSVTSLGGLPQWEVEELPVEELLLFEVAWEVTNKVGGIYTVIQTKAKTTADEWGENYFLIGPYFEHNMKTQVEQCEPVNDAVRRAVDAMNKHGCQVHFGRWLIEGSPYVVLFDIGYSAWNLDRWKGDLWEACSVGIPYHDREANDMLIFGSLTAWFLKEVTDHADGKYVVAQFHEWQAGIGLILSRARKLPIATIFTTHATLLGRYLCAANIDFYNHLDKFNIDKEAGERQIYHRYCMERASVHCAHVFTTVSEITAIEAEHMLKRKPDVVTPNGLNVKKFSAVHEFQNLHAMYKARIQDFVRGHFYGHLDFDLEKTLFLFIAGRYEFSNKGADIFLESLSRLNFLLRMHKSDITVVVFFIMPAKTNNFNVETLKGQAVRKQLWDVAHSVKEKFGKKLYDALLRGEIPDLNDILDRDDLTIMKRAIFSTQRQSLPPVTTHNMIDDSTDPILSTIRRIGLFNNRTDRVKVILHPEFLSSTSPLLPMDYEEFVRGCHLGVFPSYYEPWGYTPAECTVMGIPSVTTNLSGFGCFMQEHVADPTAYGIYIVDRRFRSPDDSCNQLTKFLYGFCKQSRRQRIIQRNRTERLSDLLDWRYLGRYYQHARHLTLSRAFPDKFHVELTSPPTTEGFKYPRPSSVPPSPSGSQASSPQSSDVEDEVEDERYDEEEEAERDRLNIKSPFSLSHVPHGKKKLHGEYKN

SEQ ID NO: 56136 - protein, 560 aa, Homo sapiens
MFARMSDLHVLLLMALVGKTACGFSLMSLLESLDPDWTPDQYDYSYEDYNQEENTSSTLTHAENPDWYYTEDQADPCQPNPCEHGGDCLVHGSTFTCSCLAPFSGNKCQKVQNTCKDNPCGRGQCLITQSPPYYRCVCKHPYTGPSCSQVVPVCRPNPCQNGATCSRHKRRSKFTCACPDQFKGKFCEIGSDDCYVGDGYSYRGKMNRTVNQHACLYWNSHLLLQENYNMFMEDAETHGIGEHNFCRNPDADEKPWCFIKVTNDKVKWEYCDVSACSAQDVAYPEESPTEPSTKLPGFDSCGKTEIAERKIKRIYGGFKSTAGKHPWQASLQSSLPLTISMPQGHFCGGALIHPCWVLTAAHCTDIKTRHLKVVLGDQDLKKEEFHEQSFRVEKIFKYSHYNERDEIPHNDIALLKLKPVDGHCALESKYVKTVCLPDGSFPSGSECHISGWGVTETGKGSRQLLDAKVKLIANTLCNSRQLYDHMIDDSMICAGNLQKPGQDTCQGDSGGPLTCEKDGTYYVYGIVSWGLECGKRPGVYTQVTKFLNWIKATIKSESGF

SEQ ID NO: 56137 - protein, 657 aa, Homo sapiens
MPRYTVHVRGEWLAVPCQDAQLTVGWLGREAVRRYIKNKPDNGGFTSVDDAHFLVRRCKGLGLLDNEDRLEVALENNEFVEVVIEGDAMSPDFIPSQPEGVYLYSKYREPEKYIELDGDRLTTEDLVNLGKGRYKIKLTPTAEKRVQKSREVIDSIIKEKTVVYGITTGFGKFARTVIPINKLQELQVNLVRSHSSGVGKPLSPERCRMLLALRINVLAKGYSGISLETLKQVIEMFNASCLPYVPEKGTVGASGDLAPLSHLALGLVGEGKMWSPKSGWADAKYVLEAHGLKPVILKPKEGLALINGTQMITSLGCEAVERASAIARQADIVAALTLEVLKGTTKAFDTDIHALRPHRGQIEVAFRFRSLLDSDHHPSEIAESHRFCDRVQDAYTLRCCPQVHGVVNDTIAFVKNIITTELNSATDNPMVFANRGETVSGGNFHGEYPAKALDYLAIGIHELAAISERRIERLCNPSLSELPAFLVAEGGLNSGFMIAHCTAAALVSENKALCHPSSVDSLSTSAATEDHVSMGGWAARKALRVIEHVEQVLAIELLAACQGIEFLRPLKTTTPLEKVYDLVRSVVRPWIKDRFMAPDIEAAHRLLLEQKVWEVAAPYIEKYRMEHIPESRPLSPTAFSLQFLHKKSTKIPESEDL

SEQ ID NO: 56138 - protein, 84 aa, Homo sapiens
MALSSQIWAACLLLLLLLASLTSGSVFPQQTGQLAELQPQDRAGARASWMPMFQRRRRRDTHFPICIFCCGCCHRSKCGMCCKT

SEQ ID NO: 56139 - protein, 370 aa, Homo sapiens
MLPRLICINDYEQHAKSVLPKSIYDYYRSGANDEETLADNIAAFSRWKLYPRMLRNVAETDLSTSVLGQRVSMPICVGATAMQRMAHVDGELATVRACQSLGTGMMLSSWATSSIEEVAEAGPEALRWLQLYIYKDREVTKKLVRQAEKMGYKAIFVTVDTPYLGNRLDDVRNRFKLPPQLRMKNFETSTLSFSPEENFGDDSGLAAYVAKAIDPSISWEDIKWLRRLTSLPIVAKGILRGDDAREAVKHGLNGILVSNHGARQLDGVPATIDVLPEIVEAVEGKVEVFLDGGVRKGTDVLKALALGAKAVFVGRPIVWGLAFQGEKGVQDVLEILKEEFRLAMALSGCQNVKVIDKTLVRKNPLAVSKI

SEQ ID NO: 56140 - protein, 147 aa, Homo sapiens
MVHFTAEEKAAVTSLWSKMNVEEAGGEALGRLLVVYPWTQRFFDSFGNLSSPSAILGNPKVKAHGKKVLTSFGDAIKNMDNLKPAFAKLSELHCDKLHVDPENFKLLGNVMVIILATHFGKEFTPEVQAAWQKLVSAVAIALAHKYH

SEQ ID NO: 56141 - protein, 147 aa, Homo sapiens
MGHFTEEDKATITSLWGKVNVEDAGGETLGRLLVVYPWTQRFFDSFGNLSSASAIMGNPKVKAHGKKVLTSLGDATKHLDDLKGTFAQLSELHCDKLHVDPENFKLLGNVLVTVLAIHFGKEFTPEVQASWQKMVTAVASALSSRYH

SEQ ID NO: 56142 - protein, 655 aa, Homo sapiens
MGRWAWVPSPWPPPGLGPFLLLLLLLLLLPRGFQPQPGGNRTESPEPNATATPAIPTILVTSVTSETPATSAPEAEGPQSGGLPPPPRAVPSSSSPQAQALTEDGRPCRFPFRYGGRMLHACTSEGSAHRKWCATTHNYDRDRAWGYCVEATPPPGGPAALDPCASGPCLNGGSCSNTQDPQSYHCSCPRAFTGKDCGTEKCFDETRYEYLEGGDRWARVRQGHVEQCECFGGRTWCEGTRHTACLSSPCLNGGTCHLIVATGTTVCACPPGFAGRLCNIEPDERCFLGNGTGYRGVASTSASGLSCLAWNSDLLYQELHVDSVGAAALLGLGPHAYCRNPDNDERPWCYVVKDSALSWEYCRLEACESLTRVQLSPDLLATLPEPASPGRQACGRRHKKRTFLRPRIIGGSSSLPGSHPWLAAIYIGDSFCAGSLVHTCWVVSAAHCFSHSPPRDSVSVVLGQHFFNRTTDVTQTFGIEKYIPYTLYSVFNPSDHDLVLIRLKKKGDRCATRSQFVQPICLPEPGSTFPAGHKCQIAGWGHLDENVSGYSSSLREALVPLVADHKCSSPEVYGADISPNMLCAGYFDCKSDACQGDSGGPLACEKNGVAYLYGIISWGDGCGRLHKPGVYTRVANYVDWINDRIRPPRRLVAPS

SEQ ID NO: 56143 - protein, 508 aa, Homo sapiens
MQRLLTPVKRILQLTRAVQETSLTPARLLPVAHQRFSTASAVPLAKTDTWPKDVGILALEVYFPAQYVDQTDLEKYNNVEAGKYTVGLGQTRMGFCSVQEDINSLCLTVVQRLMERIQLPWDSVGRLEVGTETIIDKSKAVKTVLMELFQDSGNTDIEGIDTTNACYGGTASLFNAANWMESSSWDGRYAMVVCGDIAVYPSGNARPTGGAGAVAMLIGPKAPLALERGLRGTHMENVYDFYKPNLASEYPIVDGKLSIQCYLRALDRCYTSYRKKIQNQWKQAGSDRPFTLDDLQYMIFHTPFCKMVQKSLARLMFNDFLSASSDTQTSLYKGLEAFGGLKLEDTYTNKDLDKALLKASQDMFDKKTKASLYLSTHNGNMYTSSLYGCLASLLSHHSAQELAGSRIGAFSYGSGLAASFFSFRVSQDAAPGSPLDKLVSSTSDLPKRLASRKCVSPEEFTEIMNQREQFYHKVNFSPPGDTNSLFPGTWYLERVDEQHRRKYARRPV

SEQ ID NO: 56144 - protein, 474 aa, Homo sapiens
MRLSKTLVDMDMADYSAALDPAYTTLEFENVQVLTMGNDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMCEWPRPRGQAATPETPQPSPPGGSGSEPYKLLPGAVATIVKPLSAIPQPTITKQEVI

SEQ ID NO: 56145 - protein, 464 aa, Homo sapiens
MRLSKTLVDMDMADYSAALDPAYTTLEFENVQVLTMGNDTSPSEGTNLNAPNSLGVSALCAICGDRATGKHYGASSCDGCKGFFRRSVRKNHMYSCRFSRQCVVDKDKRNQCRYCRLKKCFRAGMKKEAVQNERDRISTRRSSYEDSSLPSINALLQAEVLSRQITSPVSGINGDIRAKKIASIADVCESMKEQLLVLVEWAKYIPAFCELPLDDQVALLRAHAGEHLLLGATKRSMVFKDVLLLGNDYIVPRHCPELAEMSRVSIRILDELVLPFQELQIDDNEYAYLKAIIFFDPDAKGLSDPGKIKRLRSQVQVSLEDYINDRQYDSRGRFGELLLLLPTLQSITWQMIEQIQFIKLFGMAKIDNLLQEMLLGGSPSDAPHAHHPLHPHLMQEHMGTNVIVANTMPTHLSNGQMSTPETPQPSPPGGSGSEPYKLLPGAVATIVKPLSAIPQPTITKQEVI

SEQ ID NO: 56146 - protein, 406 aa, Homo sapiens
MSALGAVIALLLWGQLFAVDSGNDVTDIADDGCPKPPEIAHGYVEHSVRYQCKNYYKLRTEGDGVYTLNDKKQWINKAVGDKLPECEADDGCPKPPEIAHGYVEHSVRYQCKNYYKLRTEGDGVYTLNNEKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQKVSVNERVMPICLPSKDYAEVGRVGYVSGWGRNANFKFTDHLKYVMLPVADQDQCIRHYEGSTVPEKKTPKSPVGVQPILNEHTFCAGMSKYQEDTCYGDAGSAFAVHDLEEDTWYATGILSFDKSCAVAEYGVYVKVTSIQDWVQKTIAEN

SEQ ID NO: 56147 - protein, 393 aa, Homo sapiens
MTTYSDKGAKPERGRFLHFHSVTFWVGNAKQAASFYCSKMGFEPLAYRGLETGSREVVSHVIKQGKIVFVLSSALNPWNKEMGDHLVKHGDGVKDIAFEVEDCDYIVQKARERGAKIMREPWVEQDKFGKVKFAVLQTYGDTTHTLVEKMNYIGQFLPGYEAPAFMDPLLPKLPKCSLEMIDHIVGNQPDQEMVSASEWYLKNLQFHRFWSVDDTQVHTEYSSLRSIVVANYEESIKMPINEPAPGKKKSQIQEYVDYNGGAGVQHIALKTEDIITAIRHLRERGLEFLSVPSTYYKQLREKLKTAKIKVKENIDALEELKILVDYDEKGYLLQIFTKPVQDRPTLFLEVIQRHNHQGFGAGNFNSLFKAFEEEQNLRGNLTNMETNGVVPGM

SEQ ID NO: 56148 - protein, 417 aa, Homo sapiens
MAQKEGGRTVPCCSRPKVAALTAGTLLLLTAIGAASWAIVAVLLRSDQEPLYPVQVSSADARLMVFDKTEGTWRLLCSSRSNARVAGLSCEEMGFLRALTHSELDVRTAGANGTSGFFCVDEGRLPHTQRLLEVISVCDCPRGRFLAAICQDCGRRKLPVDRIVGGRDTSLGRWPWQVSLRYDGAHLCGGSLLSGDWVLTAAHCFPERNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQAIKTHSEASGMVTQL

SEQ ID NO: 56149 - protein, 417 aa, Homo sapiens; identical to SEQ ID NO: 56148

SEQ ID NO: 56150 - protein, 1004 aa, Homo sapiens
MVQLYNLHPFGSQQVVPCKLEPDRFCGGGRDALFVAAGCKVEAFAVAGQELCQPRCAFSTLGRVLRLAYSEAGDYLVAIEEKNKATFLRAYVNWRNKRTENSRVCIRMIGHNVEGPFSKAFRDQMYIIEMPLSEAPLCISCCPVKGDLLVGCTNKLVLFSLKYQIINEEFSLLDFERSLIIHIDNITPVEVSFCVGYVAVMSDLEVLIVKLESGPKNGERVHHHPHKTNNRIRRTEEGISNEISQLESDDFVICQKPLELLGEKSEQSGLSVTLESTGLADEKRKYSHFQHLLYRRFAPDISSYVLSDDIKLHSLQLLPIYQTGSLTSDGKNLSQEKELLSLFCFFSLPHVGYLYMVVKSVELMSVYQYPEKSQQAVLTPQFLHVITSNNLQCFTVRCSAAAAREEDPYMDTTLKACPPVSMDVCALRIQLFIGLKAICHFKNHIILLTKAEPEAIPERRQSPKRLLSRKDTSVKIKIPPVAEAGWNLYIVNTISPVQLYKEMVDYSNTYKTVKTQSCIHLLSEAHLLVRAALMDASQLEPGEKAELLEAFKESCGHLGDCYSRLDSQHSHLTLPYYKMSGLSMAEVLARTDWTVEDGLQKYERGLIFYINHSLYENLDEELNEELAAKVVQMFYVAEPKQVPHILCSPSMKNINPLTAMSYLRKLDTSGFSSILVTLTKAAVALKMGDLDMHRNEMKSHSEMKLVCGFILEPRLLIQQRKGQIVPTELALHLKETQPGLLVASVLGLQKNNKIGIEEADSFFKVLCAKDEDTIPQLLVDFWEAQLVACLPDVVLQELFFKLTSQYIWRLSKRQPPDTTPLRTSEDLINACSHYGLIYPWVHVVISSDSLADKNYTEDLSKLQSLICGPSFDIASIIPFLEPLSEDTIAGLSVHVLCRTRLKEYEQCIDILLERCPEAVIPYANHELKEENRTLWWKKLLPELCQRIKCGGEKYQLYLSSLKETLSIVAVELELKDFMNVLPEDGTATFFLPYLLYCSRKKPLT

SEQ ID NO: 56151 - protein, 462 aa, Homo sapiens
MARVLGAPVALGLWSLCWSLAIATPLPPTSAHGNVAEGETKPDPDVTERCSDGWSFDATTLDDNGTMLFFKGEFVWKSHKWDRELISERWKNFPSPVDAAFRQGHNSVFLIKGDKVWVYPPEKKEKGYPKLLQDEFPGIPSPLDAAVECHRGECQAEGVLFFQGDREWFWDLATGTMKERSWPAVGNCSSALRWLGRYYCFQGNQFLRFDPVRGEVPPRYPRDVRDYFMPCPGRGHGHRNGTGHGNSTHHGPEYMRCSPHLVLSALTSDNHGATYAFSGTHYWRLDTSRDGWHSWPIAHQWPQGPSAVDAAFSWEEKLYLVQGTQVYVFLTKGGYTLVSGYPKRLEKEVGTPHGIILDSVDAAFICPGSSRLHIMAGRRLWWLDLKSGAQATWTELPWPHEKVDGALCMEKSLGPNSCSANGPGLYLIHGPNLYCYSDVEKLNAAKALPQPQNVTSLLGCTH

SEQ ID NO: 56152 - protein, 137 aa, Homo sapiens
MSSLIRRVISTAKAPGAIGPYSQAVLVDRTIYISGQIGMDPSSGQLVSGGVAEEAKQALKNMGEILKAAGCDFTNVVKTTVLLADINDFNTVNEIYKQYFKSNFPARAAYQVAALPKGSRIEIEAVAIQGPLTTASL

SEQ ID NO: 56153 - protein, 292 aa, Homo sapiens
MAFMKKYLLPILGLFMAYYYYSANEEFRPEMLQGKKVIVTGASKGIGREMAYHLAKMGAHVVVTARSKETLQKVVSHCLELGAASAHYIAGTMEDMTFAEQFVAQAGKLMGGLDMLILNHITNTSLNLFHDDIHHVRKSMEVNFLSYVVLTVAALPMLKQSNGSIVVVSSLAGKVAYPMVAAYSASKFALDGFFSSIRKEYSVSRVNVSITLCVLGLIDTETAMKAVSGIVHMQAAPKEECALEIIKGGALRQEEVYYDSSLWTTLLIRNPCRKILEFLYSTSYNMDRFINK

SEQ ID NO: 56154 - protein, 292 aa, Homo sapiens; identical to SEQ ID NO: 56153

SEQ ID NO: 56155 - protein, 300 aa, Homo sapiens
MNIILEILLLLITIIYSYLESLVKFFIPQRRKSVAGEIVLITGAGHGIGRQTTYEFAKRQSILVLWDINKRGVEETAAECRKLGVTAHAYVVDCSNREEIYRSLNQVKKEVGDVTIVVNNAGTVYPADLLSTKDEEITKTFEVNILGHFWITKALLPSMMERNHGHIVTVASVCGHEGIPYLIPYCSSKFAAVGFHRGLTSELQALGKTGIKTSCLCPVFVNTGFTKNPSTRLWPVLETDEVVRSLIDGILTNKKMIFVSSYINIFLRLQKFLPERASAILNRMQNIQFEAVVGHKIKMK

SEQ ID NO: 56156 - protein, 317 aa, Homo sapiens
MWLYLAAFVGLYYLLHWYRERQVVSHLQDKYVFITGCDSGFGNLLARQLDARGLRVLAACLTEKGAEQLRGQTSDRLETVTLDVTKMESIAAATQWVKEHVGDRGLWGLVNNAGILTPITLCEWLNTEDSMNMLKVNLIGVIQVTLSMLPLVRRARGRIVNVSSILGRVAFFVGGYCVSKYGVEAFSDILRREIQHFGVKISIVEPGYFRTGMTNMTQSLERMKQSWKEAPKHIKETYGQQYFDALYNIMKEGLLNCSTNLNLVTDCMEHALTSVHPRTRYSAGWDAKFFFIPLSYLPTSLADYILTRSWPKPAQAV

SEQ ID NO: 56157 - protein, 577 aa, Homo sapiens
MNKLYIGNLNESVTPADLEKVFAEHKISYSGQFLVKSGYAFVDCPDEHWAMKAIETFSGKVELQGKRLEIEHSVPKKQRSRKIQIRNIPPQLRWEVLDSLLAQYGTVENCEQVNTESETAVVNVTYSNREQTRQAIMKLNGHQLENHALKVSYIPDEQIAQGPENGRRGGFGSRGQPRQGSPVAAGAPAKQQQVDIPLRLLVPTQYVGAIIGKEGATIRNITKQTQSKIDVHRKENAGAAEKAISVHSTPEGCSSACKMILEIMHKEAKDTKTADEVPLKILAHNNFVGRLIGKEGRNLKKVEQDTETKITISSLQDLTLYNPERTITVKGAIENCCRAEQEIMKKVREAYENDVAAMSLQSHLIPGLNLAAVGLFPASSSAVPPPPSSVTGAAPYSSFMQAPEQEMVQVFIPAQAVGAIIGKKGQHIKQLSRFASASIKIAPPETPDSKVRMVIITGPPEAQFKAQGRIYGKLKEENFFGPKEEVKLETHIRVPASAAGRVIGKGGKTVNELQNLTAAEVVVPRDQTPDENDQVIVKIIGHFYASQMAQRKIRDILAQVKQQHQKGQSNQAQARRK

SEQ ID NO: 56158 - protein, 259 aa, Homo sapiens
MSEVPVARVWLVLLLLTVQVGVTAGAPWQCAPCSAEKLALCPPVSASCSEVTRSAGCGCCPMCALPLGAACGVATARCARGLSCRALPGEQQPLHALTRGQGACVQESDASAPHAAEAGSPESPESTEITEEELLDNFHLMAPSEEDHSILWDAISTYDGSKALHVTNIKKWKEPCRIELYRVVESLAKAQETSGEEISKFYLPNCNKNGFYHSRQCETSMDGEAGLCWCVYPWNGKRIPGSPEIRGDPNCQIYFNVQN

SEQ ID NO: 56159 - protein, 241 aa, Homo sapiens
MSEVPVARVWLVLLLLTVQVGVTAGAPWQCAPCSAEKLALCPPVSASCSEVTRSAGCGCCPMCALPLGAACGVATARCARGLSCRALPGEQQPLHALTRGQGACVQESDASAPHAAEAGSPESPESTEITEEELLDNFHLMAPSEEDHSILWDAISTYDGSKALHVTNINKAQETSGEEISKFYLPNCNKNGFYHSRQCETSMDGEAGLCWCVYPWNGKRIPGSPEIRGDPNCQIYFNVQN

SEQ ID NO: 56160 - protein, 243 aa, Homo sapiens
MGQTAGDLGWRLSLLLLPLLLVQAGVWGFPRPPGRPQLSLQELRREFTVSLHLARKLLSEVRGQAHRFAESHLPGVNLYLLPLGEQLPDVSLTFQAWRRLSDPERLCFISTTLQPFHALLGGLGTQGRWTNMERMQLWAMRLDLRDLQRHLRFQVLAAGFNLPEEEEEEEEEEEEERKGLLPGALGSALQGPAQVSWPQLLSTYRLLHSLELVLSRAVRELLLLSKAGHSVWPLGFPTLSPQP

SEQ ID NO: 56161 - protein, 350 aa, Homo sapiens
MRLPDVQLWLVLLWALVRAQGTGSVCPSCGGSKLAPQAERALVLELAKQQILDGLHLTSRPRITHPPPQAALTRALRRLQPGSVAPGNGEEVISFATVTDSTSAYSSLLTFHLSTPRSHHLYHARLWLHVLPTLPGTLCLRIFRWGPRRRRQGSRTLLAEHHITNLGWHTLTLPSSGLRGEKSGVLKLQLDCRPLEGNSTVTGQPRRLLDTAGHQQPFLELKIRANEPGAGRARRRTPTCEPATPLCCRRDHYVDFQELGWRDWILQPEGYQLNYCSGQCPPHLAGSPGIAASFHSAVFSLLKANNPWPASTSCCVPTARRPLSLLYLDHNGNVVKTDVPDMVVEACGCS

SEQ ID NO: 56162 - protein, 911 aa, Homo sapiens
MDGAMGPRGLLLCMYLVSLLILQAMPALGSATGRSKSSEKRQAVDTAVDGVFIRSLKVNCKVTSRFAHYVVTSQVVNTANEAREVAFDLEIPKTAFISDFAVTADGNAFIGDIKDKVTAWKQYRKAAISGENAGLVRASGRTMEQFTIHLTVNPQSKVTFQLTYEEVLKRNHMQYEIVIKVKPKQLVHHFEIDVDIFEPQGISKLDAQASFLPKELAAQTIKKSFSGKKGHVLFRPTVSQQQSCPTCSTSLLNGHFKVTYDVTRDEICDLLVANNHFAHFFAPQNLTNMNKNVVFVIDISGSMRGQKVKQTKEALLKILGDMQPGDYFDLVLFGTRVQSWKGSLVQASEANLQAAQDFVRGFSLDEATNLNGGLLRGIEILNQVQESLPELSNHASILIMLTDGDPTEGVTDRSQILKNVRNAIRGRFPLYNLGFGHNVDFNFLEVMSMENNGRAQRIYEDHDATQQLQGFYSQVAKPLLVDVDLQYPQDAVLALTQNHHKQYYEGSEIVVAGRIADNKQSSFKADVQAHGEGQEFSITCLVDEEEMKKLLRERGHMLENHVERLWAYLTIQELLAKRMKVDREVRANLSSQALRMSLDYGFVTPLTSMSIRGMADQDGLKPTIDKPSEDSPPLEMLGPRRTFVLSALQPSPTHSSSNTQRLPDRVTGVDTDPHFIIHVPQKEDTLCFNINEEPGVILSLVQDPNTGFSVNGQLIGNKARSPGQHDGTYFGRLGIANPATDFQLEVTPQNITLNPGFGGPVFSWRDQAVLRQDGVVVTINKKRNLVVSVDDGGTFEVVLHRVWKGSSVHQDFLGFYVLDSHRMSARTHGLLGQFFHPIGFEVSDIHPGSDPTKPDATMVVRNRRLTVTRGLQKDYSKDPWHGAEVSCWFIHNNGAGLIDGAYTDYIVPDIF

SEQ ID NO: 56163 - protein, 946 aa, Homo sapiens
MKRLTCFFICFFLSEVSGFEIPINGLSEFVDYEDLVELAPGKFQLVAENRRYQRSLPGESEEMMEEVDQVTLYSYKVQSTITSRMATTMIQSKVVNNSPQPQNVVFDVQIPKGAFISNFSMTVDGKTFRSSIKEKTVGRALYAQARAKGKTAGLVRSSALDMENFRTEVNVLPGAKVQFELHYQEVKWRKLGSYEHRIYLQPGRLAKHLEVDVWVIEPQGLRFLHVPDTFEGHFDGVPVISKGQQKAHVSFKPTVAQQRICPNCRETAVDGELVVLYDVKREEKAGELEVFNGYFVHFFAPDNLDPIPKNILFVIDVSGSMWGVKMKQTVEAMKTILDDLRAEDHFSVIDFNQNIRTWRNDLISATKTQVADAKRYIEKIQPSGGTNINEALLRAIFILNEANNLGLLDPNSVSLIILVSDGDPTVGELKLSKIQKNVKENIQDNISLFSLGMGFDVDYDFLKRLSNENHGIAQRIYGNQDTSSQLKKFYNQVSTPLLRNVQFNYPHTSVTDVTQNNFHNYFGGSEIVVAGKFDPAKLDQIESVITATSANTQLVLETLAQMDDLQDFLSKDKHADPDFTRKLWAYLTINQLLAERSLAPTAAAKRRITRSILQMSLDHHIVTPLTSLVIENEAGDERMLADAPPQDPSCCSGALYYGSKVVPDSTPSWANPSPTPVISMLAQGSQVLESTPPPHVMRVENDPHFIIYLPKSQKNICFNIDSEPGKILNLVSDPESGIVVNGQLVGAKKPNNGKLSTYFGKLGFYFQSEDIKIEISTETITLSHGSSTFSLSWSDTAQVTNQRVQISVKKEKVVTITLDKEMSFSVLLHRVWKKHPVNVDFLGIYIPPTNKFSPKAHGLIGQFMQEPKIHIFNERPGKDPEKPEASMEVKGQKLIITRGLQKDYRTDLVFGTDVTCWFVHNSGKGFIDGHYKDYFVPQLYSFLKRP

SEQ ID NO: 56164 - protein, 890 aa, Homo sapiens
MAFAWWPCLILALLSSLAASGFPRSPFRLLGKRSLPEGVANGIEVYSTKINSKVTSRFAHNVVTMRAVNRADTAKEVSFDVELPKTAFITNFTLTIDGVTYPGNVKEKEVAKKQYEKAVSQGKTAGLVKASGRKLEKFTVSVNVAAGSKVTFELTYEELLKRHKGKYEMYLKVQPKQLVKHFEIEVDIFEPQGISMLDAEASFITNDLLGSALTKSFSGKKGHVSFKPSLDQQRSCPTCTDSLLNGDFTITYDVNRESPGNVQIVNGYFVHFFAPQGLPVVPKNVAFVIDISGSMAGRKLEQTKEALLRILEDMKEEDYLNFILFSGDVSTWKEHLVQATPENLQEARTFVKSMEDKGMTNINDGLLRGISMLNKAREEHRIPERSTSIVIMLTDGDANVGESRPEKIQENVRNAIGGKFPLYNLGFGNNLNYNFLENMALENHGFARRIYEDSDADLQLQGFYEEVANPLLTGVEMEYPENAILDLTQNTYQHFYDGSEIVVAGRLVDEDMNSFKADVKGHGATNDLTFTEEVDMKEMEKALQERDYIFGNYIERLWAYLTIEQLLEKRKNAHGEEKENLTARALDLSLKYHFVTPLTSMVVTKPEDNEDERAIADKPGEDAEATPVSPAMSYLTSYQPPQNPYYYVDGDPHFIIQIPEKDDALCFNIDEAPGTVLRLIQDAVTGLTVNGQITGDKRGSPDSKTRKTYFGKLGIANAQMDFQVEVTTEKITLWNRAVPSTFSWLDTVTVTQDGLSMMINRKNMVVSFGDGVTFVVVLHQVWKKHPVHRDFLGFYVVDSHRMSAQTHGLLGQFFQPFDFKVSDIRPGSDPTKPDATLVVKNHQLIVTRGSQKDYRKDASIGTKVVCWFVHNNGEGLIDGVHTDYIVPNLF

SEQ ID NO: 56165 - protein, 930 aa, Homo sapiens
MKPPRPVRTCSKVLVLLSLLAIHQTTTAEKNGIDIYSLTVDSRVSSRFAHTVVTSRVVNRANTVQEATFQMELPKKAFITNFSMIIDGMTYPGIIKEKAEAQAQYSAAVAKGKSAGLVKATGRNMEQFQVSVSVAPNAKITFELVYEELLKRRLGVYELLLKVRPQQLVKHLQMDIHIFEPQGISFLETESTFMTNQLVDALTTWQNKTKAHIRFKPTLSQQQKSPEQQETVLDGNLIIRYDVDRAISGGSIQIENGYFVHYFAPEGLTTMPKNVVFVIDKSGSMSGRKIQQTREALIKILDDLSPRDQFNLIVFSTEATQWRPSLVPASAENVNKARSFAAGIQALGGTNINDAMLMAVQLLDSSNQEERLPEGSVSLIILLTDGDPTVGETNPRSIQNNVREAVSGRYSLFCLGFGFDVSYAFLEKLALDNGGLARRIHEDSDSALQLQDFYQEVANPLLTAVTFEYPSNAVEEVTQNNFRLLFKGSEMVVAGKLQDRGPDVLTATVSGKLPTQNITFQTESSVAEQEAEFQSPKYIFHNFMERLWAYLTIQQLLEQTVSASDADQQALRNQALNLSLAYSFVTPLTSMVVTKPDDQEQSQVAEKPMEGESRNRNVHSGSTFFKYYLQGAKIPKPEASFSPRRGWNRQAGAAGSRMNFRPGVLSSRQLGLPGPPDVPDHAAYHPFRRLAILPASAPPATSNPDPAVSRVMNMKIEETTMTTQTPAPIQAPSAILPLPGQSVERLCVDPRHRQGPVNLLSDPEQGVEVTGQYEREKAGFSWIEVTFKNPLVWVHASPEHVVVTRNRRSSAYKWKETLFSVMPGLKMTMDKTGLLLLSDPDKVTIGLLFWDGRGEGLRLLLRDTDRFSSHVGGTLGQFYQEVLWGSPAASDDGRRTLRVQGNDHSATRERRLDYQEGPPGVEISCWSVEL

SEQ ID NO: 56166 - protein, 362 aa, Homo sapiens
MATAETALPSISTLTALGPFPDTQDDFLKWWRSEEAQDMGPGPPDPTEPPLHVKSEDQPGEEEDDERGADATWDLDLLLTNFSGPEPGGAPQTCALAPSEASGAQYPPPPETLGAYAGGPGLVAGLLGSEDHSGWVRPALRARAPDAFVGPALAPAPAPEPKALALQPVYPGPGAGSSGGYFPRTGLSVPAASGAPYGLLSGYPAMYPAPQYQGHFQLFRGLQGPAPGPATSPSFLSCLGPGTVGTGLGGTAEDPGVIAETAPSKRGRRSWARKRQAAHTCAHPGCGKSYTKSSHLKAHLRTHTGEKPYACTWEGCGWRFARSDELTRHYRKHTGQRPFRCQLCPRAFSRSDHLALHMKRHL

SEQ ID NO: 56167 - protein, 638 aa, Homo sapiens
MILFKQATYFISLFATVSCGCLTQLYENAFFRGGDVASMYTPNAQYCQMRCTFHPRCLLFSFLPASSINDMEKRFGCFLKDSVTGTLPKVHRTGAVSGHSLKQCGHQISACHRDIYKGVDMRGVNFNVSKVSSVEECQKRCTSNIRCQFFSYATQTFHKAEYRNNCLLKYSPGGTPTAIKVLSNVESGFSLKPCALSEIGCHMNIFQHLAFSDVDVARVLTPDAFVCRTICTYHPNCLFFTFYTNVWKIESQRNVCLLKTSESGTPSSSTPQENTISGYSLLTCKRTLPEPCHSKIYPGVDFGGEELNVTFVKGVNVCQETCTKMIRCQFFTYSLLPEDCKEEKCKCFLRLSMDGSPTRIAYGTQGSSGYSLRLCNTGDNSVCTTKTSTRIVGGTNSSWGEWPWQVSLQVKLTAQRHLCGGSLIGHQWVLTAAHCFDGLPLQDVWRIYSGILNLSDITKDTPFSQIKEIIIHQNYKVSEGNHDIALIKLQAPLNYTEFQKPICLPSKGDTSTIYTNCWVTGWGFSKEKGEIQNILQKVNIPLVTNEECQKRYQDYKITQRMVCAGYKEGGKDACKGDSGGPLVCKHNGMWRLVGITSWGEGCARREQPGVYTKVAEYMDWILEKTQSSDGKAQMQSPA

SEQ ID NO: 56168 - protein, 486 aa, Homo sapiens
MDSSVIQRKKVAVIGGGLVGSLQACFLAKRNFQIDVYEAREDTRVATFTRGRSINLALSHRGRQALKAVGLEDQIVSQGIPMRARMIHSLSGKKSAIPYGTKSQYILSVSRENLNKDLLTAAEKYPNVKMHFNHRLLKCNPEEGMITVLGSDKVPKDVTCDLIVGCDGAYSTVRSHLMKKPRFDYSQQYIPHGYMELTIPPKNGDYAMEPNYLHIWPRNTFMMIALPNMNKSFTCTLFMPFEEFEKLLTSNDVVDFFQKYFPDAIPLIGEKLLVQDFFLLPAQPMISVKCSSFHFKSHCVLLGDAAHAIVPFFGQGMNAGFEDCLVFDELMDKFSNDLSLCLPVFSRLRIPDDHAISDLSMYNYIEMRAHVNSSWFIFQKNMERFLHAIMPSTFIPLYTMVTFSRIRYHEAVQRWHWQKKVINKGLFFLGSLIAISSTYLLIHYMSPRSFLCLRRPWNWIAHFRNTTCFPAKAVDSLEQISNLISR

SEQ ID NO: 56169 - protein, 481 aa, Homo sapiens
MGALARALPSILLALLLTSTPEALGANPGLVARITDKGLQYAAQEGLLALQSELLRITLPDFTGDLRIPHVGRGRYEFHSLNIHSCELLHSALRPVPGQGLSLSISDSSIRVQGRWKVRKSFFKLQGSFDVSVKGISISVNLLLGSESSGRPTVTASSCSSDIADVEVDMSGDLGWLLNLFHNQIESKFQKVLESRICEMIQKSVSSDLQPYLQTLPVTTEIDSFADIDYSLVEAPRATAQMLEVMFKGEIFHRNHRSPVTLLAAVMSLPEEHNKMVYFAISDYVFNTASLVYHEEGYLNFSITDDMIPPDSNIRLTTKSFRPFVPRLARLYPNMNLELQGSVPSAPLLNFSPGNLSVDPYMEIDAFVLLPSSSKEPVFRLSVATNVSATLTFNTSKITGFLKPGKVKVELKESKVGLFNAELLEALLNYYILNTFYPKFNDKLAEGFPLPLLKRVQLYDLGLQIHKDFLFLGANVQYMRV

SEQ ID NO: 56170 - protein, 77 aa, Homo sapiens
MWHLKLCAVLMIFLLLLGQIDGSPIPEVSSAKRRPRRMTPFWRGVSLRPIGASCRDDSECITRLCRKRRCSLSVAQE

SEQ ID NO: 56171 - protein, 372 aa, Homo sapiens
MSLRCGDAARTLGPRVFGRYFCSPVRPLSSLPDKKKELLQNGPDLQDFVSGDLADRSTWDEYKGNLKRQKGERLRLPPWLKTEIPMGKNYNKLKNTLRNLNLHTVCEEARCPNIGECWGGGEYATATATIMLMGDTCTRGCRFCSVKTARNPPPLDASEPYNTAKAIAEWGLDYVVLTSVDRDDMPDGGAEHIAKTVSYLKERNPKILVECLTPDFRGDLKAIEKVALSGLDVYAHNVETVPELQSKVRDPRANFDQSLRVLKHAKKVQPDVISKTSIMLGLGENDEQVYATMKALREADVDCLTLGQYMQPTRRHLKVEEYITPEKFKYWEKVGNELGFHYTASGPLVRSSYKAGEFFLKNLVAKRKTKDL

SEQ ID NO: 56172 - protein, 322 aa, Homo sapiens
MSLRCGDAARTLGPRVFGRYFCSPVRPLSSLPDKKKELLQNGPDLQDFVSGDLADRSTWDEYKGNLKRQKGERLRLPPWLKTEIPMGKNYNKLKNTLRNLNLHTVCEEARCPNIGECWGGGEYATATATIMLMGDTCTRGCRFCSVKTARNPPPLDASEPYNTAKAIAEWGLDYVVLTSVDRDDMPDGGAEHIAKTVSYLKERNPKILVECLTPDFRGDLKAIEKVALSGLDVYAHNVETVPELQSKVRDPRANFDQSLRVLKHAKKVQPDVISKTSIMLGLGENDEQVYATMKALREADVDCLTLGQYMQPTRRHLKVNFS

SEQ ID NO: 56173 - protein, 189 aa, Homo sapiens
MGTPNDQAVLQAIFNPDTPFGDIVGLDLGEEAEKEEREEDEVFPQAQLEQSKALELQGVMAAEAGDLSTALERFGQAICLLPERASAYNNRAQARRLQGDVAGALEDLERAVELSGGRGRAARQSFVQRGLLARLQGRDDDARRDFERAARLGSPFARRQLVLLNPYAALCNRMLADMMGQLRRPRDSR

SEQ ID NO: 56174 - protein, 97 aa, Homo sapiens
MATPGSRKNHGALEDLERAVELSGGRGRAARQSFVQRGLLARLQGRDDDARRDFERAARLGSPFARRQLVLLNPYAALCNRMLADMMGQLRRPRDSR

SEQ ID NO: 56175 - protein, 189 aa, Homo sapiens; identical to SEQ ID NO: 56173

SEQ ID NO: 56176 - protein, 97 aa, Homo sapiens; identical to SEQ ID NO: 56174

SEQ ID NO: 56177 - protein, 579 aa, Homo sapiens
MARAVGPERRLLAVYTGGTIGMRSELGVLVPGTGLAAILRTLPMFHDEEHARARGLSEDTLVLPPASRNQRILYTVLECQPLFDSSDMTIAEWVCLAQTIKRHYEQYHGFVVIHGTDTMAFAASMLSFMLENLQKTVILTGAQVPIHALWSDGRENLLGALLMAGQYVIPEVCLFFQNQLFRGNRATKVDARRFAAFCSPNLLPLATVGADITINRELVRKVDGKAGLVVHSSMEQDVGLLRLYPGIPAALVRAFLQPPLKGVVMETFGSGNGPTKPDLLQELRVATERGLVIVNCTHCLQGAVTTDYAAGMAMAGAGVISGFDMTSEAALAKLSYVLGQPGLSLDVRKELLTKDLRGEMTPPSVEERRPSLQGNTLGGGVSWLLSLSGSQEADALRNALVPSLACAAAHAGDVEALQALVELGSDLGLVDFNGQTPLHAAARGGHTEAVTMLLQRGVDVNTRDTDGFSPLLLAVRGRHPGVIGLLREAGASLSTQELEEAGTELCRLAYRADLEGLQVWWQAGADLGQPGYDGHSALHVAEAAGNLAVVAFLQSLEGAVGAQAPCPEPSCFQEVLPGV

SEQ ID NO: 56178 - protein, 573 aa, Homo sapiens
MARAVGPERRLLAVYTGGTIGMRSELGVLVPGTGLAAILRTLPMFHDEEHARARGLSEDTLVLPPASRNQRILYTVLECQPLFDSSDMTIAEWVCLAQTIKRHYEQYHGFVVIHGTDTMAFAASMLSFMLENLQKTVILTGAQVPIHALWSDGRENLLGALLMAGQYVIPEVCLFFQNQLFRGNRATKVDARRFAAFCSPNLLPLATVGADITINRELVRKVDGKAGLVVHSSMEQDVGLLRLYPGIPAALVRAFLQPPLKGVVMETFGSGNGPTKPDLLQELRVATERGLVIVNCTHCLQGAVTTDYAAGMAMAGAGVISGFDMTSEAALAKLSYVLGQPGLSLDVRKELLTKDLRGEMTPPSVEERRPSLQGNTLGGGVSWLLSLSGSQEADALRNALVPSLACAAAHAGDVEALQALVELGSDLGLVDFNGQTPLHAAARGGHTEAVTMLLQRGVDVNTRDTDGFSPLLLAVRGRHPGVIGLLREAGASLSTQELEEAGTELCRLAYRADLEGLQVWWQAGADLGQPGYDGHSALHVAEAAGNLAVVAFLQSLEGAVGAQAPCPEVLPGV

SEQ ID NO: 56179 - protein, 540 aa, Homo sapiens
MLRTCYVRSPWRRGPSSARGEQSGSGHLEQEEVQSGSLLFRLLLFLSRSPASRNQRILYTVLECQPLFDSSDMTIAEWVCLAQTIKRHYEQYHGFVVIHGTDTMAFAASMLSFMLENLQKTVILTGAQVPIHALWSDGRENLLGALLMAGQYVIPEVCLFFQNQLFRGNRATKVDARRFAAFCSPNLLPLATVGADITINRELVRKVDGKAGLVVHSSMEQDVGLLRLYPGIPAALVRAFLQPPLKGVVMETFGSGNGPTKPDLLQELRVATERGLVIVNCTHCLQGAVTTDYAAGMAMAGAGVISGFDMTSEAALAKLSYVLGQPGLSLDVRKELLTKDLRGEMTPPSVEERRPSLQGNTLGGGVSWLLSLSGSQEADALRNALVPSLACAAAHAGDVEALQALVELGSDLGLVDFNGQTPLHAAARGGHTEAVTMLLQRGVDVNTRDTDGFSPLLLAVRGRHPGVIGLLREAGASLSTQELEEAGTELCRQRQPGTWQWWPFYRAWRVRLVPRPHAQKCCLVSNLKASCCSISHSFLP

SEQ ID NO: 56180 - protein, 573 aa, Homo sapiens; identical to SEQ ID NO: 56178

SEQ ID NO: 56181 - protein, 540 aa, Homo sapiens; identical to SEQ ID NO: 56179

SEQ ID NO: 56182 - protein, 579 aa, Homo sapiens; identical to SEQ ID NO: 56177

SEQ ID NO: 56183 - protein, 257 aa, Homo sapiens
MAFEELLSQVGGLGRFQMLHLVFILPSLMLLIPHILLENFAAAIPGHRCWVHMLDNNTGSGNETGILSEDALLRISIPLDSNLRPEKCRRFVHPQWQLLHLNGTIHSTSEADTEPCVDGWVYDQSYFPSTIVTKWDLVCDYQSLKSVVQFLLLTGMLVGGIIGGHVSDRWLVESARWLIITNKLDEGLKALRKVARTNGIKNAEETLNIEVVRSTMQEELDAAQTKTTVCDLFRNPSMRKRICILVFLRKKNLKEKA

SEQ ID NO: 56184 - protein, 533 aa, Homo sapiens
MAFEELLSQVGGLGRFQMLHLVFILPSLMLLIPHILLENFAAAIPGHRCWVHMLDNNTGSGNETGILSEDALLRISIPLDSNLRPEKCRRFVHPQWQLLHLNGTIHSTSEADTEPCVDGWVYDQSYFPSTIVTKWDLVCDYQSLKSVVQFLLLTGMLVGGIIGGHVSDRFGRRFILRWCLLQLAITDTCAAFAPTFPVYCVLRFLAGFSSMIIISNNSLPITEWIRPNSKALVVILSSGALSIGQIILGGLAYVFRDWQTLHVVASVPFFVFFLLSRWLVESARWLIITNKLDEGLKALRKVARTNGIKNAEETLNIEVVRSTMQEELDAAQTKTTVCDLFRNPSMRKRICILVFLRFANTIPFYGTMVNLQHVGSNIFLLQVLYGAVALIVRCLALLTLNHMGRRISQILFMFLVGLSILANTFVPKEMQTLRVALACLGIGCSAATFSSVAVHFIELIPTVLRARASGIDLTASRIGAALAPLLMTLTVFFTTLPWIIYGIFPIIGGLIVFLLPETKNLPLPDTIKDVENQ

SEQ ID NO: 56185 - protein, 372 aa, Homo sapiens
MLDNNTGSGNETGILSEDALLRISIPLDSNLRPEKCRRFVHPQWQLLHLNGTIHSTSEADTEPCVDGWVYDQSYFPSTIVTKWDLVCDYQSLKSVVQFLLLTGMLVGGIIGGHVSDRFGRRFILRWCLLQLAITDTCAAFAPTFPVYCVLRFLAGFSSMIIISNNSLPITEWIRPNSKALVVILSSGALSIGQIILGGLAYVFRDWQTLHVVASVPFFVFFLLSRWLVESARWLIITNKLDEGLKALRKVARTNGIKNAEETLNIEVVRSTMQEELDAAQTKTTVCDLFRNPSMRKRICILVFLRFANTIPFYGTMVNLQHVGSNIFLLQKCRPCVWLWHVWESAVLLLLFPVLLFTSLNSSPLFSGQELQE

SEQ ID NO: 56186 - protein, 424 aa, Homo sapiens
MAFEELLSQVGGLGRFQMLHLVFILPSLMLLIPHILLENFAAAIPGHRCWVHMLDNNTGSGNETGILSEDALLRISIPLDSNLRPEKCRRFVHPQWQLLHLNGTIHSTSEADTEPCVDGWVYDQSYFPSTIVTKWDLVCDYQSLKSVVQFLLLTGMLVGGIIGGHVSDRFGRRFILRWCLLQLAITDTCAAFAPTFPVYCVLRFLAGFSSMIIISNNSLPITEWIRPNSKALVVILSSGALSIGQIILGGLAYVFRDWQTLHVVASVPFFVFFLLSRWLVESARWLIITNKLDEGLKALRKVARTNGIKNAEETLNIEVVRSTMQEELDAAQTKTTVCDLFRNPSMRKRICILVFLRFANTIPFYGTMVNLQHVGSNIFLLQKCRPCVWLWHVWESAVLLLLFPVLLFTSLNSSPLFSGQELQE

SEQ ID NO: 56187 - protein, 363 aa, Homo sapiens
MPVRTLFPESWLWRKFTLPKSKSGISHYPISVKVPDSITTWQFVVVSLKAGQGLCVSDPFELTVMKSFFVDLKLPSSVIRNEQVQIQAMLYNFRDRQAKVRVEFPHKETLCSASKPGAPSHQAGVQIQQTSYSIVLEPQGQTQTKLVPRQEFLNMVPDTEAEVFISVQGYTQMLTHRSSDGTYHTSKGNPGSTWLTSYVFRVFALAYSMMTTQVLSLSSLCDMANWIIIDRQAEDGHFLEKGPVVMTSMQDGYQGSEEDVSLTALVLIALNEGKELCRQKNLMASIERARGFLERKLPDIQTTFAVAIASYALALANSSQANDCLDSFASPSGCGMLLNQPQSWSGEGVISNPAMCYSSLSVS

SEQ ID NO: 56188 - protein, 204 aa, Homo sapiens
MERELEALAARLARPAEPPFQALVEAAGGRGQVLLVGELWEREQSRALLRDFARAVFPPEPEDAVAPGLRLLEALLRAVFGRQAGGPVQAAAYCPGLPASCLAVQAAACRALQAAGAGQPVEGAWERPGLPGLLACFSWGPWSRRKNQDVAACRSSAQEDFQEPEEELPLTAIFPNGDCDDLGRGSKACDGVVHTPAEPTGDSR

SEQ ID NO: 56189 - protein, 204 aa, Homo sapiens; identical to SEQ ID NO: 56188

SEQ ID NO: 56190 - protein, 344 aa, Homo sapiens
MVLQMEPQVNSTNNFHQGPLDQPVGPLTGLKSSLLKDTTSAGPLLRPYPASLLGKVKEAVKVAIDAEYRHIDCAYFYENQHEVGEAIQEKIQEKAVMREDLFIVSKVWPTFFERPLVRKAFEKTLKDLKLSYLDVYLIHWPQGFKTGDDFFPKDDKGNMISGKGTFLDAWEAMEELVDEGLVKALGVSNFNHFQIERLLNKPGLKYKPVTNQVECHPYLTQEKLIQYCHSKGITVTAYSPLGSPDRPWAKPEDPSLLEDPKIKEIAAKHKKTTAQVLIRFHIQRNVTVIPKSMTPAHIVENIQVFDFKLSDEEMATILSFNRNWRAFDFKEFSHLEDFPFDAEY

SEQ ID NO: 56191 - protein, 344 aa, Homo sapiens; identical to SEQ ID NO: 56190

SEQ ID NO: 56192 - protein, 316 aa, Homo sapiens
MATFVELSTKAKMPIVGLGTWRSLLGKVKEAVKVAIDAEYRHIDCAYFYENQHEVGEAIQEKIQEKAVMREDLFIVSKVWPTFFERPLVRKAFEKTLKDLKLSYLDVYLIHWPQGFKTGDDFFPKDDKGNMISGKGTFLDAWEAMEELVDEGLVKALGVSNFNHFQIERLLNKPGLKYKPVTNQVECHPYLTQEKLIQYCHSKGITVTAYSPLGSPDRPWAKPEDPSLLEDPKIKEIAAKHKKTTAQVLIRFHIQRNVTVIPKSMTPAHIVENIQVFDFKLSDEEMATILSFNRNWRAFDFKEFSHLEDFPFDAEY

SEQ ID NO: 56193 - protein, 316 aa, Homo sapiens; identical to SEQ ID NO: 56192

SEQ ID NO: 56194 - protein, 316 aa, Homo sapiens; identical to SEQ ID NO: 56192

SEQ ID NO: 56195 - protein, 344 aa, Homo sapiens; identical to SEQ ID NO: 56190

SEQ ID NO: 56196 - protein, 275 aa, Homo sapiens [sequence omitted]

SEQ ID NO: 56197 - protein, 275 aa, Homo sapiens [sequence omitted]

SEQ ID NO: 56198 - protein, 178 aa, Homo sapiens
MGDRVKGSKSRRPDLVVEVAHPKIIHESGAQILRHANLLSLRVTMATHPDGFRLEGPLAAAHSPGPCTVLYEGPVRGLCPFAPRNSNTMAAAALAAPSLGFDGVIGVLVADTSLTDMHVVDVELSGPRGPTGRSFAVHTRRENPAEPGAVTGSATVTAFWRSLLACCQLPSRPGIHLC

SEQ ID NO: 56199 - protein, 233 aa, Homo sapiens
MAELKYISGFGNECSSEDPRCPGSLPEGQNNPQVCPYNLYAEQLSGSAFTCPRSTNKRSWLYRILPSVSHKPFESIDEGQVTHNWDEVDPDPNQLRWKPFEIPKASQKKVDFVSGLHTLCGAGDIKSNNGLAIHIFLCNTSMENRCFYNSDGDFLIVPQKGNLLIYTEFGKMLVQPNEICVIQRGMRFSIDVFEETRGYILEVYGVHFELPDLGPIDSLGLPKRYQTGNAVNL

SEQ ID NO: 56200 - protein, 107 aa, Homo sapiens
MVTQGSQGEGRPFLSAESAGPAQEQPNGYRCSHDSECQSSCCVRNNSPQELCTPQSVFLQCVPWRKPNGDFCSSHQECHSQCCIQLREYSPFRCIPRTGILAQCLPL

SEQ ID NO: 56201 - protein, 86 aa, Homo sapiens
MKVELRWPTAISTLWSTTLHPDCMEVGLSLQLDLGHHLSPRGTFCLTLAPFERFFYSISSLSCHHVKKDMFASPSAMNEKHGQQSR

SEQ ID NO: 56202 - protein, 107 aa, Homo sapiens; identical to SEQ ID NO: 56200

SEQ ID NO: 56203 - protein, 576 aa, Homo sapiens [sequence omitted]

SEQ ID NO: 56204 - protein, 95 aa, Homo sapiens
MLEDEERAGTTKGKMRSKTESEKAGKRLPSPALWWVNGKGKELMWNFRELSENSQQAANVLSGACGLQRGDRVAVMLPRVPEWWLVILGCIRAGW

SEQ ID NO: 56205 - protein, 86 aa, Homo sapiens; identical to SEQ ID NO: 56201

SEQ ID NO: 56206 - protein, 180 aa, Homo sapiens
MASWDEKDLTIRQPNTRKGIDMYIEGMADLNEMILLLPICQPEEKDVKLALIEERMKNCYFPTFEKALKTRISNLPTVKKFLQPGSQRRPPVDVKALEEARKTFKLEKREPVVAQSESESLTPGKPTVQPSVCGQKPESSQQAAGASPRVQRPKNLESNDKGKRSGRKNPAREKEGSQRT

SEQ ID NO: 56207 - protein, 1242 aa, Homo sapiens
MYSIITPNILRLESEETMVLEAHDAQGDVPVTVTVHDFPGKKLVLSSEKTVLTPATNHMGNVTFTIPANREFKSEKGRNKFVTVQATFGTQVVEKVVLVSLQSGYLFIQTDKTIYTPGSTVLYRIFTVNHKLLPVGRTVMVNIENPEGIPVKQDSLSSQNQLGVLPLSWDIPELVNMGQWKIRAYYENSPQQVFSTEFEVKEYVLPSFEVIVEPTEKFYYIYNEKGLEVTITARFLYGKKVEGTAFVIFGIQDGEQRISLPESLKRIPIEDGSGEVVLSRKVLLDGVQNLRAEDLVGKSLYVSATVILHSGSDMVQAERSGIPIVTSPYQIHFTKTPKYFKPGMPFDLMVFVTNPDGSPAYRVPVAVQGEDTVQSLTQGDGVAKLSINTHPSQKPLSITVRTKKQELSEAEQATRTMQALPYSTVGNSNNYLHLSVLRTELRPGETLNVNFLLRMDRAHEAKIRYYTYLIMNKGRLLKAGRQVREPGQDLVVLPLSITTDFIPSFRLVAYYTLIGASGQREVVADSVWVDVKDSCVGSLVVKSGQSEDRQPVPGQQMTLKIEGDHGARVVLVAVDKGVFVLNKKNKLTQSKIWDVVEKADIGCTPGSGKDYAGVFSDAGLTFTSSSGQQTAQRAELQCPQPAARRRRSVQLTEKRMDKVGKYPKELRKCCEDGMRENPMRFSCQRRTRFISLGEACKKVFLDCCNYITELRRQHARASHLGLARSNLDEDIIAEENIVSRSEFPESWLWNVEDLKEPPKNGISTKLMNIFLKDSITTWEILAVSMSDKKGICVADPFEVTVMQDFFIDLRLPYSVVRNEQVEIRAVLYNYRQNQELKVRVELLHNPAFCSLATTKRRHQQTVTIPPKSSLSVPYVIVPLKTGLQEVEVKAAVYHHFISDGVRKSLKVVPEGIRMNKTVAVRTLDPERLGREGVQKEDIPPADLSDQVPDTESETRILLQGTPVAQMTEDAVDAERLKHLIVTPSGCGEQNMIGMTPTVIAVHYLDETEQWEKFGLEKRQGALELIKKGYTQQLAFRQPSSAFAAFVKRAPSTWLTAYVVKVFSLAVNLIAIDSQVLCGAVKWLILEKQKPDGVFQEDAPVIHQEMIGGLRNNNEKDMALTAFVLISLQEAKDICEEQVNSLPGSITKAGDFLEANYMNLQRSYTVAIAGYALAQMGRLKGPLLNKFLTTAKDKNRWEDPGKQLYNVEATSYALLALLQLKDFDFVPPVPWLNTKRTPLTTRN

SEQ ID NO: 56208 - protein, 120 aa, Homo sapiens
MAAQNAPAPLGISLCMLRRLAALLFFRMLFFFFPTEGASEEEIRLSKMVMKFWANFARNGNPNGEGLPHWPEYNQKEGYLQIGANTQAAQKLKDKEVAFWTNLFAKKAVEKPPQTEHIEL

SEQ ID NO: 56209 - protein, 530 aa, Homo sapiens
MSLKWTSVFLLIQLSCYFSSGSCGKVLVWPTEYSHWINMKTILEELVQRGHEVTVLTSSASTLVNASKSSAIKLEVYPTSLTKNYLEDSLLKILDRWIYGVSKNTFWSYFSQLQELCWEYYDYSNKLCKDAVLNKKLMMKLQESKFDVILADALNPCGELLAELFNIPFLYSLRFSVGYTFEKNGGGFLFPPSYVPVVMSELSDQMIFMERIKNMIHMLYFDFWFQIYDLKKWDQFYSEVLGRPTTLFETMGKAEMWLIRTYWDFEFPRPFLPNVDFVGGLHCKPAKPLPKEMEEFVQSSGENGIVVFSLGSMISNMSEESANMIASALAQIPQKVLWRFDGKKPNTLGSNTRLYKWLPQNDLLGHPKTKAFITHGGTNGIYEAIYHGIPMVGIPLFADQHDNIAHMKAKGAALSVDIRTMSSRDLLNALKSVINDPVYKENVMKLSRIHHDQPMKPLDRAVFWIEFVMRHKGAKHLRVAAHNLTWIQYHSLDVIAFLLACVATVIFIITKFCLFCFRKLAKKGKKKKRD

SEQ ID NO: 56210 - protein, 530 aa, Homo sapiens; identical to SEQ ID NO: 56209

SEQ ID NO: 56211 - protein, 1766 aa, Homo sapiens
MSCSKAYGERYVASVQGSAPSPRKKSTRGFYFAKLYYEAKEYDLAKKYICTYINVREMDPRAHRFLGLLYELEENTEKAVECYRRSVELNPTQKDLVLKIAELLCKNDVTDGRAEYWVERAAKLFPGSPAIYKLKEQLLDCEGEDGWNKLFDLIQSELYVRPDDVHVNIRLVELYRSTKRLKDAVARCHEAERNIALRSSLEWNSCVVQTLKEYLESLQCLESDKSDWRATNTDLLLAYANLMLLTLSTRDVQESRELLESFDSALQSAKSSLGGNDELSATFLEMKGHFYMHAGSLLLKMGQHGNNVQWRALSELAALCYLIAFQVPRPKIKLIKGEAGQNLLEMMACDRLSQSGHMLLNLSRGKQDFLKVVVETFANKSGQSALYDALFSSQSPKDTSFLGSDDIGNIDVQEPELEDLARYDVGAIRAHNGSLQHLTWLGLQWNSLPALPGIRKWLKQLFHHLPQETSRLETNAPESICILDLEVFLLGVVYTSHLQLKEKCNSHHSSYQPLCLPLPVCKQLCTERQKSWWDAVCTLIHRKAVPGNSAKLRLLVQHEINTLRAQEKHGLQPALLVHWAKCLQKMGSGLNSFYDQREYIGRSVHYWKKVLPLLKIIKKKNSIPEPIDPLFKHFHSVDIQASEIVEYEEDAHVTFAILDAVNGNIEDAMTAFESIKSVVSYWNLALIFHRKAEDIANDALSPEEQEECKNYLRKTRGYLIKILDDSDSNLSVVKKLPVPLESVKEMLKSVMQELENYSEGGPLYKNGSLRNADSEIKHSTPSPTKYSLSPSKSYKYSPKTPPRWAEDQNSLLKMIRQEVKAIKEEMQELKLNSSKSASHHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKKSEKPLENDTGLQAQDISGRKKGRGVIFGQTSSTFTFADVAKSTSGEGFQFGKKDLNFKGFSGAGEKLFSSQYGKMANKANTSGDFEKDDDAYKTEDSDDIHFEPVVQMPEKVELVTGEEGEKVLYSQGVKLFRFDAEVSQWKERGLGNLKILKNEVNGKVRMLMQREQVLKVCANHWITTTMNLKPLSGSDRAWMWSASDFSDGDAKLERLAAKFKTPELAEEFKQKFEECQRLLLDIPLQTPHKLVDTGRAAKLIQRAEEMKSGLKDFKTFLTNDQTKVAEEENKGSGTGAAGASDTTIKPNAENTGPTLEWDNYDLREDALDDSVSSSSVHASPLASSPVRKNLFHFDESTTGSNFSFKSALSLSKSPAKLNQSGTSVGTDEESDVTQEEERDGQYFEPVVPLPDLVEVSSGEENEQVVFSHRAEFYRYDKDVGQWKERGIGDIKILQNYDNKHVRILMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSKPFAFGNSSATGSLFGFSFNAPLKSNNSETSSVAQSGSESKVEPKKCELSKNSDIEQSSDSKVKNLSASFPTEESSINYTFKTPEKEPPLWYAEFTKEELVQKLSSTTKSADHLNGLLREIEATNAVLMEQIKLLKSEIRRLERNQEQEVSAANVEHLKNVLLQFIFLKPGSERERLLPVINTMLQLSLEEKGKLAAVAQGLQETSIPKKK

SEQ ID NO: 56212 - protein, 1760 aa, Homo sapiens
MSCSKAYGERYVASVQGSAPSPRKKSTRGFYFAKLYYEAKEYDLAKKYICTYINVREMDPRAHRFLGLLYELEENTEKAVECYRRSVELNPTQKDLVLKIAELLCKNDVTDGRAEYWVERAAKLFPGSPAIYKLKEQLLDCEGEDGWNKLFDLIQSELYVRPDDVHVNIRLVELYRSTKRLKDAVARCHEAERNIALRSSLEWNSCVVQTLKEYLESLQCLESDKSDWRATNTDLLLAYANLMLLTLSTRDVQESRELLESFDSALQSAKSSLGGNDELSATFLEMKGHFYMHAGSLLLKMGQHGNNVQWRALSELAALCYLIAFQVPRPKIKLIKGEAGQNLLEMMACDRLSQSGHMLLNLSRGKQDFLKVVVETFANKSGQSALYDALFSSQSPKDTSFLGSDDIGNIDVQEPELEDLARYDVGAIRAHNGSLQHLTWLGLQWNSLPALPGIRKWLKQLFHHLPQETSRLETNAPESICILDLEVFLLGVVYTSHLQLKEKCNSHHSSYQPLCLPLPVCKQLCTERQKSWWDAVCTLIHRKAVPGNSAKLRLLVQHEINTLRAQEKHGLQPALLVHWAKCLQKMGSGLNSFYDQREYIGRSVHYWKKVLPLLKIIKKKNSIPEPIDPLFKHFHSVDIQASEIVEYEEDAHVTFAILDAVNGNIEDAMTAFESIKSVVSYWNLALIFHRKAEDIANDALSPEEQEECKNYLRKTRGYLIKILDDSDSNLSVVKKLPVPLESVKEMLKSVMQELENYSEGGPLYKNGSLRNADSEIKHSTPSPTKYSLSPSKSYKYSPKTPPRWAEDQNSLLKMIRQEVKAIMKLNSSKSASHHRWPTENYGPDSVPDGYQGSQTFHGAPLTVATTGPSVYYSQSPAYNSQYLLRPAANVTPTKGSSNTEFKSTKEGFSIPVSADGFKFGISEPGNQEKKSEKPLENDTGLQAQDISGRKKGRGVIFGQTSSTFTFADVAKSTSGEGFQFGKKDLNFKGFSGAGEKLFSSQYGKMANKANTSGDFEKDDDAYKTEDSDDIHFEPVVQMPEKVELVTGEEGEKVLYSQGVKLFRFDAEVSQWKERGLGNLKILKNEVNGKVRMLMQREQVLKVCANHWITTTMNLKPLSGSDRAWMWSASDFSDGDAKLERLAAKFKTPELAEEFKQKFEECQRLLLDIPLQTPHKLVDTGRAAKLIQRAEEMKSGLKDFKTFLTNDQTKVAEEENKGSGTGAAGASDTTIKPNAENTGPTLEWDNYDLREDALDDSVSSSSVHASPLASSPVRKNLFHFDESTTGSNFSFKSALSLSKSPAKLNQSGTSVGTDEESDVTQEEERDGQYFEPVVPLPDLVEVSSGEENEQVVFSHRAEFYRYDKDVGQWKERGIGDIKILQNYDNKHVRILMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSKPFAFGNSSATGSLFGFSFNAPLKSNNSETSSVAQSGSESKVEPKKCELSKNSDIEQSSDSKVKNLSASFPTEESSINYTFKTPEKEPPLWYAEFTKEELVQKLSSTTKSADHLNGLLREIEATNAVLMEQIKLLKSEIRRLERNQEQEVSAANVEHLKNVLLQFIFLKPGSERERLLPVINTMLQLSLEEKGKLAAVAQGLQETSIPKKK

SEQ ID NO: 56213 - protein, 101 aa, Homo sapiens
MRMVTPAMRTLAILAAILLVALQAQAEPLQARADEVAAAPEQIAADIPEVVVSLAWDESLAPKHPGSRKNMACYCRIPACIAGERRYGTCIYQGRLWAFCC

SEQ ID NO: 56214 - protein, 168 aa, Homo sapiens
MTPHQHSRTSEKYPNADLIMNYCRNPDPVEGPWCYTMDPKVRWEYCNLTRCSDTEGTAVVPLTVIPVPSLEDPSKPAPTEPRPWEQQCYHGNGQSYRGTYFTTVTGRTCQAWSSMTPHQHSRTPENGLTRNYCRNPDSGKQPWCYTTDPCVRWEYCNLTQCSETESVS

SEQ ID NO: 56215 - protein, 156 aa, Homo sapiens
MQKLELGRYNETHAIAKWLLEKQELGGGFRSTQTTVVALEALTRFREAVPFKGIQDLHVQIRAPKTALNVNWYIDHSNAYQQRSAKFLAQDDLEIKASGNGRGTISILTMYHKSPESREDNCNLYHLNATLHSALEENKKGGETFRLRMETRFQNN

SEQ ID NO: 56216 - protein, 267 aa, Homo sapiens
MEVSLLTGFYPNQDDLKQLTSDVERYAFQYKTKTSTSDSTVVLYLEKTGLCSLQLSHEKNTVLGFRVHRMLQAEFLQAALVTIYDYYEPSRRCSTFYNLPTEQSSLRKICHKDICRCAEGQCPSLQKPSGQLRQEELQTTACEAGVDFVYKTKLESVEVSASNPYVYYNTQLEDIIKSGTDPATPLAMKKFVSHATCHDSLGLQEQESYLIMGQTSDLWRIKSDYSYVLGKETFLILWPADGDASKKELRDQLEEFLEYMRTHGCQS

SEQ ID NO: 56217 - protein, 83 aa, Homo sapiens [sequence omitted]

SEQ ID NO: 56218 - protein, 156 aa, Homo sapiens; identical to SEQ ID NO: 56215

SEQ ID NO: 56219 - protein, 267 aa, Homo sapiens; identical to SEQ ID NO: 56216

SEQ ID NO: 56220 - protein, 168 aa, Homo sapiens; identical to SEQ ID NO: 56214

SEQ ID NO: 56221 - protein, 83 aa, Homo sapiens
MIEENIILTIDKAYLTFKWRDDENPLIQSFRTKRQSSDKSMTWMKCPTGALDIFNFCDYVKEVDFTDNGAEANISKRNPNFFP

SEQ ID NO: 56222 - protein, 4548 aa, Homo sapiens
MEHKEVVLLLLLFLKSAAPEQSHVVQDCYHGDGQSYRGTYSTTVTGRTCQAWSSMTPHQHNRTTENYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDPVAAPYCYTRDPSVRWEYCNLTQCSDAEGTAVAPPTITPIPSLEAPSEQAPTEQRPGVQECYHGNGQSYQGTYFITVTGRTCQAWSSMTPHSHSRTPAYYPNAGLIKNYCRNPDPVAAPWCYTTDPSVRWEYCNLTRCSDAEWTAFVPPNVILAPSLEAFFEQALTEETPGVQDCYYHYGQSYRGTYSTTVTGRTCQAWSSMTPHQHSRTPENYPNAGLTRNYCRNPDAEIRPWCYTMDPSVRWEYCNLTQCLVTESSVLATLTVVPDPSTEASSEEAPTEQSPGVQDCYHGDGQSYRGSFSTTVTGRTCQSWSSMTPHWHQRTTEYYPNGGLTRNYCRNPDAEISPWCYTMDPNVRWEYCNLTQCPVTESSVLATSTAVSEQAPTEQSPTVQDCYHGDGQSYRGSFSTTVTGRTCQSWSSMTPHWHQRTTEYYPNGGLTRNYCRNPDAEIRPWCYTMDPSVRWEYCNLTQCPVMESTLLTTPTVVPVPSTELPSEEAPTENSTGVQDCYRGDGQSYRGTLSTTITGRTCQSWSSMTPHWHRRIPLYYPNAGLTRNYCRNPDAEIRPWCYTMDPSVRWEYCNLTRCPVTESSVLTTPTVAPVPSTEAPSEQAPPEKSPVVQDCYHGDGRSYRGISSTTVTGRTCQSWSSMIPHWHQRTPENYPNAGLTENYCRNPDSGKQPWCYTTDPCVRWEYCNLTQCSETESGVLETPTVVPVPSMEAHSEAAPTEQTPVVRQCYHGNGQSYRGTFSTTVTGRTCQSWSSMTPHRHQRTPENYPNDGLTMNYCRNPDADTGPWCFTMDPSIRWEYCNLTRCSDTEGTVVAPPTVIQVPSLGPPSEQDCMFGNGKGYRGKKATTVTGTPCQEWAAQEPHRHSTFIPGTNKWAGLEKNYCRNPDGDINGPWCYTMNPRKLFDYCDIPLCASSSFDCGKPQVEPKKCPGSIVGGCVAHPHSWPWQVSLRTRFGKHFCGGTLISPEWVLTAAHCLKKSSRPSSYKVILGAHQEVNLESHVQEIEVSRLFLEPTQADIALLKLSRPAVITDKVMPACLPSPDYMVTARTECYITGWGETQGTFGTGLLKEAQLLVIENEVCNHYKYICAEHLARGTDSCQGDSGGPLVCFEKDKYILQGVTSWGLGCARPNKPGVYARVSRFVTWIEGMMRNN

SEQ ID NO: 56223 - protein, 132 aa, Homo sapiens
MEHKEVVLLLLLFLKSAPTETGPSVQECYHSNGQSYRGTYFTTVTGRTCQAWSSMTPHQHSRTPEKYPNDGLISNYCRNPDCSAGPWCYTTDPNVRWEYCNLTRCSDDEGTVFVPLTVIPVPSLEDSFIQVA

SEQ ID NO: 56224 - protein, 132 aa, Homo sapiens; identical to SEQ ID NO: 56223

SEQ ID NO: 56225 - protein, 347 aa, Homo sapiens
MSSWSRQRPKSPGGIQPHVSRTLFLLLLLAASAWGVTLSPKDCQVFRSDHGSSISCQPPAEIPGYLPADTVHLAVEFFNLTHLPANLLQGASKLQELHLSSNGLESLSPEFLRPVPQLRVLDLTRNALTGLPPGLFQASATLDTLVLKENQLEVLEVSWLHGLKALGHLDLSGNRLRKLPPGLLANFTLLRTLDLGENQLETLPPDLLRGPLQLERLHLEGNKLQVLGKDLLLPQPDLRYLFLNGNKLARVAAGAFQGLRQLDMLDLSNNSLASVPEGLWASLGQPNWDMRDGFDISGNPWICDQNLSDLYRWLQAQKDKMFSQNDTRCAGPEAVKGQTLLAVAKSQ

SEQ ID NO: 56226 - protein, 329 aa, Homo sapiens
MVRTKTWTLKKHFVGYPTNSDFELKTSELPPLKNGEVLLEALFLTVDPYMRVAAKRLKEGDTMMGQQVAKVVESKNVALPKGTIVLASPGWTTHSISDGKDLEKLLTEWPDTIPLSLALGTVGMPGLTAYFGLLEICGVKGGETVMVNAAAGAVGSVVGQIAKLKGCKVVGAVGSDEKVAYLQKLGFDVVFNYKTVESLEETLKKASPDGYDCYFDNVGGEFSNTVIGQMKKFGRIAICGAISTYNRTGPLPPGPPPEIVIYQELRMEAFVVYRWQGDARQKALKDLLKWVLEGKIQYKEYIIEGFENMPAAFMGMLKGDNLGKTIVKA

SEQ ID NO: 56227 - protein, 686 aa, Homo sapiens
MRLLTLLGLLCGSVATPLGPKWPEPVFGRLASPGFPGEYANDQERRWTLTAPPGYRLRLYFTHFDLELSHLCEYDFVKLSSGAKVLATLCGQESTDTERAPGKDTFYSLGSSLDITFRSDYSNEKPFTGFEAFYAAEDIDECQVAPGEAPTCDHHCHNHLGGFYCSCRAGYVLHRNKRTCSALCSGQVFTQRSGELSSPEYPRPYPKLSSCTYSISLEEGFSVILDFVESFDVETHPETLCPYDFLKIQTDREEHGPFCGKTLPHRIETKSNTVTITFVTDESGDHTGWKIHYTSTAQPCPYPMAPPNGHVSPVQAKYILKDSFSIFCETGYELLQGHLPLKSFTAVCQKDGSWDRPMPACSIVDCGPPDDLPSGRVEYITGPGVTTYKAVIQYSCEETFYTMKVNDGKYVCEADGFWTSSKGEKSLPVCEPVCGLSARTTGGRIYGGQKAKPGDFPWQVLILGGTTAAGALLYDNWVLTAAHAVYEQKHDASALDIRMGTLKRLSPHYTQAWSEAVFIHEGYTHDAGFDNDIALIKLNNKVVINSNITPICLPRKEAESFMRTDDIGTASGWGLTQRGFLARNLMYVDIPIVDHQKCTAAYEKPPYPRGSVTANMLCAGLESGGKDSCRGDSGGALVFLDSETERWFVGGIVSWGSMNCGEAGQYGVYTKVINYIPWIENIISDF

SEQ ID NO: 56228 - protein, 395 aa, Homo sapiens
MNGPVDGLCDHSLSEGVFMFTSESVGEGHPDKICDQISDAVLDAHLKQDPNAKVACETVCKTGMVLLCGEITSMAMVDYQRVVRDTIKHIGYDDSAKGFDFKTCNVLVALEQQSPDIAQCVHLDRNEEDVGAGDQGLMFGYATDETEECMPLTIILAHKLNARMADLRRSGLLPWLRPDSKTQVTVQYMQDNGAVIPVRIHTIVISVQHNEDITLEEMRRALKEQVIRAVVPAKYLDEDTVYHLQPSGRFVIGGPQGDAGVTGRKIIVDTYGGWGAHGGGAFSGKDYTKVDRSAAYAARWVAKSLVKAGLCRRVLVQVSYAIGVAEPLSISIFTYGTSQKTERELLDVVHKNFDLRPGVIVRDLDLKKPIYQKTACYGHFGRSEFPWEVPRKLVF

SEQ ID NO: 56229 - protein, 280 aa, Homo sapiens
MKLPIFIADAFTARAFRGNPAAVCLLENELDEDMHQKIAREMNLSETAFIRKLHPTDNFAQSSCFGLRWFTPASEVPLCGHATLASAAVLFHKIKNMNSTLTFVTLSGELRARRAEDGIVLDLPLYPAHPQDFHEVEDLIKTAIGNTLVQDICYSPDTQKLLVRLSDVYNRSFLENLKVNTENLLQVENTGKVKGLILTLKGEPGGQTQAFDFYSRYFAPWVGVAEDPVTGSAHAVLSSYWSQHLGKKEMHGRTALYQFLFYLPNSKLVFLLICTIPLKM

SEQ ID NO: 56230 - protein, 288 aa, Homo sapiens
MKLPIFIADAFTARAFRGNPAAVCLLENELDEDMHQKIAREMNLSETAFIRKLHPTDNFAQSSCFGLRWFTPASEVPLCGHATLASAAVLFHKIKNMNSTLTFVTLSGELRARRAEDGIVLDLPLYPAHPQDFHEVEDLIKTAIGNTLVQDICYSPDTQKLLVRLSDVYNRSFLENLKVNTENLLQVENTGKVKGLILTLKGEPGGQTQAFDFYSRYFAPWVGVAEDPVTGSAHAVLSSYWSQHLGKKEMHAFQCSHRGGELGISLRPDGRVDIRGGAAVVLEGTLTA

SEQ ID NO: 56231 - protein, 177 aa, Homo sapiens
METNYLKRCFGNCLAQALAEVAKVRPSDPIEYLAHWLYHYRKTAKAKEENREKKIHLQEEYDSSLKEMEMTEMLKQEEYQIQQNCEKCHKELTSETVSTKKTIFMQEDTNPLEKEALKQEFLPGTSSLIPGMPQQVPPSESAGQIDQNFKMPQEINYKEAFQHEVAHEMPPGSKSPF

SEQ ID NO: 56232 - protein, 711 aa, Homo sapiens
MGWLPLLLLLTQCLGVPGQRSPLNDFQVLRGTELQHLLHAVVPGPWQEDVADAEECAGRCGPLMDCRAFHYNVSSHGCQLLPWTQHSPHTRLRRSGRCDLFQKKDYVRTCIMNNGVGYRGTMATTVGGLPCQAWSHKFPNDHKYTPTLRNGLEENFCRNPDGDPGGPWCYTTDPAVRFQSCGIKSCREAACVWCNGEEYRGAVDRTESGRECQRWDLQHPHQHPFEPGKFLDQGLDDNYCRNPDGSERPWCYTTDPQIEREFCDLPRCGSEAQPRQEATTVSCFRGKGEGYRGTANTTTAGVPCQRWDAQIPHQHRFTPEKYACKDLRENFCRNPDGSEAPWCFTLRPGMRAAFCYQIRRCTDDVRPQDCYHGAGEQYRGTVSKTRKGVQCQRWSAETPHKPQFTFTSEPHAQLEENFCRNPDGDSHGPWCYTMDPRTPFDYCALRRCADDQPPSILDPPDQVQFEKCGKRVDRLDQRRSKLRVVGGHPGNSPWTVSLRNRQGQHFCGGSLVKEQWILTARQCFSSCHMPLTGYEVWLGTLFQNPQHGEPSLQRVPVAKMVCGPSGSQLVLLKLERSVTLNQRVALICLPPEWYVVPPGTKCEIAGWGETKGTGNDTVLNVALLNVISNQECNIKHRGRVRESEMCTEGLLAPVGACEGDYGGPLACFTHNCWVLEGIIIPNRVCARSRWPAVFTRVSVFVDWIHKVMRLG

SEQ ID NO: 56233 - protein, 61 aa, Homo sapiens
MDPNCSCTTGGSCACAGSCKCKECKCTSCKKCCCSCCPVGCAKCAQGCVCKGSSEKCRCCA

SEQ ID NO: 56234 - protein, 40 aa, Homo sapiens
MDPNYSCTTGGSCTCAGSCKCKECKCTSCKKSCCFCCPMG

SEQ ID NO: 56235 - protein, 61 aa, Homo sapiens
MDPNCSCTTGVSCACTGSCKCKECKCTSCKKSCCSCCPVGCAKCAHGCVCKGTLENCSCCA

SEQ ID NO: 56236 - protein, 49 aa, Homo sapiens
MDLSCSCATGGSCTCASSCKCKEYKCTSCKKNCCSCCPMGCAKCSQGCT

SEQ ID NO: 56237 - protein, 290 aa, Homo sapiens
MDIEAYFERIGYKNSRNKLDLETLTDILEHQIRAVPFENLNMHCGQAMELGLEAIFDHIVRRNRGGWCLQVNQLLYWALTTIGFQTTMLGGYFYIPPVNKYSTGMVHLLLQVTIDGRNYIVDAGSGSSSQMWQPLELISGKDQPQVPCIFCLTEERGIWYLDQIRREQYITNKEFLNSHLLPKKKHQKIYLFTLEPRTIEDFESMNTYLQTSPTSSFITTSFCSLQTPEGVYCLVGFILTYRKFNYKDNTDLVEFKTLTEEEVEEVLKNIFKISLGRNLVPKPGDGSLTI

SEQ ID NO: 56238 - protein, 348 aa, Homo sapiens
MASREDELRNCVVCGDQATGYHFNALTCEGCKGFFRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVGFQVEFLELLFHFHGTLRKLQLQEPEYVLLAAMALFSPDRPGVTQRDEIDQLQEEMALTLQSYIKGQQRRPRDRFLYAKLLGLLAELRSINEAYGYQIQHIQGLSAMMPLLQEICS

SEQ ID NO: 56239 - protein, 545 aa, Homo sapiens
MPPFLLLTCLFITGTSVSPVALDPCSAYISLNEPWRNTDHQLDESQGPPLCDNHVNGEWYHFTGMAGDAMPTFCIPENHCGTHAPVWLNGSHPLEGDGIVQRQACASFNGNCCLWNTTVEVKACPGGYYVYRLTKPSVCFHVYCGHFYDICDEDCHGSCSDTSECTCAPGTVLGPDRQTCFDENECEQNNGGCSEICVNLKNSYRCECGVGRVLRSDGKTCEDVEGCHNNNGGCSHSCLGSEKGYQCECPRGLVLSEDNHTCQVPVLCKSNAIEVNIPRELVGGLELFLTNTSCRGVSNGTHVNILFSLKTCGTVVDVVNDKIVASNLVTGLPKQTPGSSGDFIIRTSKLLIPVTCEFPRLYTISEGYVPNLRNSPLEIMSRNHGIFPFTLEIFKDNEFEEPYREALPTLKLRDSLYFGIEPVVHVSGLESLVESCFATPTSKIDEVLKYYLIRDGCVSDDSVKQYTSRDHLAKHFQVPVFKFVGKDHKEVFLHCRVLVCGVLDERSRCAQGCHRRMRRGAGGEDSAGLQGQTLTGGPIRIDWED

SEQ ID NO: 56240 - protein, 201 aa, Homo sapiens
MALSWVLTVLSLLPLLEAQIPLCANLVPVPITNATLDQITGKWFYIASAFRNEEYNKSVQEIQATFFYFTPNKTEDTIFLREYQTRQDQCIYNTTYLNVQRENGTISRYVGGQEHFAHLLILRDTKTYMLAFDVNDEKNWGLSVYADKPETTKEQLGEFYEALDCLRIPKSDVVYTDWKKDKCEPLEKQHEKERKQEEGES

SEQ ID NO: 56241 - protein, 354 aa, Homo sapiens
MLFNLRILLNNAAFRNGHNFMVRNFRCGQPLQNKVQLKGRDLLTLKNFTGEEIKYMLWLSADLKFRIKQKGEYLPLLQGKSLGMIFEKRSTRTRLSTETGFALLGGHPCFLTTQDIHLGVNESLTDTARVLSSMADAVLARVYKQSDLDTLAKEASIPIINGLSDLYHPIQILADYLTLQEHYSSLKGLTLSWIGDGNNILHSIMMSAAKFGMHLQAATPKGYEPDASVTKLAEQYAKENGTKLLLTNDPLEAAHGGNVLITDTWISMGQEEEKKKRLQAFQGYQVTMKTAKVAASDWTFLHCLPRKPEEVDDEVFYSPRSLVFPEAENRKWTIMAVMVSLLTDYSPQLQKPKF

SEQ ID NO: 56242 - protein, 452 aa, Homo sapiens
MSTAVLENPGLGRKLSDFGQETSYIEDNCNQNGAISLIFSLKEEVGALAKVLRLFEENDVNLTHIESRPSRLKKDEYEFFTHLDKRSLPALTNIIKILRHDIGATVHELSRDKKKDTVPWFPRTIQELDRFANQILSYGAELDADHPGFKDPVYRARRKQFADIAYNYRHGQPIPRVEYMEEEKKTWGTVFKTLKSLYKTHACYEYNHIFPLLEKYCGFHEDNIPQLEDVSQFLQTCTGFRLRPVAGLLSSRDFLGGLAFRVFHCTQYIRHGSKPMYTPEPDICHELLGHVPLFSDRSFAQFSQEIGLASLGAPDEYIEKLATIYWFTVEFGLCKQGDSIKAYGAGLLSSFGELQYCLSEKPKLLPLELEKTAIQNYTVTEFQPLYYVAESFNDAKEKVRNFAATIPRPFSVRYDPYTQRIEVLDNTQQLKILADSINSEIGILCSALQKIK

SEQ ID NO: 56243 - protein, 314 aa, Homo sapiens
MKLINGKKQTFPWFGMDIGGTLVKLVYFEPKDITAEEEQEEVENLKSIRKYLTSNTAYGKTGIRDVHLELKNLTMCGRKGNLHFIRFPSCAMHRFIQMGSEKNFSSLHTTLCATGGGAFKFEEDFRMIADLQLHKLDELDCLIQGLLYVDSVGFNGKPECYYFENPTNPELCQKKPYCLDNPYPMLLVNMGSGVSILAVYSKDNYKRVTGTSFGNMMSKEKRDSISKEDLARATLVTITNNIGSIARMCALNENIDRVVFVGNFLRINMVSMKLLAYAMDFWSKGQLKALFLEHEGYFGAVGALLELFKMTDDK

SEQ ID NO: 56244 - protein, 598 aa, Homo sapiens
MLKLVGGGGGQDWACSVAGTSLGGEEAAFEVARPGDQGKAGGGSPGWGCAGIPDSAPGAGVLQAGAVGPARGGQGAEEVGESAGGGEERRVRHPQAPALRLLNRKPQGGSGEIKTPENDLQRGRLSRGPRTAPPAPGMGDRSGQQERSVPHSPGAPVGTSAAAVNGLLHNGFHPPPVQPPHVCSRGPVGGSDAAPQRLPLLPELQPQPLLPQHDSPAKKCRLRRRMDSGRKNRPPFPWFGMDIGGTLVKLVYFEPKDITAEEEQEEVENLKSIRKYLTSNTAYGKTGIRDVHLELKNLTMCGRKGNLHFIRFPSCAMHRFIQMGSEKNFSSLHTTLCATGGGAFKFEEDFRMIADLQLHKLDELDCLIQGLLYVDSVGFNGKPECYYFENPTNPELCQKKPYCLDNPYPMLLVNMGSGVSILAVYSKDNYKRVTGTSLGGGTFLGLCCLLTGCETFEEALEMAAKGDSTNVDKLVKDIYGGDYERFGLQGSAVASSFGNMMSKEKRDSISKEDLARATLVTITNNIGSIARMCALNENIDRVVFVGNFLRINMVSMKLLAYAMDFWSKGQLKALFLEHEGYFGAVGALLELFKMTDDK

SEQ ID NO: 56245 - protein, 373 aa, Homo sapiens
MKLINGKKQTFPWFGMDIGGTLVKLVYFEPKDITAEEEQEEVENLKSIRKYLTSNTAYGKTGIRDVHLELKNLTMCGRKGNLHFIRFPSCAMHRFIQMGSEKNFSSLHTTLCATGGGAFKFEEDFRMIADLQLHKLDELDCLIQGLLYVDSVGFNGKPECYYFENPTNPELCQKKPYCLDNPYPMLLVNMGSGVSILAVYSKDNYKRVTGTSLGGGTFLGLCCLLTGCETFEEALEMAAKGDSTNVDKLVKDIYGGDYERFGLQGSAVASSFGNMMSKEKRDSISKEDLARATLVTITNNIGSIARMCALNENIDRVVFVGNFLRINMVSMKLLAYAMDFWSKGQLKALFLEHEGYFGAVGALLELFKMTDDK

SEQ ID NO: 56246 - protein, 634 aa, Homo sapiens
MAQGVLWILLGLLLWSDPGTASLPLLMDSVIQALAELEQKVPAAKTRHTASAWLMSAPNSGPHNRLYHFLLGAWSLNATELDPCPLSPELLGLTKEVARHDVREGKEYGVVLAPDGSTVAVEPLLAGLEAGLQGRRVINLPLDSMAAPWETGDTFPDVVAIAPDVRATSSPGLRDGSPDVTTADIGANTPDATKGCPDVQASLPDAKAKSPPTMVDSLLAVTLAGNLGLTFLRGSQTQSHPDLGTEGCWDQLSAPRTFTLLDPKASLLTMAFLNGALDGVILGDYLSRTPEPRPSLSHLLSQYYGAGVARDPGFRSNFRRQNGAALTSASILAQQVWGTLVLLQRLEPVHLQLQCMSQEQLAQVAANATKEFTEAFLGCPAIHPRCRWGAAPYRGRPKLLQLPLGFLYVHHTYVPAPPCTDFTRCAANMRSMQRYHQDTQGWGDIGYGFVVGSDGYVYEGRGWHWVGAHTLGHNSRGFGVAIVGNYTAALPTEAALRTVRDTLPSCAVRAGLLRPDYALLGHRQLVRTDCPGDALFDLLRTWPHFTAVSLRSLHYTARRPSVYTSSTRPLPPACNSCARTASARPPTSRRHVYSGNLGPAFAGHSAGNIPDPVTSAYAASAQPQTQPACPFPSS

SEQ ID NO: 56247 - protein, 749 aa, Homo sapiens
MEAETGSSVETGKKANRGTRIALVVFVGGTLVLGTILFLVSQGLLSLQAKQEYCLKPECIEAAAAILSKVNLSVDPCDNFFRFACDGWISNNPIPEDMPSYGVYPWLRHNVDLKLKELLEKSISRRRDTEAIQKAKILYSSCMNEKAIEKADAKPLLHILRHSPFRWPVLESNIGPEGVWSERKFSLLQTLATFRGQYSNSVFIRLYVSPDDKASNEHILKLDQATLSLAVREDYLDNSTEAKSYRDALYKFMVDTAVLLGANSSRAEHDMKSVLRLEIKIAEIMIPHENRTSEAMYNKMNISELSAMIPQFDWLGYIKKVIDTRLYPHLKDISPSENVVVRVPQYFKDLFRILGSERKKTIANYLVWRMVYSRIPNLSRRFQYRWLEFSRVIQGTTTLLPQWDKCVNFIESALPYVVGKMFVDVYFQEDKKEMMEELVEGVRWAFIDMLEKENEWMDAGTKRKAKEKARAVLAKVGYPEFIMNDTHVNEDLKAIKFSEADYFGNVLQTRKYLAQSDFFWLRKAVPKTEWFTNPTTVNAFYSASTNQIRFPAGELQKPFFWGTEYPRSLSYGAIGVIVGHEFTHGFDNNGRKYDKNGNLDPWWSTESEEKFKEKTKCMINQYSNYYWKKAGLNVKGKRTLGENIADNGGLREAFRAYRKWINDRRQGLEEPLLPGITFTNNQLFFLSYAHVRCNSYRPEAAREQVQIGAHSPPQFRVNGAISNSEEFQKAFNCPPNSTMNRGMDSCRLW

SEQ ID NO: 56248 - protein, 574 aa, Homo sapiens
MSIQENISSLQLRSWVSKSQRDLAKSILIGAPGGPAGYLRRASVAQLTQELGTAFFQQQQLPAAMADTFLEHLCLLDIDSEPVAARSTSIIATIGPASRSVERLKEMIKAGMNIARLNFSHGSHEYHAESIANVREAVESFAGSPLSYRPVAIALDTKGPEIRTGILQGGPESEVELVKGSQVLVTVDPAFRTRGNANTVWVDYPNIVRVVPVGGRIYIDDGLISLVVQKIGPEGLVTQVENGGVLGSRKGVNLPGAQVDLPGLSEQDVRDLRFGVEHGVDIVFASFVRKASDVAAVRAALGPEGHGIKIISKIENHEGVKRFDEILEVSDGIMVARGDLGIEIPAEKVFLAQKMMIGRCNLAGKPVVCATQMLESMITKPRPTRAETSDVANAVLDGADCIMLSGETAKGNFPVEAVKMQHAIAREAEAAVYHRQLFEELRRAAPLSRDPTEVTAIGAVEAAFKCCAAAIIVLTTTGRSAQLLSRYRPRAAVIAVTRSAQAARQVHLCRGVFPLLYREPPEAIWADDVDRRVQFGIESGKLRGFLRVGDLVIVVTGWRPGSGYTNIMRVLSIS

SEQ ID NO: 56249 - protein, 543 aa, Homo sapiens
MEGPAGYLRRASVAQLTQELGTAFFQQQQLPAAMADTFLEHLCLLDIDSEPVAARSTSIIATIGPASRSVERLKEMIKAGMNIARLNFSHGSHEYHAESIANVREAVESFAGSPLSYRPVAIALDTKGPEIRTGILQGGPESEVELVKGSQVLVTVDPAFRTRGNANTVWVDYPNIVRVVPVGGRIYIDDGLISLVVQKIGPEGLVTQVENGGVLGSRKGVNLPGAQVDLPGLSEQDVRDLRFGVEHGVDIVFASFVRKASDVAAVRAALGPEGHGIKIISKIENHEGVKRFDEILEVSDGIMVARGDLGIEIPAEKVFLAQKMMIGRCNLAGKPVVCATQMLESMITKPRPTRAETSDVANAVLDGADCIMLSGETAKGNFPVEAVKMQHAIAREAEAAVYHRQLFEELRRAAPLSRDPTEVTAIGAVEAAFKCCAAAIIVLTTTGRSAQLLSRYRPRAAVIAVTRSAQAARQVHLCRGVFPLLYREPPEAIWADDVDRRVQFGIESGKLRGFLRVGDLVIVVTGWRPGSGYTNIMRVLSIS

SEQ ID NO: 56250 - protein, 391 aa, Homo sapiens
MSELRLCCDLLVQQVDKTKEVTTTGVSNSEEGIDVGTLLKSTCNTFLKTLEECMQIANAAFTSELLYHTPPGSPQLAMLKSSKMKHPIIPIHNSLERQTELSTCENGSLNMEINGEEEILMKNKNSLYLKSAEIDCSISSEENTDDNITVQGEIMKEDRMENLKNHDNNLSQSGSDSSCSPECLWEEGKEVIPTFFSTMNTSFSDIELLEDSGIPTEAFLASCCAVVPVLDKLGPTVFAPVKMDLVENIKKVNQKYITNKEEFTTLQKIVLHEVEADVAQVRNSATEALLWLKRGLKFLKGFLTEVKNGEKDIQTALNNAYGKTLRQHHGWVVRGVFALALRATPSYEDFVAALTVKEGDHRKEAFSIGMQRDLSLYLPAMKKQMAILDAL

SEQ ID NO: 56251 - protein, 810 aa, Homo sapiens
MEHKEVVLLLLLFLKSGQGEPLDDYVNTQGASLFSVTKKQLGAGSIEECAAKCEEDEEFTCRAFQYHSKEQQCVIMAENRKSSIIIRMRDVVLFEKKVYLSECKTGNGKNYRGTMSKTKNGITCQKWSSTSPHRPRFSPATHPSEGLEENYCRNPDNDPQGPWCYTTDPEKRYDYCDILECEEECMHCSGENYDGKISKTMSGLECQAWDSQSPHAHGYIPSKFPNKNLKKNYCRNPDRELRPWCFTTDPNKRWELCDIPRCTTPPPSSGPTYQCLKGTGENYRGNVAVTVSGHTCQHWSAQTPHTHNRTPENFPCKNLDENYCRNPDGKRAPWCHTTNSQVRWEYCKIPSCDSSPVSTEQLAPTAPPELTPVVQDCYHGDGQSYRGTSSTTTTGKKCQSWSSMTPHRHQKTPENYPNAGLTMNYCRNPDADKGPWCFTTDPSVRWEYCNLKKCSGTEASVVAPPPVVLLPDVETPSEEDCMFGNGKGYRGKRATTVTGTPCQDWAAQEPHRHSIFTPETNPRAGLEKNYCRNPDGDVGGPWCYTTNPRKLYDYCDVPQCAAPSFDCGKPQVEPKKCPGRVVGGCVAHPHSWPWQVSLRTRFGMHFCGGTLISPEWVLTAAHCLEKSPRPSSYKVILGAHQEVNLEPHVQEIEVSRLFLEPTRKDIALLKLSSPAVITDKVIPACLPSPNYVVADRTECFITGWGETQGTFGAGLLKEAQLPVIENKVCNRYEFLNGRVQSTELCAGHLAGGTDSCQGDSGGPLVCFEKDKYILQGVTSWGLGCARPNKPGVYVRVSRFVTWIEGVMRNN

SEQ ID NO: 56252 - protein, 96 aa, Homo sapiens
MEHKEVVLLLLLFLKSGQGEPLDDYVNAQGASLFSVTKKQLGAGSREECAAKCEEDKEFTCRAFQYHSKEQQCVIMAENKKSSIIIRMRDVVLFEK

SEQ ID NO: 56253 - protein, 96 aa, Homo sapiens
MEHKEVVLLLLLFLKSGQGEPLDDYVNTQGPSLFSVTKKQLGAGSREECAAKCEEDKEFTCRAFQYHSKEQQCVIMAENRKSSIIIRMRDAVLFEK

SEQ ID NO: 56254 - protein, 96 aa, Homo sapiens; identical to SEQ ID NO: 56253

SEQ ID NO: 56255 - protein, 355 aa, Homo sapiens [sequence omitted]

SEQ ID NO: 56256 - protein, 354 aa, Homo sapiens
MGKLVALVLLGVGLSLVGEMFLAFRERVNASREVEPVEPENCHLIEELESGSEDIDILPSGLAFISSGLKYPGMPNFAPDEPGKIFLMDLNEQNPRAQALEISGGFDKELFNPHGISIFIDKDNTVYLYVVNHPHMKSTVEIFKFEEQQRSLVYLKTIKHELLKSVNDIVVLGPEQFYATRDHYFTNSLLSFFEMILDLRWTYVLFYSPREVKVVAKGFCSANGITVSADQKYVYVADVAAKNIHIMEKHDNWDLTQLKVIQLGTLVDNLTVDPATGDILAGCHPNPMKLLNYNPEDPPGSEVLRIQNVLSEKPRVSTVYANNGSVLQGTSVASVYHGKILIGTVFHKTLYCEL

SEQ ID NO: 56257 - protein, 285 aa, Homo sapiens
MMAVDIEYRYNCMAPSLRQERFAFKISPKPSKPLRPCIQLSSKNEASGMVAPAVQEKKVKKRVSFADNQGLALTMVKVFSEFDDPLDMPFNITELLDNIVSLTTAESESFVLDFSQPSADYLDFRNRLQADHVCLENCVLKDKAIAGTAKVQNLAFEKTVKIRMTFDTWKSYTDFPCQYVKDTYAGSDRDTFSFDISLPEKIQSYERMEFAVYYECNGQTYWDSNRGKNYRIIRAELKSTQGMTKPHSGPDLGISFDQFGSPRCSYGLFPEWPSYLGYEKLGPYY

SEQ ID NO: 56258 - protein, 536 aa, Homo sapiens
MSPRVVSNSSVLASQSVGITNVRTVFSNVFNNTTAFPILRGSNCHKITAPGLGKGQLVNLLPPENLPWCGGSQGPRMLRTCYVLCSQAGPPSRGWQSLSFDGGAFHLKGTGELTRALLVLRLCAWPPLVTHGLLLQAWSRRLLGSRLSGAFLRASVYGQFVAGETAEEVKGCVQQLRTLSLRPLLAVPTEEEPDSAAKSGEAWYEGNLGAMLRCVDLSRGLLEPPSLAEASLMQLKVTALTSTRLCKELASWVRRPGASLELSPERLAEAMDSGQNLQVSCLNAEQNQHLRASLSRLHRVAQYARAQHVRLLVDAEYTSLNPALSLLVAALAVRWNSPGEGGPWVWNTYQACLKDTFERLGRDAEAAHRAGLAFGVKLVRGAYLDKERAVAQLHGMEDPTQPDYEATSQSYSRCLELMLTHVARHGPMCHLMVASHNEESVRQATKRMWELGIPLDGTVCFGQLLGMCDHVSLALGQAGYVVYKSIPYGSLEEVIPYLIRRAQENRSVLQGARREQELLSQELWRRLLPGCRRIPH

SEQ ID NO: 56259 - protein, 737 aa, Homo sapiens
MPDHDSTALLSRQTKRRRVDIGVKRTVGTASAFFAKARATFFSAMNPQGSEQDVEYSVVQHADGEKSNVLRKLLKRANSYEDAMMPFPGATIISQLLKNNMNKNGGTEPSFQASGLSSTGSEVHQEDICSNSSRDSPPECLSPFGRPTMSQFDMDRLCDEHLRAKRARVENIIRGMSHSPSVALRGNENEREMAPQSVSPRESYRENKRKQKLPQQQQQSFQQLVSARKEQKREERRQLKQQLEDMQKQLRQLQEKFYQIYDSTDSENDEDGNLSEDSMRSEILDARAQDSVGRSDNEMCELDPGQFIDRARALIREQEMAENKPKREGNNKERDHGPNSLQPEGKHLAETLKQELNTAMSQVVDTVVKVFSAKPSRQVPQVFPPLQIPQARFAVNGENHNFHTANQRLQCFGDVIIPNPLDTFGNVQMASSTDQTEALPLVVRKNSSDQSASGPAAGGHHQPLHQSPLSATTGFTTSTFRHPFPLPLMAYPFQSPLGAPSGSFSGKDRASPESLDLTRDTTSLRTKMSSHHLSHHPCSPAHPPSTAEGLSLSLIKSECGDLQDMSEISPYSGSAMQEGLSPNHLKKAKLMFFYTRYPSSNMLKTYFSDVKFNRCITSQLIKWFSNFREFYYIQMEKYARQAINDGVTSTEELSITRDCELYRALNMHYNKANDFEVPERFLEVAQITLREFFNAIIAGKDVDPSWKKAIYKVICKLDSEVPEIFKSPNCLQELLHE

SEQ ID NO: 56260 - protein, 400 aa, Homo sapiens
MAGCVPLLQGLVLVLALHRVEPSVFLPASKANDVLVRWKRAGSYLLEELFEGNLEKECYEEICVYEEAREVFENEVVTDEFWRRYKGGSPCISQPCLHNGSCQDSIWGYTCTCSPGYEGSNCELAKNECHPERTDGCQHFCLPGQESYTCSCAQGYRLGEDHKQCVPHDQCACGVLTSEKRAPDLQDLPWQVKLTNSEGKDFCGGVIIRENFVLTTAKCSLLHRNITVKTYFNRTSQDPLMIKITHVHVHMRYDADAGENDLSLLELEWPIQCPGAGLPVCTPEKDFAEHLLIPRTRGLLSGWARNGTDLGNSLTTRPVTLVEGEECGQVLNVTVTTRTYCERSSVAAMHWMDGSVVTREHRGSWFLTGVLGSQPVGGQAHMVLVTKVSRYSLWFKQIMN

SEQ ID NO: 56261 - protein, 283 aa, Homo sapiens
MGLGLRGWGRPLLTVATALMLPVKPPAGSWGAQIIGGHEVTPHSRPYMASVRFGGQHHCGGFLLRARWVVSAAHCFSHRDLRTGLVVLGAHVLSTAEPTQQVFGIDALTTHPDYHPMTHANDICLLRLNGSAVLGPAVGLLRLPGRRARPPTAGTRCRVAGWGFVSDFEELPPGLMEAKVRVLDPDVCNSSWKGHLTLTMLCTRSGDSHRRGFCSADSGGPLVCRNRAHGLVSFSGLWCGDPKTPDVYTQVSAFVAWIWDVVRRSSPQPGPLPGTTRPPGEAA

SEQ ID NO: 56262 - protein, 256 aa, Homo sapiens
MAHRPPSPALASVLLALLLSGAARAAEIVGGHEAQPHSRPYMASLQMRGNPGSHFCGGTLIHPSFVLTAAHCLRDIPQRLVNVVLGAHNVRTQEPTQQHFSVAQVFLNNYDAENKLNDVLLIQLSSPANLSASVATVQLPQQDQPVPHGTQCLAMGWGRVGAHDPPAQVLQELNVTVVTFFCRPHNICTFVPRRKAGICFGDSGGPLICDGIIQGIDSFVIWGCATRLFPDFFTRVALYVDWIRSTLRRVEAKGRP

SEQ ID NO: 56263 - protein, 201 aa, Homo sapiens
MKWVWALLLLAALGSGRAERDCRVSSFRVKENFDKARFSGTWYAMAKKDPEGLFLQDNIVAEFSVDETGQMSATAKGRVRLLNNWDVCADMVGTFTDTEDPAKFKMKYWGVASFLQKGNDDHWIVDTDYDTYAVQYSCRLLNLDGTCADSYSFVFSRDPNGLPPEAQKIVRQRQEELCLARQYRLIVHNGYCDGRSERNLL

SEQ ID NO: 56264 - protein, 317 aa, Homo sapiens
MWLYLAVFVGLYYLLHWYRERQVLSHLRDKYVFITGCDSGFGKLLARQLDARGLRVLAACLTEKGAEQLRGQTSDRLETVTLDVTKTESVAAAAQWVKECVRDKGLWGLVNNAGISLPTAPNELLTKQDLLTILDVNLLGVIDVTLNLLPLVRRARGRVVNVFSVMGRVSLFGGGYCISKYGVEAFSDSLRRELSYFGVKVAMIEPGYFKTAVTSKERFLKSFLEIWDRSSPEVKEAYGEKFVADYKKSAEQMEQKCTQDLSLVTNCMEHALIACHPRTRYSAGWDAKLLYLPMSYMPTFLVDAIMYWVSPSPAKAL

SEQ ID NO: 56265 - protein, 1748 aa, Homo sapiens
MNVMGFNTDRLAWTRNKLRGFYFAKLYYEAKEYDLAKKYVCTYLSVQERDPRAHRFLGLLYELEENTEKAVECYRRSLELNPPQKDLVLKIAELLCKNDVTDGRAKYWVERAAKLFPGSPAIYKLKEHLLDCEGEDGWNKLFDWIQSELYVRPDDVHMNIRLVELYRSNKRLKDAVARCHEAERNIALRSSLEWNSCVVQTLKEYLESLQCLESDKSDWRATNTDLLLAYANLMLLTLSTRDVQESRELLESFDSALQSAKSSLGGNDELSATFLEMKGHFYMHAGSLLLKMGQHGNNVQWQALSELAALCYVIAFQVPRPKIKLIKGEAGQNLLEMMACDRLSQSGHMLLNLSRGKQDFLKEVVETFANKSGQSVLYNALFSSQSSKDTSFLGSDDIGNIDVQEPELEDLARYDVGAIQAHNGSLQHLTWLGLQWNSLPALPGIRKWLKQLFHHLPQETSRLETNAPESICILDLEVFLLGVVYTSHLQLKEKCNSHHSSYQPLCLPLPVCKRLCTERQKSWWDAVCTLIHRKAVPGNSAELRLVVQHEINTLRAQEKHGLQPALLVHWAKCLQKMGRGLNSSYDQQEYIGRSVHYWKKVLPLLKIIKKNSIPEPIDPLFKHFHSVDIQASEIVEYEEDAHITFAILDAVHGNIEDAVTAFESIKSVVSYWNLALIFHRKAEDIENDAVFPEEQEECKNYLRKTRDYLIKIIDDSDSNLSVVKKLPVPLESVKEMLKSVMQELEDYSEGGPLYKNGSLRNADSEIKHSTPSPTKYSLSPSKSYKYSPKTPPRWAEDQNSLRKMICQEVKAITKLNSSKSASRHRWPTENYGPDSVPDGYQGSQTFHGAPLTVATTGPSVYYSQSPAYNSQYLLRPAANVTPTKGSSNTEFKSTKEGFSIAVSADGFKFGISEPGNQEKKSEKPLENDTGFQAQDISGQKNGRGVIFGQTSSTFTFADVAKSTSGEGFQFGKKDPNFKGFSGAGEKLFSSQCGKMANKANTSGDFEKDDDACKTEDSDDIHFEPVVQMPEKVELVTGEEGEKVLYSQGVKLFRFDAEISQWKERGLGNLKILKNEVNGKPRMLMRRDQVLKVCANHWITTTMNLKPLSGSDRAWMWLASDFSDGDAKLERLAAQFKTPELAEEFKQKFEECQRLLLDIPLQTPHKLVDTGRAAKLIQRAEEMKSGLKDFKTFLTNDQTKVTEEENKGSGTGSAGASDTTIKPNPENTGPTLEWDNYDLREDALDDNVSSSSVHDSPLASSPVRKNIFRFDESTTGFNFSFKSALSLSKSPAKLNQSGTSVGTDEESDVTQEEERDGQYFEPVVPLPDLVEVSSGEENEQVVFSHRAELYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSNPFAFGNSSATGSLFGFSFNAPLKSNDSETSSVAQSGSESKVEPKKCELSKNSDIEHSSDSKVKNLSASFPMEESSINYTFKTPEKEPPLWHAEFTKEELVQKLSSTTKSADQLNGLLRETEATSAVLMEQIKLLKSEIRRLERNQEESAANVEHLKNVLLQFIFLKPGSERESLLPVINTMLQLSPEEKGKLAAVAQGLQETSIPKKK

SEQ ID NO: 56266 - protein, 1756 aa, Homo sapiens
MRRSKAYGERYLASVQGSAPSPGKKLRGFYFAKLYYEAKEYDLAKKYVCTYLSVQERDPRAHRFLGLLYELEENTEKAVECYRRSLELNPPQKDLVLKIAELLCKNDVTDGRAKYWVERAAKLFPGSPAIYKLKEHLLDCEGEDGWNKLFDWIQSELYVRPDDVHMNIRLVELYRSNKRLKDAVARCHEAERNIALRSSLEWNSCVVQTLKEYLESLQCLESDKSDWRATNTDLLLAYANLMLLTLSTRDVQESRELLESFDSALQSAKSSLGGNDELSATFLEMKGHFYMHAGSLLLKMGQHGNNVQWQALSELAALCYVIAFQVPRPKIKLIKGEAGQNLLEMMACDRLSQSGHMLLNLSRGKQDFLKEVVETFANKSGQSVLYNALFSSQSSKDTSFLGSDDIGNIDVQEPELEDLARYDVGAIQAHNGSLQHLTWLGLQWNSLPALPGIRKWLKQLFHHLPQETSRLETNAPESICILDLEVFLLGVVYTSHLQLKEKCNSHHSSYQPLCLPLPVCKRLCTERQKSWWDAVCTLIHRKAVPGNSAELRLVVQHEINTLRAQEKHGLQPALLVHWAKCLQKMGRGLNSSYDQQEYIGRSVHYWKKVLPLLKIIKKNSIPEPIDPLFKHFHSVDIQASEIVEYEEDAHITFAILDAVHGNIEDAVTAFESIKSVVSYWNLALIFHRKAEDIENDAVFPEEQEECKNYLRKTRDYLIKIIDDSDSNLSVVKKLPVPLESVKEMLKSVMQELEDYSEGGPLYKNGSLRNADSEIKHSTPSPTKYSLSPSKSYKYSPKTPPRWAEDQNSLRKMICQEVKAITKLNSSKSASRHRWPTENYGPDSVPDGYQGSQTFHGAPLTVATTGPSVYYSQSPAYNSQYLLRPAANVTPTKGSSNTEFKSTKEGFSIAVSADGFKFGISEPGNQEKKSEKPLENDTGFQAQDISGQKNGRGVIFGQTSSTFTFADVAKSTSGEGFQFGKKDPNFKGFSGAGEKLFSSQCGKMANKANTSGDFEKDDDACKTEDSDDIHFEPVVQMPEKVELVTGEEGEKVLYSQGVKLFRFDAEISQWKERGLGNLKILKNEVNGKPRMLMRRDQVLKVCANHWITTTMNLKPLSGSDRAWMWLASDFSDGDAKLERLAAQFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDNVSSSSVHDSPLASSPVRKNIFRFDESTTGFNFSFKSALSLSKSPAKLNQSGTSVGTDEESDVTQEEERDGQYFEPVVPLPDLVEVSSGEENEQVVFSHMAELYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSNPFAFGNSSATGSLFGFSFNAPLKSNDSETSSVAQSGSESKVEPKKCELSKNSDIEQSSDSKVKNLSASFPMEESSINYTFKTPEKEPPLWHAEFTKEELVQKLSSTTKSADQLNGLLRETEATSAVLMEQIKLLKSEIRRLERNQEESAANVEHLKNVLLQFIFLKPGSERESLLPVINTMLQLSPEEKGKLAAVAQGLQETSIPKKK

SEQ ID NO: 56267 - protein, 1745 aa, Homo sapiens
MGFNTDRLAWTRNKLRGFYFAKLYYEAKEYDLAKKYVCTYLSVQERDPRAHRFLGLLYELEENTEKAVECYRRSLELNPPQKDLVLKIAELLCKNDVTDGRAKYWVERAAKLFPGSPAIYKLKEHLLDCEGEDGWNKLFDWIQSELYVRPDDVHMNIRLVELYRSNKRLKDAVARCHEAERNIALRSSLEWNSCVVQTLKEYLESLQCLESDKSDWRATNTDLLLAYANLMLLTLSTRDVQESRELLESFDSALQSAKSSLGGNDELSATFLEMKGHFYMHAGSLLLKMGQHGNNVQWQALSELAALCYVIAFQVPRPKIKLIKGEAGQNLLEMMACDRLSQSGHMLLNLSRGKQDFLKEVVETFANKSGQSVLYNALFSSQSSKDTSFLGSDDIGNIDVQEPELEDLARYDVGAIQAHNGSLQHLTWLGLQWNSLPALPGIRKWLKQLFHHLPQETSRLETNAPESICILDLEVFLLGVVYTSHLQLKEKCNSHHSSYQPLCLPLPVCKRLCTERQKSWWDAVCTLIHRKAVPGNSAELRLVVQHEINTLRAQEKHGLQPALLVHWAKCLQKMGRGLNSSYDQQEYIGRSVHYWKKVLPLLKIIKKNSIPEPIDPLFKHFHSVDIQASEIVEYEEDAHITFAILDAVHGNIEDAVTAFESIKSVVSYWNLALIFHRKAEDIENDAVFPEEQEECKNYLRKTRDYLIKIIDDSDSNLSVVKKLPVPLESVKEMLKSVMQELEDYSEGGPLYKNGSLRNADSEIKHSTPSPTKYSLSPSKSYKYSPKTPPRWAEDQNSLRKMICQEVKAITKLNSSKSASRHRWPTENYGPDSVPDGYQGSQTFHGAPLTVATTGPSVYYSQSPAYNSQYLLRPAANVTPTKGSSNTEFKSTKEGFSIAVSADGFKFGISEPGNQEKKSEKPLENDTGFQAQDISGQKNGRGVIFGQTSSTFTFADVAKSTSGEGFQFGKKDPNFKGFSGAGEKLFSSQCGKMANKANTSGDFEKDDDACKTEDSDDIHFEPVVQMPEKVELVTGEEGEKVLYSQGVKLFRFDAEISQWKERGLGNLKILKNEVNGKPRMLMRRDQVLKVCANHWITTTMNLKPLSGSDRAWMWLASDFSDGDAKLERLAAQFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDNVSSSSVHDSPLASSPVRKNIFRFDESTTGFNFSFKSALSLSKSPAKLNQSGTSVGTDEESDVTQEEERDGQYFEPVVPLPDLVEVSSGEENEQVVFSHMAELYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSNPFAFGNSSATGSLFGFSFNAPLKSNDSETSSVAQSGSESKVEPKKCELSKNSDIEQSSDSKVKNLSASFPMEESSINYTFKTPEKEPPLWHAEFTKEELVQKLSSTTKSADQLNGLLRETEATSAVLMEQIKLLKSEIRRLERNQEESAANVEHLKNVLLQFIFLKPGSERESLLPVINTMLQLSPEEKGKLAAVAQGLQETSIPKKK

SEQ ID NO: 56268 - protein, 1411 aa, Homo sapiens
MACDRLSQSGHMLLNLSRGKQDFLKEVVETFANKSGQSVLYNALFSSQSSKDTSFLGSDDIGNIDVQEPELEDLARYDVGAIQAHNGSLQHLTWLGLQWNSLPALPGIRKWLKQLFHHLPQETSRLETNAPESICILDLEVFLLGVVYTSHLQLKEKCNSHHSSYQPLCLPLPVCKRLCTERQKSWWDAVCTLIHRKAVPGNSAELRLVVQHEINTLRAQEKHGLQPALLVHWAKCLQKMGRGLNSSYDQQEYIGRSVHYWKKVLPLLKIIKKNSIPEPIDPLFKHFHSVDIQASEIVEYEEDAHITFAILDAVHGNIEDAVTAFESIKSVVSYWNLALIFHRKAEDIENDAVFPEEQEECKNYLRKTRDYLIKIIDDSDSNLSVVKKLPVPLESVKEMLKSVMQELEDYSEGGPLYKNGSLRNADSEIKHSTPSPTKYSLSPSKSYKYSPKTPPRWAEDQNSLRKMICQEVKAITKLNSSKSASRHRWPTENYGPDSVPDGYQGSQTFHGAPLTVATTGPSVYYSQSPAYNSQYLLRPAANVTPTKGSSNTEFKSTKEGFSIAVSADGFKFGISEPGNQEKKSEKPLENDTGFQAQDISGQKNGRGVIFGQTSSTFTFADVAKSTSGEGFQFGKKDPNFKGFSGAGEKLFSSQCGKMANKANTSGDFEKDDDACKTEDSDDIHFEPVVQMPEKVELVTGEEGEKVLYSQGVKLFRFDAEISQWKERGLGNLKILKNEVNGKPRMLMRRDQVLKVCANHWITTTMNLKPLSGSDRAWMWLASDFSDGDAKLERLAAQFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDNVSSSSVHDSPLASSPVRKNIFRFDESTTGFNFSFKSALSLSKSPAKLNQSGTSVGTDEESDVTQEEERDGQYFEPVVPLPDLVEVSSGEENEQVVFSHMAELYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSNPFAFGNSSATGSLFGFSFNAPLKSNDSETSSVAQSGSESKVEPKKCELSKNSDIEQSSDSKVKNLSASFPMEESSINYTFKTPEKEPPLWHAEFTKEELVQKLSSTTKSADQLNGLLRETEATSAVLMEQIKLLKSEIRRLERNQEESAANVEHLKNVLLQFIFLKPGSERESLLPVINTMLQLSPEEKGKLAAVAQGLQETSIPKKK

SEQ ID NO: 56269 - protein, 945 aa, Homo sapiens
MICQEVKAITKLNSSKSASRHRWPTENYGPDSVPDGYQGSQTFHGAPLTVATTGPSVYYSQSPAYNSQYLLRPAANVTPTKGSSNTEFKSTKEGFSIAVSADGFKFGISEPGNQEKKSEKPLENDTGFQAQDISGQKNGRGVIFGQTSSTFTFADVAKSTSGEGFQFGKKDPNFKGFSGAGEKLFSSQCGKMANKANTSGDFEKDDDACKTEDSDDIHFEPVVQMPEKVELVTGEEGEKVLYSQGVKLFRFDAEISQWKERGLGNLKILKNEVNGKPRMLMRRDQVLKVCANHWITTTMNLKPLSGSDRAWMWLASDFSDGDAKLERLAAQFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDNVSSSSVHDSPLASSPVRKNIFRFDESTTGFNFSFKSALSLSKSPAKLNQSGTSVGTDEESDVTQEEERDGQYFEPVVPLPDLVEVSSGEENEQVVFSHMAELYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSNPFAFGNSSATGSLFGFSFNAPLKSNDSETSSVAQSGSESKVEPKKCELSKNSDIEQSSDSKVKNLSASFPMEESSINYTFKTPEKEPPLWHAEFTKEELVQKLSSTTKSADQLNGLLRETEATSAVLMEQIKLLKSEIRRLERNQEESAANVEHLKNVLLQFIFLKPGSERESLLPVINTMLQLSPEEKGKLAAVAQGLQETSIPKKK

SEQ ID NO: 56270 - protein, 1013 aa, Homo sapiens
MLKSVMQELEDYSEGGPLYKNGSLRNADSEIKHSTPSPTKYSLSPSKSYKYSPKTPPRWAEDQNSLRKMICQEVKAITKLNSSKSASRHRWPTENYGPDSVPDGYQGSQTFHGAPLTVATTGPSVYYSQSPAYNSQYLLRPAANVTPTKGSSNTEFKSTKEGFSIAVSADGFKFGISEPGNQEKKSEKPLENDTGFQAQDISGQKNGRGVIFGQTSSTFTFADVAKSTSGEGFQFGKKDPNFKGFSGAGEKLFSSQCGKMANKANTSGDFEKDDDACKTEDSDDIHFEPVVQMPEKVELVTGEEGEKVLYSQGVKLFRFDAEISQWKERGLGNLKILKNEVNGKPRMLMRRDQVLKVCANHWITTTMNLKPLSGSDRAWMWLASDFSDGDAKLERLAAQFKTPELAEEFKQKFEECQRLLLDIPLQTPHKLVDTGRAAKLIQRAEEMKSGLKDFKTFLTNDQTKVTEEENKGSGTGAAGASDTTIKPNPENTGPTLEWDNYDLREDALDDNVSSSSVHDSPLASSPVRKNIFRFDESTTGFNFSFKSALSLSKSPAKLNQSGTSVGTDEESDVTQEEERDGQYFEPVVPLPDLVEVSSGEENEQVVFSHMAELYRYDKDVGQWKERGIGDIKILQNYDNKQVRIVMRRDQVLKLCANHRITPDMSLQNMKGTERVWVWTACDFADGERKVEHLAVRFKLQDVADSFKKIFDEAKTAQEKDSLITPHVSRSSTPRESPCGKIAVAVLEETTRERTDVIQGDDVADAASEVEVSSTSETTTKAVVSPPKFVFGSESVKRIFSSEKSNPFAFGNSSATGSLFGFSFNAPLKSNDSETSSVAQSGSESKVEPKKCELSKNSDIEQSSDSKVKNLSASFPMEESSINYTFKTPEKEPPLWHAEFTKEELVQKLSSTTKSADQLNGLLRETEATSAVLMEQIKLLKSEIRRLERNQEESAANVEHLKNVLLQFIFLKPGSERESLLPVINTMLQLSPEEKGKLAAVAQGLQETSIPKKK

SEQ ID NO: 56271 - protein, 184 aa, Homo sapiens
MPQSKSRKIAILGYRSVGKSSLTIQFVEGQFVDSYDPTIENTFTKLITVNGQEYHLQLVDTAGQDEYSIFPQTYSIDINGYILVYSVTSIKSFEVIKVIHGKLLDMVGKVQIPIMLVGNKKDLHMERVISYEEGKALAESWNAAFLESSAKENQTAVDVFRRIILEAEKMDGAASQGKSSCSVM

SEQ ID NO: 56272 - protein, 232 aa, Homo sapiens
MAGDTEVWKQMFQELMREVKPWHRWTLRPDKGLLPNVLKPGWMQYQQWTFARFQCSSCSRNWASAQVLVLFHMNWSEEKSRGQVKMRVFTQRCKKCPQPLFEDPEFTQENISRILKNLVFRILKKCYRGRFQLIEEVPMIKDISLEGPHNSDNCEACLQGFCAGPIQVTSLPPSQTPRVHSIYKVEEVVKPWASGENVYSYACQNHICRNLSIFCCCVILIVIVVIVVKTAI

SEQ ID NO: 56273 - protein, 122 aa, Homo sapiens
MKLLTGLVFCSLVLSVSSRSFFSFLGEAFDGARDMWRAYSDMREANYIGSDKYFHARGNYDAAKRGPGGAWAAEVISNARENIQRLTGHGAEDSLADQAANKWGRSGRDPNHFRPAGLPEKY

SEQ ID NO: 56274 - protein, 328 aa, Homo sapiens
MMSGEPLHVKTPIRDSMALSKMAGTSVYLKMDSAQPSGSFKIRGIGHFCKRWAKQGCAHFVCSSAGNAGMAAAYAARQLGVPATIVVPSTTPALTIERLKNEGATVKVVGELLDEAFELAKALAKNNPGWVYIPPFDDPLIWEGHASIVKELKETLWEKPGAIALSVGGGGLLCGVVQGLQEVGWGDVPVIAMETFGAHSFHAATTAGKLVSLPKITSVAKALGVKTVGAQALKLFQEHPIFSEVISDQEAVAAIEKFVDDEKILVEPACGAALAAVYSHVIQKLQLEGNLRTPLPSLVVIVCGGSNISLAQLRALKEQLGMTNRLPK

SEQ ID NO: 56275 - protein, 400 aa, Homo sapiens
MSGRVGDLSPKQAETLAKFRENVQDVLPALPNPDDYFLLRWLRARNFDLQKSEALLRKYMEFRKTMDIDHILDWQPPEVIQKYMPGGLCGYDRDGCPVWYDIIGPLDPKGLLFSVTKQDLLKTKMRDCERILHECDLQTERLGKKIETIVMIFDCEGLGLKHFWKPLVEVYQEFFGLLEENYPETLKFMLIVKATKLFPVGYNLMKPFLSEDTRRKIIVLGNNWKEGLLKLISPEELPAQFGGTLTDPDGNPKCLTKINYGGEIPKSMYVRDQVKTQYEHSVQINRGSSHQVEYEILFPGCVLRWQFSSDGADIGFGVFLKTKMGERQRAGEMTDVLPSQRYNAHMVPEDGNLTCSEAGVYVLRFDNTYSFVHAKKVSFTVEVLLPDEGMQKYDKELTPV

SEQ ID NO: 56276 - protein, 444 aa, Homo sapiens
MKVVPSLLLSVLLAQVWLVPGLAPSPQSPETPAPQNQTSRVVQAPKEEEEDEQEASEEKASEEEKAWLMASRQQLAKETSNFGFSLLRKISMRHDGNMVFSPFGMSLAMTGLMLGATGPTETQIKRGLHLQALKPTKPGLLPSLFKGLRETLSRNLELGLTQGSFAFIHKDFDVKETFFNLSKRYFDTECVPMNFRNASQAKRLMNHYINKETRGKIPKLFDEINPETKLILVDYILFKGKWLTPFDPVFTEVDTFHLDKYKTIKVPMMYGAGKFASTFDKNFRCHVLKLPYQGNATMLVVLMEKMGDHLALEDYLTTDLVETWLRNMKTRNMEVFFPKFKLDQKYEMHELLRQMGIRRIFSPFADLSELSATGRNLQVSRVLQRTVIEVDERGTEAVAGILSEITAYSMPPVIKVDRPFHFMIYEETSGMLLFLGRVVNPTLL

SEQ ID NO: 56277 - protein, 422 aa, Homo sapiens
MGPAWLWLLGTGILASVHCQPLLAHGDKSLQGPQPPRHQLSEPAPAYHRITPTITNFALRLYKELAADAPGNIFFSPVSISTTLALLSLGAQANTSALILEGLGFNLTETPEADIHQGFRSLLHTLALPSPKLELKVGNSLFLDKRLKPRQHYLDSIKELYGAFAFSANFTDSVTTGRQINDYLRRQTYGQVVDCLPEFSQDTFMVLANYIFFKAKWKHPFSRYQTQKQESFFVDERTSLQVPMMHQKEMHRFLYDQDLACTVLQIEYRGNALALLVLPDPGKMKQVEAALQPQTLRKWGQLLLPSLLDLHLPRFSISGTYNLEDILPQIGLTNILNLEADFSGVTGQLNKTISKVSHKAMVDMSEKGTEAGAASGLLSQPPSLNTMSDPHAHFNRPFLLLLWEVTTQSLLFLGKVVNPVAG

SEQ ID NO: 56278 - protein, 422 aa, Homo sapiens [sequence omitted]

SEQ ID NO: 56279 - protein, 583 aa, Homo sapiens [sequence omitted]

SEQ ID NO: 56280 - protein, 423 aa, Homo sapiens
MERMLPLLALGLLAAGFCPAVLCHPNSPLDEENLTQENQDRGTHVDLGLASANVDFAFSLYKQLVLKAPDKNVIFSPLSISTALAFLSLGAHNTTLTEILKGLKFNLTETSEAEIHQSFQHLLRTLNQSSDELQLSMGNAMFVKEQLSLLDRFTEDAKRLYGSEAFATDFQDSAAAKKLINDYVKNGTRGKITDLIKDLDSQTMMVLVNYIFFKAKWEMPFDPQDTHQSRFYLSKKKWVMVPMMSLHHLTIPYFRDEELSCTVVELKYTGNASALFILPDQDKMEEVEAMLLPETLKRWRDSLEFREIGELYLPKFSISRDYNLNDILLQLGIEEAFTSKADLSGITGARNLAVSQVVHKAVLDVFEEGTEASAATAVKITLLSALVETRTIVRFNRPFLMIIVPTDTQNIFFMSKVTNPKQA

SEQ ID NO: 56281 - protein, 427 aa, Homo sapiens
MHLIDYLLLLLVGLLALSHGQLHVEHDGESCSNSSHQQILETGEGSPSLKIAPANADFAFRFYYLIASETPGKNIFFSPLSISAAYAMLSLGACSHSRSQILEGLGFNLTELSESDVHRGFQHLLHTLNLPGHGLETRVGSALFLSHNLKFLAKFLNDTMAVYEAKLFHTNFYDTVGTIQLINDHVKKETRGKIVDLVSELKKDVLMVLVNYIYFKALWEKPFISSRTTPKDFYVDENTTVRVPMMLQDQEHHWYLHDRYLPCSVLRMDYKGDATVFFILPNQGKMREIEEVLTPEMLMRWNNLLRKRNFYKKLELHLPKFSISGSYVLDQILPRLGFTDLFSKWADLSGITKQQKLEASKSFHKATLDVDEAGTEAAAATSFAIKFFSAQTNRHILRFNRPFLVVIFSTSTQSVLFLGKVVDPTKP

SEQ ID NO: 56282 - protein, 405 aa, Homo sapiens
MPLLLYTCLLWLPTSGLWTVQAMDPNAAYVNMSNHHRGLASANVDFAFSLYKHLVALSPKKNIFISPVSISMALAMLSLGTCGHTRAQLLQGLGFNLTERSETEIHQGFQHLHQLFAKSDTSLEMTMGNALFLDGSLELLESFSADIKHYYESEVLAMNFQDWATASRQINSYVKNKTQGKIVDLFSGLDSPAILVLVNYIFFKGTWTQPFDLASTREENFYVDETTVVKVPMMLQSSTISYLHDAELPCQLVQMNYVGNGTVFFILPDKGKMNTVIAALSRDTINRWSAGLTSSQVDLYIPKVTISGVYDLGDVLEEMGIADLFTNQANFSRITQDAQLKSSKVVHKAVLQLNEEGVDTAGSTGVTLNLTSKPIILRFNQPFIIMIFDHFTWSSLFLARVMNPV

SEQ ID NO: 56283 - protein, 415 aa, Homo sapiens
MSPFLYLVLLVLGLHATIHCASPEGKVTACHSSQPNATLYKMSSINADFAFNLYRRFTVETPDKNIFFSPVSISAALVMLSFGACCSTQTEIVETLGFNLTDTPMVEIQHGFQHLICSLNFPKKELELQIGNALFIGKHLKPLAKFLNDVKTLYETEVFSTDFSNISAAKQEINSHVEMQTKGKVVGLIQDLKPNTTMVLVNYIHFKAQWANPFDPSKTEDSSSFLIDKTTTVQVPMMHQMEQYYHLVDMELNCTVLQMDYSKNALALFVLPKEGQMESVEAAMSSKTLKKWNRLLQKGWVDLFVPKFSISATYDLGATLLKMGIQHAYSENADFSGLTEDNGLKLSNAAHKAVLHIGEKGTEAAAVPEVELSDQPENTFLHPIIQIDRSFMLLILERSTRSILFLGKVVNPTEA

SEQ ID NO: 56284 - protein, 464 aa, Homo sapiens
MYSNVIGTVTSGKRKVYLLSLLLIGFWDCVTCHGSPVDICTAKPRDIPMNPMCIYRSPEKKATEDEGSEQKIPEATNRRVWELSKANSRFATTFYQHLADSKNDNDNIFLSPLSISTAFAMTKLGACNDTLQQLMEVFKFDTISEKTSDQIHFFFAKLNCRLYRKANKSSKLVSANRLFGDKSLTFNETYQDISELVYGAKLQPLDFKENAEQSRAAINKWVSNKTEGRITDVIPSEAINELTVLVLVNTIYFKGLWKSKFSPENTRKELFYKADGESCSASMMYQEGKFRYRRVAEGTQVLELPFKGDDITMVLILPKPEKSLAKVEKELTPEVLQEWLDELEEMMLVVHMPRFRIEDGFSLKEQLQDMGLVDLFSPEKSKLPGIVAEGRDDLYVSDAFHKAFLEVNEEGSEAAASTAVVIAGRSLNPNRVTFKANRPFLVFIREVPLNTIIFMGRVANPCVK

SEQ ID NO: 56285 - protein, 499 aa, Homo sapiens
MKHSLNALLIFLIITSAWGGSKGPLDQLEKGGETAQSADPQWEQLNNKNLSMPLLPADFHKENTVTNDWIPEGEEDDDYLDLEKIFSEDDDYIDIVDSLSVSPTDSDVSAGNILQLFHGKSRIQRLNILNAKFAFNLYRVLKDQVNTFDNIFIAPVGISTAMGMISLGLKGETHEQVHSILHFKDFVNASSKYEITTIHNLFRKLTHRLFRRNFGYTLRSVNDLYIQKQFPILLDFKTKVREYYFAEAQIADFSDPAFISKTNNHIMKLTKGLIKDALENIDPATQMMILNCIYFKGSWVNKFPVEMTHNHNFRLNEREVVKVSMMQTKGNFLAANDQELDCDILQLEYVGGISMLIVVPHKMSGMKTLEAQLTPRVVERWQKSMTNRTREVLLPKFKLEKNYNLVESLKLMGIRMLFDKNGNMAGISDQRIAIDLFKHQGTITVNEEGTQATTVTTVGFMPLSTQVRFTVDRPFLFLIYEHRTSCLLFMGRVANPSRS

SEQ ID NO: 56286 - protein, 349 aa, Homo sapiens
MEAHNASAPFNFTLPPNFGKRPTDLALSVILVFMLFFIMLSLGCTMEFSKIKAHLWKPKGLAIALVAQYGIMPLTAFVLGKVFRLKNIEALAILVCGCSPGGNLSNVFSLAMKGDMNLSIVMTTCSTFCALGMMPLLLYIYSRGIYDGDLKDKVPYKGIVISLVLVLIPCTIGIVLKSKRPQYMRYVIKGGMIIILLCSVAVTVLSAINVGKSIMFAMTPLLIATSSLMPFIGFLLGYVLSALFCLNGRCRRTVSMETGCQNVQLCSTILNVAFPPEVIGPLFFFPLLYMIFQLGEGLLLIAIFWCYEKFKTPKDKTKMIYTAATTEETIPGALGNGTYKGEDCSPCTA

SEQ ID NO: 56287 - protein, 568 aa, Homo sapiens [sequence omitted]

SEQ ID NO: 56288 - protein, 467 aa, Homo sapiens
MQMDNRLPPKKVPGFCSFRYGLSFLVHCCNVIITAQRACLNLTMVVMVNSTDPHGLPNTSTKKLLDNIKNPMYNWSPDIQGIILSSTSYGVIIIQVPVGYFSGIYSTKKMIGFALCLSSVLSLLIPPAAGIGVAWVVVCRAVQGAAQGIVATAQFEIYVKWAPPLERGRLTSMSTSGFLLGPFIVLLVTGVICESLGWPMVFYIFGACGCAVCLLWFVLFYDDPKDHPCISISEKEYITSSLVQQVSSSRQSLPIKAILKSLPVWAISIGSFTFFWSHNIMTLYTPMFINSMLHVNIKENGFLSSLPYLFAWICGNLAGQLSDFFLTRNILSVIAVRKLFTAAGFLLPAIFGVCLPYLSSTFYSIVIFLILAGATGSFCLGGVFINGLDIAPRYFGFIKACSTLTGMIGGLIASTLTGLILKQDPESAWFKTFILMAAINVTGLIFYLIVATAEIQDWAKEKQHTRL

SEQ ID NO: 56289 - protein, 436 aa, Homo sapiens
MDGKPATRKGPDFCSLRYGLALIMHFSNFTMITQRVSLSIAIIAMVNTTQQQGLSNASTEGPVADAFNNSSISIKEFDTKASVYQWSPETQGIIFSSINYGIILTLIPSGYLAGIFGAKKMLGAGLLISSLLTLFTPLAADFGVILVIMVRTVQGMAQGMAWTGQFTIWAKWAPPLERSKLTTIAGSGSAFGSFIILCVGGLISQALSWPFIFYIFGSTGCVCCLLWFTVIYDDPMHHPCISVREKEHILSSLAQQPSSPGRAVPIKAMVTCLPLWAIFLGFFSHFWLCTIILTYLPTYISTLLHVNIRDSGVLSSLPFIAAASCTILGGQLADFLLSRNLLRLITVRKLFSSLDMQVSSWESQGDLGSSQESSLPLPLDSSSVRILSLVGGMSFSCLLQSTCLAWSFTSRLDKQNFKTGPKRGPLPASEDIKLQT

SEQ ID NO: 56290 - protein, 497 aa, Homo sapiens
MSTGPDVKATVGDISSDGNLNVAQEECSRKGFCSVRHGLALILQLCNFSIYTQQMNLSIAIPAMVNNTAPPSQPNASTERPSTDSQGYWNETLKEFKAMAPAYDWSPEIQGIILSSLNYGSFLAPIPSGYVAGIFGAKYVVGAGLFISSFLTLFIPLAANAGVALLIVLRIVQGIAQVMVLTGQYSIWVKWAPPLERSQLTTIAGSGSMLGSFIVLLAGGLLCQTIGWPYVFYIFGGIGCACCPLWFPLIYDDPVNHPFISAGEKRYIVCSLAQQDCSPGWSLPIRAMIKSLPLWAILVSYFCEYWLFYTIMAYTPTYISSVLQANLRDSGILSALPFVVGCICIILGGLLADFLLSRKILRLITIRKLFTAIGVLFPSVILVSLPWVRSSHSMTMTFLVLSSAISSFCESGALVNFLDIAPRYTGFLKGLLQVFAHIAGAISPTAAGFFISQDSEFGWRNVFLLSAAVNISGLVFYLIFGRADVQDWAKEQTFTHL

SEQ ID NO: 56291 - protein, 554 aa, Homo sapiens
MPTVDDILEQVGESGWFQKQAFLILCLLSAAFAPICVGIVFLGFTPDHHCQSPGVAELSQRCGWSPAEELNYTVPGLGPAGEAFLGQCRRYEVDWNQSALSCVDPLASLATNRSHLPLGPCQDGWVYDTPGSSIVTEFNLVCADSWKLDLFQSCLNAGFLFGSLGVGYFADRFGRKLCLLGTVLVNAVSGVLMAFSPNYMSMLLFRLLQGLVSKGNWMAGYTLITEFVGSGSRRTVAIMYQMAFTVGLVALTGLAYALPHWRWLQLAVSLPTFLFLLYYWCVPESPRWLLSQKRNTEAIKIMDHIAQKNGKLPPADLKMLSLEEDVTEKLSPSFADLFRTPRLRKRTFILMYLWFTDSVLYQGLILHMGATSGNLYLDFLYSALVEIPGAFIALITIDRVGRIYPMAMSNLLAGAACLVMIFISPDLHWLNIIIMCVGRMGITIAIQMICLVNAELYPTFVRNLGVMVCSSLCDIGGIITPFIVFRLREVWQALPLILFAVLGLLAAGVTLLLPETKGVALPETMKDAENLGRKAKPKENTIYLKVQTSEPSGT

SEQ ID NO: 56292 - protein, 506 aa, Homo sapiens
MPTVDDILEQVGESGWFQKQAFLILCLLSAAFAPICVGIVFLGFTPDHHCQSPGVAELSQRCGWSPAEELNYTVPGLGPAGEAFLGQCRRYEVDWNQSALSCVDPLASLATNRSHLPLGPCQDGWVYDTPGSSIVTEFNLVCADSWKLDLFQSCLNAGFLFGSLGVGYFADRFGRKLCLLGTVLVNAVSGVLMAFSPNYMSMLLFRLLQGLVSKGNWMAGYTLITEFVGSGSRRTVAIMYQMAFTVGLVALTGLAYALPHWRWLQLAVSLPTFLFLLYYWCVPESPRWLLSQKRNTEAIKIMDHIAQKNGKLPPADLKMLSLEEDVTEKLSPSFADLFRTPRLRKRTFILMYLWFTDSVLYQGLILHMGATSGNLYLDFLYSALVEIPGAFIALITIDRVGRIYPMAMSNLLAGAACLVMIFISPDLHWLNIIIMCVGRMGITIAIQMICLVNAELYPTFVSGVGPACRGSDATSSRDQGGRFARDHEGRREPWEKSKAQRKHDLP

SEQ ID NO: 56293 - protein, 546 aa, Homo sapiens
MGFEELLEQVGGFGPFQLRNVALLALPRVLLPLHFLLPIFLAAVPAHRCALPGAPANFSHQDVWLEAHLPREPDGTLSSCLRFAYPQALPNTTLGEERQSRGELEDEPATVPCSQGWEYDHSEFSSTIATEWDLVCEQKGLNRAASTFFFAGVLVGAVAFGYLSDRFGRRRLLLVAYVSTLVLGLASAASVSYVMFAITRTLTGSALAGFTIIVMPLELEWLDVEHRTVAGVLSSTFWTGGVMLLALVGYLIRDWRWLLLAVTLPCAPGILSLWWVPESARWLLTQGHVKEAHRYLLHCARLNGRPVCEDSFSQEAVSKVAAGERVVRRPSYLDLFRTPRLRHISLCCVVVWFGVNFSYYGLSLDVSGLGLNVYQTQLLFGAVELPSKLLVYLSVRYAGRRLTQAGTLLGTALAFGTRLLVSSDMKSWSTVLAVMGKAFSEAAFTTAYLFTSELYPTVLRQTGMGLTALVGRLGGSLAPLAALLDGVWLSLPKLTYGGIALLAAGTALLLPETRQAQLPETIQDVERKSAPTSLQEEEMPMKQVQN

SEQ ID NO: 56294 - protein, 235 aa, Homo sapiens
MGFEELLEQVGGFGPFQLRNVALLALPRVLLPLHFLLPIFLAAVPAHRCALPGAPANFSHQDVWLEAHLPREPDGTLSSCLRFAYPQALPNTTLGEERQSRGELEDEPATVPCSQGWEYDHSEFSSTIATESQVGIYIIHLEVECRWRQSPWEAAGRGLPWEEAEAAGLGRDKVSYSPSWRESLGGLLSGMEVPEWQSSPQKAPGSGEEELVPAGEGLMFIGGPFLPVLAVGSGV

SEQ ID NO: 56295 - protein, 553 aa, Homo sapiens
MAFQDLLGHAGDLWRFQILQTVFLSIFAVATYLHFMLENFTAFIPGHRCWVHILDNDTVSDNDTGALSQDALLRISIPLDSNMRPEKCRRFVHPQWQLLHLNGTFPNTSDADMEPCVDGWVYDRISFSSTIVTEWDLVCDSQSLTSVAKFVFMAGMMVGGILGGHLSDRFGRRFVLRWCYLQVAIVGTCAALAPTFLIYCSLRFLSGIAAMSLITNTIMLIAEWATHRFQAMGITLGMCPSGIAFMTLAGLAFAIRDWHILQLVVSVPYFVIFLTSSWLLESARWLIINNKPEEGLKELRKAAHRSGMKNARDTLTLEILKSTMKKELEAAQKKKPSLCEMLHMPNICKRISLLSFTRFANFMAYFGLNLHVQHLGNNVFLLQTLFGAVILLANCVAPWALKYMNRRASQMLLMFLLAICLLAIIFVPQEMQTLREVLATLGLGASALANTLAFAHGNEVIPTIIRARAMGINATFANIAGALAPLMMILSVYSPPLPWIIYGVFPFISGFAFLLLPETRNKPLFDTIQDEKNERKDPREPKQEDPRVEVTQF

SEQ ID NO: 56296 - protein, 701 aa, Homo sapiens
MDESPEPLQQGRGPVPVRRQRPAPRGLREMLKARLWCSCSCSVLCVRALVQDLLPATRWLRQYRPREYLAGDVMSGLVIGIILVPQAIAYSLLAGLQPIYSLYTSFFANLIYFLMGTSRHVSVGIFSLLCLMVGQVVDRELQLAGFDPSQDGLQPGANSSTLNGSAAMLDCGRDCYAIRVATALTLMTGLYQVLMGVLRLGFVSAYLSQPLLDGFAMGASVTILTSQLKHLLGVRIPRHQGPGMVVLTWLSLLRGAGQANVCDVVTSTVCLAVLLAAKELSDRYRHRLRVPLPTELLVIVVATLVSHFGQLHKRFGSSVAGDIPTGFMPPQVPEPRLMQRVALDAVALALVAAAFSISLAEMFARSHGYSVRANQELLAVGCCNVLPAFLHCFATSAALAKSLVKTATGCRTQLSSVVSATVVLLVLLALAPLFHDLQRSVLACVIVVSLRGALRKVWDLPRLWRMSPADALVWAGTAATCMLVSTEAGLLAGVILSLLSLAGRTQRPRTALLARIGDTAFYEDATEFEGLVPEPGVRVFRFGGPLYYANKDFFLQSLYSLTGLDAGCMAARRKEGGSETGVGEGGPAQGEDLGPVSTRAALVPAAAGFHTVVIDCAPLLFLDAAGVSTLQDLRRDYGALGISLLLACCSPPVRDILSRGGFLGEGPGDTAEEEQLFLSVHDAVQTARARHRELEATDAHL

SEQ ID NO: 56297 - protein, 701 aa, Homo sapiens; identical to SEQ ID NO: 56296

SEQ ID NO: 56298 - protein, 620 aa, Homo sapiens
MLSAIYTVLAGLLFLPLLVNLCCPYFFQDIGYFLKVAAVGRRVRSYGQRRPARTILRAFLEKARQTPHKPFLLFRDETLTYAQVDRRSNQVARALHDHLGLRQGDCVALLMGNEPAYVWLWLGLVKLGCAMACLNYNIRAKSLLHCFQCCGAKVLLVSPELQAAVEEILPSLKKDDVSIYYVSRTSNTDGIDSFLDKVDEVSTEPIPESWRSEVTFSTPALYIYTSGTTGLPKAAMITHQRIWYGTGLTFVSGLKADDVIYITLPFYHSAALLIGIHGCIVAGATLALRTKFSASQFWDDCRKYNVTVIQYIGELLRYLCNSPQKPNDRDHKVRLALGNGLRGDVWRQFVKRFGDICIYEFYAATEGNIGFMNYARKVGAVGRVNYLQKKIITYDLIKYDVEKDEPVRDENGYCVRVPKGEVGLLVCKITQLTPFNGYAGAKAQTEKKKLRDVFKKGDLYFNSGDLLMVDHENFIYFHDRVGDTFRWKGENVATTEVADTVGLVDFVQEVNVYGVHVPDHEGRIGMASIKMKENHEFDGKKLFQHIADYLPSYARPRFLRIQDTIEITGTFKHRKMTLVEEGFNPAVIKDALYFLDDTAKMYVPMTEDIYNAISAKTLKL

SEQ ID NO: 56299 - protein, 691 aa, Homo sapiens
MDQNQHLNKTAEAQPSENKKTRYCNGLKMFLAALSLSFIAKTLGAIIMKSSIIHIERRFEISSSLVGFIDGSFEIGNLLVIVFVSYFGSKLHRPKLIGIGCFIMGIGGVLTALPHFFMGYYRYSKETNIDSSENSTSTLSTCLINQILSLNRASPEIVGKGCLKESGSYMWIYVFMGNMLRGIGETPIVPLGLSYIDDFAKEGHSSLYLGILNAIAMIGPIIGFTLGSLFSKMYVDIGYVDLSTIRITPTDSRWVGAWWLNFLVSGLFSIISSIPFFFLPQTPNKPQKERKASLSLHVLETNDEKDQTANLTNQGKNITKNVTGFFQSFKSILTNPLYVMFVLLTLLQVSSYIGAFTYVFKYVEQQYGQPSSKANILLGVITIPIFASGMFLGGYIIKKFKLNTVGIAKFSCFTAVMSLSFYLLYFFILCENKSVAGLTMTYDGNNPVTSHRDVPLSYCNSDCNCDESQWEPVCGNNGITYISPCLAGCKSSSGNKKPIVFYNCSCLEVTGLQNRNYSAHLGECPRDDACTRKFYFFVAIQVLNLFFSALGGTSHVMLIVKIVQPELKSLALGFHSMVIRALGGILAPIYFGALIDTTCIKWSTNNCGTRGSCRTYNSTSFSRVYLGLSSMLRVSSLVLYIILIYAMKKKYQEKDINASENGSVMDEANLESLNKNKHFVPSAGADSETHC

SEQ ID NO: 56300 - protein, 211 aa, Homo sapiens
MISRMEKMTMMMKILIMFALGMNYWSCSGFPVYDYDPSSLRDALSASVVKVNSQSLSPYLFRAFRSSLKRVEVLDENNLVMNLEFSIRETTCRKDSGEDPATCAFQRDYYVSTAVCRSTVKVSAQQVQGVHARCSWSSSTSESYSSEEMIFGDMLGSHKWRNNYLFGLISDESISEQFYDRSLGIMRRVLPPGNRRYPNHRHRARINTDFE

SEQ ID NO: 56301 - protein, 254 aa, Homo sapiens
MQVQCQQSPVLAGSATLVALGALALYVAKPSGYGKHTESLKPAATRLPARAAWFLQELPSFAVPAGILARQPLSLFGPPGTVLLGLFCLHYFHRTFVYSLLNRGRPYPAILILRGTAFCTGNGVLQGYYLIYCAEYPDGWYTDIRFSLGVFLFILGMGINIHSDYILRQLRKPGEISYRIPQGGLFTYVSGANFLGEIIEWIGYALATWSLPALAFAFFSLCFLGLRAFHHHRFYLKMFEDYPKSRKALIPFIF

SEQ ID NO: 56302 - protein, 406 aa, Homo sapiens
MSGCPFLGNNFGYTFKKLPVEGSEEDKSQTGVNRASKGGLIYGNYLHLEKVLNAQELQSETKGNKIHDEHLFIITHQAYELWFKQILWELDSVREIFQNGHVRDERNMLKVVSRMHRVSVILKLLVQQFSILETMTALDFNDFREYLSPASGFQSLQFRLLENKIGVLQNMRVPYNRRHYRDNFKGEENELLLKSEQEKTLLELVEAWLERTPGLEPHGFNFWGKLEKNITRGLEEEFIRIQAKEESEEKEEQVAEFQKQKEVLLSLFDEKRHEHLLSKGERRLSYRALQGALMIYFYREEPRFQVPFQLLTSLMDIDSLMTKWRYNHVCMVHRMLGSKAGTGGSSGYHYLRSTVSDRYKVFVDLFNLSTYLIPRHWIPKMNPTIHKFLYTAEYCDSSYFSSDESD

SEQ ID NO: 56303 - protein, 197 aa, Homo sapiens
MCTGKCARCVGLSLITLCLVCIVANALLLVPNGETSWTNTNHLSLQVWLMGGFIGGGLMVLCPGIAAVRAGGKGCCGAGCCGNRCRMLRSVFSSAFGVLGAIYCLSVSGAGLRNGPRCLMNGEWGYHFEDTAGAYLLNRTLWDRCEAPPRVVPWNVTLFSLLVAASCLEIVLCGIQLVNATIGVFCGDCRKKQDTPH

SEQ ID NO: 56304 - protein, 811 aa, Homo sapiens
MLLLFHSKRMPVAEAPQVAGGQGDGGDGEEAEPEGMFKACEDSKRKARGYLRLVPLFVLLALLVLASAGVLLWYFLGYKAEVMVSQVYSGSLRVLNRHFSQDLTRRESSAFRSETAKAQKMLKELITSTRLGTYYNSSSVYSFGEGPLTCFFWFILQIPEHRRLMLSPEVVQALLVEELLSTVNSSAAVPYRAEYEVDPEGLVILEASVKDIAALNSTLGCYRYSYVGQGQVLRLKGPDHLASSCLWHLQGPKDLMLKLRLEWTLAECRDRLAMYDVAGPLEKRLITSVYGCSRQEPVVEVLASGAIMAVVWKKGLHSYYDPFVLSVQPVVFQACEVNLTLDNRLDSQGVLSTPYFPSYYSPQTHCSWHLTVPSLDYGLALWFDAYALRRQKYDLPCTQGQWTIQNRRLCGLRILQPYAERIPVVATAGITINFTSQISLTGPGVRVHYGLYNQSDPCPGEFLCSVNGLCVPACDGVKDCPNGLDERNCVCRATFQCKEDSTCISLPKVCDGQPDCLNGSDEEQCQEGVPCGTFTFQCEDRSCVKKPNPQCDGRPDCRDGSDEEHCDCGLQGPSSRIVGGAVSSEGEWPWQASLQVRGRHICGGALIADRWVITAAHCFQEDSMASTVLWTVFLGKVWQNSRWPGEVSFKVSRLLLHPYHEEDSHDYDVALLQLDHPVVRSAAVRPVCLPARSHFFEPGLHCWITGWGALREGGPISNALQKVDVQLIPQDLCSEVYRYQVTPRMLCAGYRKGKKDACQGDSGGPLVCKALSGRWFLAGLVSWGLGCGRPNYFGVYTRITGVISWIQQVVT

SEQ ID NO: 56305 - protein, 278 aa, Homo sapiens
MAEARSQPSAGPQLNALPDHSPLLQPGLAALRRRAREAGVPLAPLPLTDSFLLRFLRARDFDLDLAWRLLKNYYKWRAECPEISADLHPRSIIGLLKAGYHGVLRSRDPTGSKVLIYRIAHWDPKVFTAYDVFRVSLITSELIVQEVETQRNGIKAIFDLEGWQFSHAFQITPSVAKKIAAVLTDSFPLKVRGIHLINEPVIFHAVFSMIKPFLTEKIKERIHMHGNNYKQSLLQHFPDILPLEYGGEEFSMEDICQEWTNFIMKSEDYLSSISESIQ

SEQ ID NO: 56306 - protein, 165 aa, Homo sapiens
MAPNASCLCVHVRSEEWDLMTFDANPYDSVKKIKEHVRSKTKVPVQDQVLLLGSKILKPRRSLSSYGIDKEKTIHLTLKVVKPSDEELPLFLVESGDEAKRHLLQVRRSSSVAQVKAMIETKTGIIPETQIVTCNGKRLEDGKMMADYGIRKGNLLFLASYCIGG

SEQ ID NO: 56307 - protein, 533 aa, Homo sapiens
MAVESQGGRPLVLGLLLCVLGPVVSHAGKILLIPVDGSHWLSMLGAIQQLQQRGHEIVVLAPDASLYIRDGAFYTLKTYPVPFQREDVKESFVSLGHNVFENDSFLQRVIKTYKKIKKDSAMLLSGCSHLLHNKELMASLAESSFDVMLTDPFLPCSPIVAQYLSLPTVFFLHALPCSLEFEATQCPNPFSYVPRPLSSHSDHMTFLQRVKNMLIAFSQNFLCDVVYSPYATLASEFLQREVTVQDLLSSASVWLFRSDFVKDYPRPIMPNMVFVGGINCLHQNPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 56308 - protein, 530 aa, Homo sapiens
MARAGWTSPVPLCVCLLLTCGFAEAGKLLVVPMDGSHWFTMQSVVEKLILRGHEVVVVMPEVSWQLERSLNCTVKTYSTSYTLEDQNREFMVFAHAQWKAQAQSIFSLLMSSSSGFLDLFFSHCRSLFNDRKLVEYLKESSFDAVFLDPFDTCGLIVAKYFSLPSVVFTRGIFCHHLEEGAQCPAPLSYVPNDLLGFSDAMTFKERVWNHIVHLEDHLFCQYLFRNALEIASEILQTPVTAYDLYSHTSIWLLRTDFVLDYPKPVMPNMIFIGGINCHQGKPLPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 56309 - protein, 534 aa, Homo sapiens
MATGLQVPLPWLATGLLLLLSVQPWAESGKVLVVPIDGSHWLSMREVLRELHARGHQAVVLTPEVNMHIKEENFFTLTTYAISWTQDEFDRHVLGHTQLYFETEHFLKKFFRSMAMLNNMSLVYHRSCVELLHNEALIRHLNATSFDVVLTDPVNLCAAVLAKYLSIPTVFFLRNIPCDLDFKGTQCPNPSSYIPRLLTTNSDHMTFMQRVKNMLYPLALSYICHAFSAPYASLASELFQREVSVVDILSHASVWLFRGDFVMDYPRPIMPNMVFIGGINCANRKPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 56310 - protein, 534 aa, Homo sapiens
MARGLQVPLPRLATGLLLLLSVQPWAESGKVLVVPTDGSPWLSMREALRELHARGHQAVVLTPEVNMHIKEEKFFTLTAYAVPWTQKEFDRVTLGYTQGFFETEHLLKRYSRSMAIMNNVSLALHRCCVELLHNEALIRHLNATSFDVVLTDPVNLCGAVLAKYLSIPAVFFWRYIPCDLDFKGTQCPNPSSYIPKLLTTNSDHMTFLQRVKNMLYPLALSYICHTFSAPYASLASELFQREVSVVDLVSYASVWLFRGDFVMDYPRPIMPNMVFIGGINCANGKPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 56311 - protein, 534 aa, Homo sapiens
MATGLQVPLPQLATGLLLLLSVQPWAESGKVLVVPTDGSHWLSMREALRDLHARGHQVVVLTLEVNMYIKEENFFTLTTYAISWTQDEFDRLLLGHTQSFFETEHLLMKFSRRMAIMNNMSLIIHRSCVELLHNEALIRHLHATSFDVVLTDPFHLCAAVLAKYLSIPAVFFLRNIPCDLDFKGTQCPNPSSYIPRLLTTNSDHMTFLQRVKNMLYPLALSYLCHAVSAPYASLASELFQREVSVVDLVSHASVWLFRGDFVMDYPRPIMPNMVFIGGINCANGKPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 56312 - protein, 532 aa, Homo sapiens
MACLLRSFQRISAGVFFLALWGMVVGDKLLVVPQDGSHWLSMKDIVEVLSDRGHEIVVVVPEVNLLLKESKYYTRKIYPVPYDQEELKNRYQSFGNNHFAERSFLTAPQTEYRNNMIVIGLYFINCQSLLQDRDTLNFFKESKFDALFTDPALPCGVILAEYLGLPSVYLFRGFPCSLEHTFSRSPDPVSYIPRCYTKFSDHMTFSQRVANFLVNLLEPYLFYCLFSKYEELASAVLKRDVDIITLYQKVSVWLLRYDFVLEYPRPVMPNMVFIGGINCKKRKDLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 56313 - protein, 265 aa, Homo sapiens
MPNMVFIGGINCKKRKDLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 56314 - protein, 530 aa, Homo sapiens
MARAGWTGLLPLYVCLLLTCGFAKAGKLLVVPMDGSHWFTMQSVVEKLILRGHEVVVVMPEVSWQLGRSLNCTVKTYSTSYTLEDQDREFMVFADARWTAPLRSAFSLLTSSSNGIFDLFFSNCRSLFNDRKLVEYLKESCFDAVFLDPFDACGLIVAKYFSLPSVVFARGIFCHYLEEGAQCPAPLSYVPRLLLGFSDAMTFKERVWNHIMHLEEHLFCPYFFKNVLEIASEILQTPVTAYDLYSHTSIWLLRTDFVLEYPKPVMPNMIFIGGINCHQGKPVPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 56315 - protein, 530 aa, Homo sapiens
MARTGWTSPIPLCVSLLLTCGFAEAGKLLVVPMDGSHWFTMQSVVEKLILRGHEVVVVMPEVSWQLGKSLNCTVKTYSTSYTLEDLDREFMDFADAQWKAQVRSLFSLFLSSSNGFFNLFFSHCRSLFNDRKLVEYLKESSFDAVFLDPFDACGLIVAKYFSLPSVVFARGIACHYLEEGAQCPAPLSYVPRILLGFSDAMTFKERVRNHIMHLEEHLFCQYFSKNALEIASEILQTPVTAYDLYSHTSIWLLRTDFVLDYPKPVMPNMIFIGGINCHQGKPLPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 56316 - protein, 530 aa, Homo sapiens
MACTGWTSPLPLCVCLLLTCGFAEAGKLLVVPMDGSHWFTMRSVVEKLILRGHEVVVVMPEVSWQLGRSLNCTVKTYSTSYTLEDLDREFKAFAHAQWKAQVRSIYSLLMGSYNDIFDLFFSNCRSLFKDKKLVEYLKESSFDAVFLDPFDNCGLIVAKYFSLPSVVFARGILCHYLEEGAQCPAPLSYVPRILLGFSDAMTFKERVRNHIMHLEEHLLCHRFFKNALEIASEILQTPVTEYDLYSHTSIWLLRTDFVLDYPKPVMPNMIFIGGINCHQGKPLPMEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 56317 - protein, 529 aa, Homo sapiens
MTLKWTSVLLLIHLSCYFSSGSCGKVLVWAAEYSHWMNMKTILKELVQRGHEVTVLASSASILFDPNDASTLKFEVYPTSLTKTEFENIIMQQVKRWSDIRKDSFWLYFSQEQEILWELYDIFRNFCKDVVSNKKVMKKLQESRFDIVFADAVFPCGELLAALLNIRFVYSLRFTPGYTIERHSGGLIFPPSYIPIVMSKLSDQMTFMERVKNMIYVLYFDFWFQMSDMKKWDQFYSEVLGRPTTLFETMGKADIWLMRNSWSFQFPHPFLPNVDFVGGFHCKPAKPLPKEMEEFVQSSGENGVVVFSLGSVISNMTAERANVIATALAKIPQKVLWRFDGNKPDALGLNTRLYKWIPQNDLLGHPKTRAFITHGGANGIYEAIYHGIPMVGIPLFFDQPDNIAHMKAKGAAVRLDFNTMSSTDLLNALKTVINDPLYKENIMKLSRIQHDQPVKPLDRAVFWIEFVMPHKGAKHLRVAAHDLTWFQYHSLDVIGFLLACVATVIFIITKFCLFCFWKFARKGKKGKRD

SEQ ID NO: 56318 - protein, 529 aa, Homo sapiens
MALKWTSVLLLIHLGCYFSSGSCGKVLVWTGEYSHWMNMKTILKELVQRGHEVTVLASSASILFDPNDAFTLKLEVYPTSLTKTEFENIIMQQVKRWSDIQKDSFWLYFSQEQEILWEFHDIFRNFCKDVVSNKKVMKKLQESRFDIIFADAFFPCGELLAALLNIPFVYSLCFTPGYTIERHSGGLIFPPSYIPVVMSKLSDQMTFMERVKNMIYVLYFDFWFQMCDMKKWDQFYSEVLGRPTTLFETMGKADIWLMRNSWSFQFPHPFLPNIDFVGGLHCKPAKPLPKEMEEFVQSSGENGVVVFSLGSVISNMTAERANVIATALAKIPQKVLWRFDGNKPDALGLNTRLYKWIPQNDLLGLPKTRAFITHGGANGIYEAIYHGIPMVGIPLFWDQPDNIAHMKAKGAAVRLDFHTMSSTDLLNALKTVINDPSYKENVMKLSIIQHDQPVKPLHRAVFWIEFVMCHKGAKHLRVAARDLTWFQYHSLDVIGFLLACVATVIFVVTKFCLFCFWKFARKGKKGKRD

SEQ ID NO: 56319 - protein, 676 aa, Homo sapiens
MSSLQALCSGLPLRPLPENRGRQAGVPHAPVRTPSLSPVEKQLALRNALRYFPPDVQELLAPEFAQELQLYGHIYMYRFCPDIEMRAYPIEQYPCQTKVAAAIMHMIMNNLDPAVAQFPQELVTYGGNGQVFSNWAQFWLTMFYLSKMTEEQTLVMYSGHPLGLFPSSRSAPRLVITNGMVIPNYSSRTEYEKLFALGVTMYGQMTAGSYCYIGPQGIVHGTVLTVLNAARRYLGIEDLAGKVFVTSGLGGMSGAQAKAAVIVGCIGVIAEVDKAALEKRHRQGWLMEVTDSLDRCIQRLREARKKKEVLSLGYHGNVVALWERLVHELDTTGECLVDLGSDQTSCHNPFNGGYYPVQLSFTEAQSLMASNPAVFKDLVQESLRRQVSAINRLAEEKFFFWDYGNAFLLEAQRAGADVEKKGAGRTEFRYPSYVQHIMGDIFSQGFGPFRWVCTSGDPQDLAVTDELATSVLEEAIADGVKVSVKLQYMDNIRWIREAARHRLVVGSQARILYSDQKGRVAIAVAINQAIACRRIKAPVVLSRDHHDVSGTDSPFRETSNIYDGSAFCADMAVQNFVGDACRGATWVALHNGGGVGWGEVINGGFGLVLDGTPEAEGRARLMLSWDVSNGVARRCWSGNQKAYEIICQTMQENSTLVVTLPHKVEDERVLQQALQL

SEQ ID NO: 56320 - DNA, 20 bp, Homo sapiens
gatcagctcgaggttcgccg

SEQ ID NO: 56321 - DNA, 20 bp, Homo sapiens
gatcgcatcttctttcacct

SEQ ID NO: 56322 - DNA, 20 bp, Homo sapiens
gatcttcgtggggccccagc

SEQ ID NO: 56323 - DNA, 20 bp, Homo sapiens
gatcatattgacaggtgatg

SEQ ID NO: 56324 - DNA, 20 bp, Homo sapiens
gatcccaacagttgtcaaat

SEQ ID NO: 56325 - DNA, 20 bp, Homo sapiens
gatcttgttcacaagtaatc

SEQ ID NO: 56326 - DNA, 20 bp, Homo sapiens
gatctcgccagctttcccaa

SEQ ID NO: 56327 - DNA, 20 bp, Homo sapiens
gatcaccatcgcccacaggc

SEQ ID NO: 56328 - DNA, 20 bp, Homo sapiens
gatccaagaggcacaaatgg

SEQ ID NO: 56329 - DNA, 20 bp, Homo sapiens
gatcacatccagatacaaag

SEQ ID NO: 56330 - DNA, 20 bp, Homo sapiens
gatcaataaatataaattca

SEQ ID NO: 56331 - DNA, 20 bp, Homo sapiens
gatcgtgatactccgggcct

SEQ ID NO: 56332 - DNA, 20 bp, Homo sapiens
gatctcctgtgcctaagtta

SEQ ID NO: 56333 - DNA, 20 bp, Homo sapiens
gatctcttgcccattaagaa

SEQ ID NO: 56334 - DNA, 20 bp, Homo sapiens
gatcataaataatatgtttc

SEQ ID NO: 56335 - DNA, 20 bp, Homo sapiens
gatcccaccacaacctacct

SEQ ID NO: 56336 - DNA, 20 bp, Homo sapiens
gatcctctgtccctcaagct

SEQ ID NO: 56337 - DNA, 20 bp, Homo sapiens
gatcagctgtatcacatcac

SEQ ID NO: 56338 - DNA, 20 bp, Homo sapiens
gatcacagccgtctcaacca

SEQ ID NO: 56339 - DNA, 20 bp, Homo sapiens
gatcctggcctcgcagttcc

SEQ ID NO: 56340 - DNA, 20 bp, Homo sapiens
gatctttccagttacaagtt

SEQ ID NO: 56341 - DNA, 20 bp, Homo sapiens
gatcatgtagggtagaggag

SEQ ID NO: 56342 - DNA, 20 bp, Homo sapiens
gatctggagcaacagctggg

SEQ ID NO: 56343 - DNA, 20 bp, Homo sapiens
gatcaacaactaatggaaga

SEQ ID NO: 56344 - DNA, 20 bp, Homo sapiens
gatcatctcatcacccaggt

SEQ ID NO: 56345 - DNA, 20 bp, Homo sapiens
gatcatgtactttcattgga

SEQ ID NO: 56346 - DNA, 20 bp, Homo sapiens
gatccacctgcacagtcaag

SEQ ID NO: 56347 - DNA, 20 bp, Homo sapiens
gatcggtttatgtaagtctc

SEQ ID NO: 56348 - DNA, 20 bp, Homo sapiens
gatctgtgcagcaaagcacc

SEQ ID NO: 56349 - DNA, 20 bp, Homo sapiens
gatccactaattactcatac

SEQ ID NO: 56350 - DNA, 20 bp, Homo sapiens
gatctgtctgattaaacctt

SEQ ID NO: 56351 - DNA, 20 bp, Homo sapiens
gatccagggtagggaaagga

SEQ ID NO: 56352 - DNA, 20 bp, Homo sapiens
gatctcctgagaaattgctg

SEQ ID NO: 56353 - DNA, 20 bp, Homo sapiens
gatctttgtatatttgaaca

SEQ ID NO: 56354 - DNA, 20 bp, Homo sapiens
gatctgtgccaagctcaggg

SEQ ID NO: 56355 - DNA, 20 bp, Homo sapiens
gatcaaagcgccactgccct

SEQ ID NO: 56356 - DNA, 20 bp, Homo sapiens
gatcagcagcaggcaggcgc

SEQ ID NO: 56357 - DNA, 20 bp, Homo sapiens
gatcatacacagcaaacagg

SEQ ID NO: 56358 - DNA, 20 bp, Homo sapiens
gatccagcctcactatgcct

SEQ ID NO: 56359 - DNA, 20 bp, Homo sapiens
gatccttgcagcaccagttg

SEQ ID NO: 56360 - DNA, 20 bp, Homo sapiens
gatcttatgacctgcaggac

SEQ ID NO: 56361 - DNA, 20 bp, Homo sapiens
gatcaaggaaggcatccagt

SEQ ID NO: 56362 - DNA, 20 bp, Homo sapiens
gatcaggagcaaacagaccc

SEQ ID NO: 56363 - DNA, 20 bp, Homo sapiens
gatccctcagggtgggcatg

SEQ ID NO: 56364 - DNA, 20 bp, Homo sapiens
gatcggcctgctgggctgca

SEQ ID NO: 56365 - DNA, 20 bp, Homo sapiens
gatctcaatgtcgaagtggt

SEQ ID NO: 56366 - DNA, 20 bp, Homo sapiens
gatccatgaggactgcaagc

SEQ ID NO: 56367 - DNA, 20 bp, Homo sapiens
gatctccctagctcagagaa

SEQ ID NO: 56368 - DNA, 20 bp, Homo sapiens
gatcagacacttcaaggtct

SEQ ID NO: 56369 - DNA, 20 bp, Homo sapiens
gatcatcgcagttcggttgt

SEQ ID NO: 56370 - DNA, 20 bp, Homo sapiens
gatccagaaactgaggaagc

SEQ ID NO: 56371 - DNA, 20 bp, Homo sapiens
gatcctccccggacatggag

SEQ ID NO: 56372 - DNA, 20 bp, Homo sapiens
gatcgcatgtgacacttgcg

SEQ ID NO: 56373 - DNA, 20 bp, Homo sapiens
gatctacattaatatcaagt

SEQ ID NO: 56374 - DNA, 20 bp, Homo sapiens
gatcagataagtggaaaaaa

SEQ ID NO: 56375 - DNA, 20 bp, Homo sapiens
gatcccatcgagaagaacca

SEQ ID NO: 56376 - DNA, 20 bp, Homo sapiens
gatcagagagaacatccagg

SEQ ID NO: 56377 - DNA, 20 bp, Homo sapiens
gatccgctgctcattgtagc

SEQ ID NO: 56378 - DNA, 20 bp, Homo sapiens
gatcagttgcttatagataa

SEQ ID NO: 56379 - DNA, 20 bp, Homo sapiens
gatcatcctgaatacccatt

SEQ ID NO: 56380 - DNA, 20 bp, Homo sapiens
gatcttgggaaaacataatt

SEQ ID NO: 56381 - DNA, 20 bp, Homo sapiens
gatcaaaagcttattcatct

SEQ ID NO: 56382 - DNA, 20 bp, Homo sapiens
gatcatgtaaaattagtgaa

SEQ ID NO: 56383 - DNA, 20 bp, Homo sapiens
gatcctcatgaatgctatgc

SEQ ID NO: 56384 - DNA, 20 bp, Homo sapiens
gatcgaatcttgattttcac

SEQ ID NO: 56385 - DNA, 20 bp, Homo sapiens
gatctccagtaaactgaagg

SEQ ID NO: 56386 - DNA, 20 bp, Homo sapiens
gatctgcagcggcacagcac

SEQ ID NO: 56387 - DNA, 20 bp, Homo sapiens
gatctgcttgaatgtgctga

SEQ ID NO: 56388 - DNA, 20 bp, Homo sapiens
gatctgtcactaacttggaa

SEQ ID NO: 56389 - DNA, 20 bp, Homo sapiens
gatcttcaaatggacactgc

SEQ ID NO: 56390 - DNA, 20 bp, Homo sapiens
gatcttcattttctttctct

SEQ ID NO: 56391 - DNA, 20 bp, Homo sapiens
gatctttgccaaatccagac

SEQ ID NO: 56392 - DNA, 20 bp, Homo sapiens
gatcgatgggattggaatac

SEQ ID NO: 56393 - DNA, 20 bp, Homo sapiens
gatcaaactatgtactcttc

SEQ ID NO: 56394 - DNA, 20 bp, Homo sapiens
gatccattcctacggtcgag

SEQ ID NO: 56395 - DNA, 20 bp, Homo sapiens
gatcagcatgaccagcactc

SEQ ID NO: 56396 - DNA, 20 bp, Homo sapiens
gatcagggggtgggcaactg

SEQ ID NO: 56397 - DNA, 20 bp, Homo sapiens
gatcatggacaggatgacag

SEQ ID NO: 56398 - DNA, 20 bp, Homo sapiens
gatccgagagatattgaagt

SEQ ID NO: 56399 - DNA, 20 bp, Homo sapiens
gatccttcctcttcttgggg

SEQ ID NO: 56400 - DNA, 20 bp, Homo sapiens
gatctatgggaagtggtaca

SEQ ID NO: 56401 - DNA, 20 bp, Homo sapiens
gatctccgcctctgtagcgc

SEQ ID NO: 56402 - DNA, 20 bp, Homo sapiens
gatcttcttcagccaggggc

SEQ ID NO: 56403 - DNA, 20 bp, Homo sapiens
gatccctcaatgttcactaa

SEQ ID NO: 56404 - DNA, 20 bp, Homo sapiens
gatcgaaagaaatctaagtg

SEQ ID NO: 56405 - DNA, 20 bp, Homo sapiens
gatctcattatcatcaattc

SEQ ID NO: 56406 - DNA, 20 bp, Homo sapiens
gatcagtcaattttccgtcg

SEQ ID NO: 56407 - DNA, 20 bp, Homo sapiens
gatccaagtggacaggtaag

SEQ ID NO: 56408 - DNA, 20 bp, Homo sapiens
gatcaacattttggttgatt

SEQ ID NO: 56409 - DNA, 20 bp, Homo sapiens
gatcacaaagcaaaaggaca

SEQ ID NO: 56410 - DNA, 20 bp, Homo sapiens
gatccatccaacagattcag

SEQ ID NO: 56411 - DNA, 20 bp, Homo sapiens
gatcccaagtagaaaacacc

SEQ ID NO: 56412 - DNA, 20 bp, Homo sapiens
gatcatttaacattctgtgt

SEQ ID NO: 56413 - DNA, 20 bp, Homo sapiens
gatcctacgttccttggaat

SEQ ID NO: 56414 - DNA, 20 bp, Homo sapiens
gatcaatgggacacctttgg

SEQ ID NO: 56415 - DNA, 20 bp, Homo sapiens
gatccaaaattcagcaatac

SEQ ID NO: 56416 - DNA, 20 bp, Homo sapiens
gatctagtatccagttgctt

SEQ ID NO: 56417 - DNA, 20 bp, Homo sapiens
gatctctctcgtgcctacag

SEQ ID NO: 56418 - DNA, 20 bp, Homo sapiens
gatctcttagacagtcattt

SEQ ID NO: 56419 - DNA, 20 bp, Homo sapiens
gatctggtcaaagcaactgg

SEQ ID NO: 56420 - DNA, 20 bp, Homo sapiens
gatcccaggggctctggggg

SEQ ID NO: 56421 - DNA, 20 bp, Homo sapiens
gatccttgctcatctcctgc

SEQ ID NO: 56422 - DNA, 20 bp, Homo sapiens
gatctggaggaggtgaaggc

SEQ ID NO: 56423 - DNA, 20 bp, Homo sapiens
gatcaagaaggctggaacgg

SEQ ID NO: 56424 - DNA, 20 bp, Homo sapiens
gatcaggggtgtcagctgct

SEQ ID NO: 56425 - DNA, 20 bp, Homo sapiens
gatcctcaggggtcccccag

SEQ ID NO: 56426 - DNA, 20 bp, Homo sapiens
gatctacctgcccaggccca

SEQ ID NO: 56427 - DNA, 20 bp, Homo sapiens
gatctgatggagcaggtggc

SEQ ID NO: 56428 - DNA, 20 bp, Homo sapiens
gatcaatagcaaacacctaa

SEQ ID NO: 56429 - DNA, 20 bp, Homo sapiens
gatccagatggaaaagggaa

SEQ ID NO: 56430 - DNA, 20 bp, Homo sapiens
gatcctgattttctttaact

SEQ ID NO: 56431 - DNA, 20 bp, Homo sapiens
gatcggtaaggatgctaaga

SEQ ID NO: 56432 - DNA, 20 bp, Homo sapiens
gatctcatcttggatataat

SEQ ID NO: 56433 - DNA, 20 bp, Homo sapiens
gatctgagttattttgctaa

SEQ ID NO: 56434 - DNA, 20 bp, Homo sapiens
gatcgacagaaccaccacca

SEQ ID NO: 56435 - DNA, 20 bp, Homo sapiens
gatcgtcttggaaggcccag

SEQ ID NO: 56436 - DNA, 20 bp, Homo sapiens
gatcaggggagtaggggact

SEQ ID NO: 56437 - DNA, 20 bp, Homo sapiens
gatcccccaggttcagactg

SEQ ID NO: 56438 - DNA, 20 bp, Homo sapiens
gatctcgctgtgttgcccag

SEQ ID NO: 56439 - DNA, 20 bp, Homo sapiens
gatctcttgggggtaaaaca

SEQ ID NO: 56440 - DNA, 20 bp, Homo sapiens
gatcagttttgaagtttcta

SEQ ID NO: 56441 - DNA, 20 bp, Homo sapiens
gatcctggggctgggagtct

SEQ ID NO: 56442 - DNA, 20 bp, Homo sapiens
gatcgcgccgctgcattcca

SEQ ID NO: 56443 - DNA, 20 bp, Homo sapiens
gatcagtttttcttgtaaca

SEQ ID NO: 56444 - DNA, 20 bp, Homo sapiens
gatcgtgttgggatattcaa

SEQ ID NO: 56445 - DNA, 20 bp, Homo sapiens
gatccatttccggggcacac

SEQ ID NO: 56446 - DNA, 20 bp, Homo sapiens
gatctcagaactgaaggccg

SEQ ID NO: 56447 - DNA, 20 bp, Homo sapiens
gatcagggtggaccctggca

SEQ ID NO: 56448 - DNA, 20 bp, Homo sapiens
gatcttggagtcatctgggt

SEQ ID NO: 56449 - DNA, 20 bp, Homo sapiens
gatcactccagcctgctgct

SEQ ID NO: 56450 - DNA, 20 bp, Homo sapiens
gatcacgatgccctgctctt

SEQ ID NO: 56451 - DNA, 20 bp, Homo sapiens
gatcccacctccttctgtaa

SEQ ID NO: 56452 - DNA, 20 bp, Homo sapiens
gatctcagtcctccagggtc

SEQ ID NO: 56453 - DNA, 20 bp, Homo sapiens
gatcacagtctcttctcact

SEQ ID NO: 56454 - DNA, 20 bp, Homo sapiens
gatccagaaatacgcaagag

SEQ ID NO: 56455 - DNA, 20 bp, Homo sapiens
gatcgtttgaggccaggagg

SEQ ID NO: 56456 - DNA, 20 bp, Homo sapiens
gatccagagatttctcagga

SEQ ID NO: 56457 - DNA, 20 bp, Homo sapiens
gatctcactcctgtatgaat

SEQ ID NO: 56458 - DNA, 20 bp, Homo sapiens
gatctgaccatgatatacct

SEQ ID NO: 56459 - DNA, 20 bp, Homo sapiens
gatcaaggcaaaaatatcag

SEQ ID NO: 56460 - DNA, 20 bp, Homo sapiens
gatctaaaggaaaatatgtt

SEQ ID NO: 56461 - DNA, 20 bp, Homo sapiens
gatcctgctagaacaaggtc

SEQ ID NO: 56462 - DNA, 20 bp, Homo sapiens
gatcaataaatatccaatac

SEQ ID NO: 56463 - DNA, 20 bp, Homo sapiens
gatcacacatttaatttcga

SEQ ID NO: 56464 - DNA, 20 bp, Homo sapiens
gatccacctagtgcctctgg

SEQ ID NO: 56465 - DNA, 20 bp, Homo sapiens
gatccagtgttgactaggat

SEQ ID NO: 56466 - DNA, 20 bp, Homo sapiens
gatcaagtcgagactgcagg

SEQ ID NO: 56467 - DNA, 20 bp, Homo sapiens
gatccagacggagccaaagt

SEQ ID NO: 56468 - DNA, 20 bp, Homo sapiens
gatccgagcctactatgaaa

SEQ ID NO: 56469 - DNA, 20 bp, Homo sapiens
gatcacaaatagaattcagc

SEQ ID NO: 56470 - DNA, 20 bp, Homo sapiens
gatcagtatgttgagcctga

SEQ ID NO: 56471 - DNA, 20 bp, Homo sapiens
gatcagtttagcaaatctac

SEQ ID NO: 56472 - DNA, 20 bp, Homo sapiens
gatccttatccacagacaac

SEQ ID NO: 56473 - DNA, 20 bp, Homo sapiens
gatctgtattgaattgcaag

SEQ ID NO: 56474 - DNA, 20 bp, Homo sapiens
gatcaacttgcagactggaa

SEQ ID NO: 56475 - DNA, 20 bp, Homo sapiens
gatccaggaagctcccaaac

SEQ ID NO: 56476 - DNA, 20 bp, Homo sapiens
gatcctaaggtgaagttatt

SEQ ID NO: 56477 - DNA, 20 bp, Homo sapiens
gatcttctaacactgcttaa

SEQ ID NO: 56478 - DNA, 20 bp, Homo sapiens
gatcagtttcctgttccttg

SEQ ID NO: 56479 - DNA, 20 bp, Homo sapiens
gatcattaaagcctgagttt

SEQ ID NO: 56480 - DNA, 20 bp, Homo sapiens
gatctgacaatctctgcaga

SEQ ID NO: 56481 - DNA, 20 bp, Homo sapiens
gatcatcaacaagtgagaaa

SEQ ID NO: 56482 - DNA, 20 bp, Homo sapiens
gatcattattctcccctgac

SEQ ID NO: 56483 - DNA, 20 bp, Homo sapiens
gatctcaaactaacagaaaa

SEQ ID NO: 56484 - DNA, 20 bp, Homo sapiens
gatcatcaaaaaaataaagt

SEQ ID NO: 56485 - DNA, 20 bp, Homo sapiens
gatccaaagtgctgtaagta

SEQ ID NO: 56486 - DNA, 20 bp, Homo sapiens
gatccatgggtggcatttat

SEQ ID NO: 56487 - DNA, 20 bp, Homo sapiens
gatcccaaggcctagcctgt

SEQ ID NO: 56488 - DNA, 20 bp, Homo sapiens
gatcctttcaggacagggac

SEQ ID NO: 56489 - DNA, 20 bp, Homo sapiens
gatctgaggctggtttcacg

SEQ ID NO: 56490 - DNA, 20 bp, Homo sapiens
gatcttctgccggctgcccc

SEQ ID NO: 56491 - DNA, 20 bp, Homo sapiens
gatcctacccctgaagataa

SEQ ID NO: 56492 - DNA, 20 bp, Homo sapiens
gatctatgaaaccaaaggcg

SEQ ID NO: 56493 - DNA, 20 bp, Homo sapiens
gatctgaaggtactagtgtt

SEQ ID NO: 56494 - DNA, 20 bp, Homo sapiens
gatcatccagaaggagcccg

SEQ ID NO: 56495 - DNA, 20 bp, Homo sapiens
gatcatttgaggaataaaat

SEQ ID NO: 56496 - DNA, 20 bp, Homo sapiens
gatcaaaataaaggagaagt

SEQ ID NO: 56497 - DNA, 20 bp, Homo sapiens
gatcattgttctgcttctct

SEQ ID NO: 56498 - DNA, 20 bp, Homo sapiens
gatcctctcatattttgtct

SEQ ID NO: 56499 - DNA, 20 bp, Homo sapiens
gatctagcaaagtctctgca

SEQ ID NO: 56500 - DNA, 20 bp, Homo sapiens
gatctatattttcttcaatt

SEQ ID NO: 56501 - DNA, 20 bp, Homo sapiens
gatcctttattcccaaagct

SEQ ID NO: 56502 - DNA, 20 bp, Homo sapiens
gatcttcattcacagctcta

SEQ ID NO: 56503 - DNA, 20 bp, Homo sapiens
gatcttttgaaggccaaaaa

SEQ ID NO: 56504 - DNA, 20 bp, Homo sapiens
gatccttacagaattctttt

SEQ ID NO: 56505 - DNA, 20 bp, Homo sapiens
gatcaagctcaagaataagc

SEQ ID NO: 56506 - DNA, 20 bp, Homo sapiens
gatcagacagcattggggcc

SEQ ID NO: 56507 - DNA, 20 bp, Homo sapiens
gatcagggcaacgtcatagt

SEQ ID NO: 56508 - DNA, 20 bp, Homo sapiens
gatcatttggtagaaaacat

SEQ ID NO: 56509 - DNA, 20 bp, Homo sapiens
gatcgatgaaagccagtctc

SEQ ID NO: 56510 - DNA, 20 bp, Homo sapiens
gatcgcaaaaacccaaggga

SEQ ID NO: 56511 - DNA, 20 bp, Homo sapiens
gatctcagtcattcgccctt

SEQ ID NO: 56512 - DNA, 20 bp, Homo sapiens
gatctcatcaatgacagtaa

SEQ ID NO: 56513 - DNA, 20 bp, Homo sapiens
gatccatgtgtaatatcaca

SEQ ID NO: 56514 - DNA, 20 bp, Homo sapiens
gatctaagcattttggtggt

SEQ ID NO: 56515 - DNA, 20 bp, Homo sapiens
gatcaattacatgtttgcaa

SEQ ID NO: 56516 - DNA, 20 bp, Homo sapiens
gatccatgtgtggtatctga

SEQ ID NO: 56517 - DNA, 20 bp, Homo sapiens
gatctcacctgacaacactg

SEQ ID NO: 56518 - DNA, 20 bp, Homo sapiens
gatctttagaaggtgattaa

SEQ ID NO: 56519 - DNA, 20 bp, Homo sapiens
gatcacaattttatacattg

SEQ ID NO: 56520 - DNA, 20 bp, Homo sapiens
gatctctctcttcattctat

SEQ ID NO: 56521 - DNA, 20 bp, Homo sapiens
gatcaggcgcagcacacaca

SEQ ID NO: 56522 - DNA, 20 bp, Homo sapiens
gatccacattgcataagtgg

SEQ ID NO: 56523 - DNA, 20 bp, Homo sapiens
gatctttagcctttccaagt

SEQ ID NO: 56524 - DNA, 20 bp, Homo sapiens
gatccaggaataaaccttgc

SEQ ID NO: 56525 - DNA, 20 bp, Homo sapiens
gatcctgtgcgtggggatgg

SEQ ID NO: 56526 - DNA, 20 bp, Homo sapiens
gatctgagtcaacatagcta

SEQ ID NO: 56527 - DNA, 20 bp, Homo sapiens
gatcaccccgagaaagtaaa

SEQ ID NO: 56528 - DNA, 20 bp, Homo sapiens
gatcagagtatgttttgatg

SEQ ID NO: 56529 - DNA, 20 bp, Homo sapiens
gatcctactcaacaaaagga

SEQ ID NO: 56530 - DNA, 20 bp, Homo sapiens
gatctatgatttgggcatca

SEQ ID NO: 56531 - DNA, 20 bp, Homo sapiens
gatctttgattaaacttgct

SEQ ID NO: 56532 - DNA, 20 bp, Homo sapiens
gatcaagcattctttctatt

SEQ ID NO: 56533 - DNA, 20 bp, Homo sapiens
gatcccaggtcttcagctaa

SEQ ID NO: 56534 - DNA, 20 bp, Homo sapiens
gatctcctggactggaaaga

SEQ ID NO: 56535 - DNA, 20 bp, Homo sapiens
gatcaaggtaggaaaagttg

SEQ ID NO: 56536 - DNA, 20 bp, Homo sapiens
gatcaccattaatcagcacc

SEQ ID NO: 56537 - DNA, 20 bp, Homo sapiens
gatccaaaaagaagcaatac

SEQ ID NO: 56538 - DNA, 20 bp, Homo sapiens
gatcctcattctcacccatt

SEQ ID NO: 56539 - DNA, 20 bp, Homo sapiens
gatccttcccctttgtttcc

SEQ ID NO: 56540 - DNA, 20 bp, Homo sapiens
gatcctggagggcctgggct

SEQ ID NO: 56541 - DNA, 20 bp, Homo sapiens
gatcagcgcttccttctcag

SEQ ID NO: 56542 - DNA, 20 bp, Homo sapiens
gatcgtggagttctgggtag

SEQ ID NO: 56543 - DNA, 20 bp, Homo sapiens
gatctacacctggactgccc

SEQ ID NO: 56544 - DNA, 20 bp, Homo sapiens
gatctgctctgctggggcaa

SEQ ID NO: 56545 - DNA, 20 bp, Homo sapiens
gatctgctttttttccagag

SEQ ID NO: 56546 - DNA, 20 bp, Homo sapiens
gatctggttccagacaaggc

SEQ ID NO: 56547 - DNA, 20 bp, Homo sapiens
gatctgtccaacttgaaata

SEQ ID NO: 56548 - DNA, 20 bp, Homo sapiens
gatcttctatttaattcccc

SEQ ID NO: 56549 - DNA, 20 bp, Homo sapiens
gatcttggagataatttctt

SEQ ID NO: 56550 - DNA, 20 bp, Homo sapiens
gatcatgtttataatataat

SEQ ID NO: 56551 - DNA, 20 bp, Homo sapiens
gatccctgccatctctgcag

SEQ ID NO: 56552 - DNA, 20 bp, Homo sapiens
gatcatttgagcccaggaat

SEQ ID NO: 56553 - DNA, 20 bp, Homo sapiens
gatctgcccgcctcgacctc

SEQ ID NO: 56554 - DNA, 20 bp, Homo sapiens
gatccaagttaatttaattt

SEQ ID NO: 56555 - DNA, 20 bp, Homo sapiens
gatcttcaccaacaaggaag

SEQ ID NO: 56556 - DNA, 20 bp, Homo sapiens
gatcactctgtcaatctcct

SEQ ID NO: 56557 - DNA, 20 bp, Homo sapiens
gatcagtgagcgctatggcc

SEQ ID NO: 56558 - DNA, 20 bp, Homo sapiens
gatccagcgtgcgctggttg

SEQ ID NO: 56559 - DNA, 20 bp, Homo sapiens
gatcccaccttcttcctgag

SEQ ID NO: 56560 - DNA, 20 bp, Homo sapiens
gatcccacgaaactacacca

SEQ ID NO: 56561 - DNA, 20 bp, Homo sapiens
gatcgatattggcgccgtgc

SEQ ID NO: 56562 - DNA, 20 bp, Homo sapiens
gatcgtggcaaagcccacgt

SEQ ID NO: 56563 - DNA, 20 bp, Homo sapiens
gatcttcatgagggagttgt

SEQ ID NO: 56564 - DNA, 20 bp, Homo sapiens
gatccccatgagtttggccc

SEQ ID NO: 56565 - DNA, 20 bp, Homo sapiens
gatcccaattccccacagga

SEQ ID NO: 56566 - DNA, 20 bp, Homo sapiens
gatcgtggcaaagaccacgt

SEQ ID NO: 56567 - DNA, 20 bp, Homo sapiens
gatcaagagattctccagtc

SEQ ID NO: 56568 - DNA, 20 bp, Homo sapiens
gatcaagagttcctgaagat

SEQ ID NO: 56569 - DNA, 20 bp, Homo sapiens
gatcaagcaactctcctgcc

SEQ ID NO: 56570 - DNA, 20 bp, Homo sapiens
gatcacatattatgcctgta

SEQ ID NO: 56571 - DNA, 20 bp, Homo sapiens
gatccacccacctcagtgtt

SEQ ID NO: 56572 - DNA, 20 bp, Homo sapiens
gatccgcttcctgccccgct

SEQ ID NO: 56573 - DNA, 20 bp, Homo sapiens
gatctgacaccccaggagtg

SEQ ID NO: 56574 - DNA, 20 bp, Homo sapiens
gatcttggaaggcagaggtt

SEQ ID NO: 56575 - DNA, 20 bp, Homo sapiens
gatcttttgtgtctggttgc

SEQ ID NO: 56576 - DNA, 20 bp, Homo sapiens
gatctccttccatctctttc

SEQ ID NO: 56577 - DNA, 20 bp, Homo sapiens
gatcaaaatggagaaggaaa

SEQ ID NO: 56578 - DNA, 20 bp, Homo sapiens
gatcaatcagggcttccttc

SEQ ID NO: 56579 - DNA, 20 bp, Homo sapiens
gatccggcgtttctccctca

SEQ ID NO: 56580 - DNA, 20 bp, Homo sapiens
gatcttggagaggagttttc

SEQ ID NO: 56581 - DNA, 20 bp, Homo sapiens
gatcaatctcttcctggact

SEQ ID NO: 56582 - DNA, 20 bp, Homo sapiens
gatccagagatacagtgacc

SEQ ID NO: 56583 - DNA, 20 bp, Homo sapiens
gatctgctatcacctgcaac

SEQ ID NO: 56584 - DNA, 20 bp, Homo sapiens
gatctggtatgagggtggca

SEQ ID NO: 56585 - DNA, 20 bp, Homo sapiens
gatctagtgaacattcgacc

SEQ ID NO: 56586 - DNA, 20 bp, Homo sapiens
gatctgcaataatttttctc

SEQ ID NO: 56587 - DNA, 20 bp, Homo sapiens
gatcttcagggaagggaaaa

SEQ ID NO: 56588 - DNA, 20 bp, Homo sapiens
gatcgacgacgtgatagggc

SEQ ID NO: 56589 - DNA, 20 bp, Homo sapiens
gatcaggaaattcttggttg

SEQ ID NO: 56590 - DNA, 20 bp, Homo sapiens
gatccagaaaagtttaagcc

SEQ ID NO: 56591 - DNA, 20 bp, Homo sapiens
gatccagagggaggcccact

SEQ ID NO: 56592 - DNA, 20 bp, Homo sapiens
gatccggctctcattgccct

SEQ ID NO: 56593 - DNA, 20 bp, Homo sapiens
gatcgaagagaagctccatg

SEQ ID NO: 56594 - DNA, 20 bp, Homo sapiens
gatctcagggtatttcatga

SEQ ID NO: 56595 - DNA, 20 bp, Homo sapiens
gatcaaaaaaggcataatta

SEQ ID NO: 56596 - DNA, 20 bp, Homo sapiens
gatcaaaacagtgctagtga

SEQ ID NO: 56597 - DNA, 20 bp, Homo sapiens
gatcaatgggatgttcattc

SEQ ID NO: 56598 - DNA, 20 bp, Homo sapiens
gatcacatccatgctgtagg

SEQ ID NO: 56599 - DNA, 20 bp, Homo sapiens
gatcactagcacatcatttg

SEQ ID NO: 56600 - DNA, 20 bp, Homo sapiens
gatccattctttctctcaat

SEQ ID NO: 56601 - DNA, 20 bp, Homo sapiens
gatccccctgaaattaagct

SEQ ID NO: 56602 - DNA, 20 bp, Homo sapiens
gatccttacatatacacacc

SEQ ID NO: 56603 - DNA, 20 bp, Homo sapiens
gatcggacagagctttgtgg

SEQ ID NO: 56604 - DNA, 20 bp, Homo sapiens
gatcgtaatctcttccattc

SEQ ID NO: 56605 - DNA, 20 bp, Homo sapiens
gatctatgttgtccttgttc

SEQ ID NO: 56606 - DNA, 20 bp, Homo sapiens
gatctcaacatcttttttgc

SEQ ID NO: 56607 - DNA, 20 bp, Homo sapiens
gatctggagctcgtggccca

SEQ ID NO: 56608 - DNA, 20 bp, Homo sapiens
gatctgtgtttctttacaag

SEQ ID NO: 56609 - DNA, 20 bp, Homo sapiens
gatcaacaaataaatatttt

SEQ ID NO: 56610 - DNA, 20 bp, Homo sapiens
gatcccactgaaattagaca

SEQ ID NO: 56611 - DNA, 20 bp, Homo sapiens
gatccattatttctctcaat

SEQ ID NO: 56612 - DNA, 20 bp, Homo sapiens
gatccccctgaaattacgct

SEQ ID NO: 56613 - DNA, 20 bp, Homo sapiens
gatctggagctcatggccca

SEQ ID NO: 56614 - DNA, 20 bp, Homo sapiens
gatcaattgtatcttgagtt

SEQ ID NO: 56615 - DNA, 20 bp, Homo sapiens
gatcaccaataaataatctg

SEQ ID NO: 56616 - DNA, 20 bp, Homo sapiens
gatccccatccccattgcac

SEQ ID NO: 56617 - DNA, 20 bp, Homo sapiens
gatcctggacatgattcaag

SEQ ID NO: 56618 - DNA, 20 bp, Homo sapiens
gatcctgggagagcaaggag

SEQ ID NO: 56619 - DNA, 20 bp, Homo sapiens
gatccattacaacccaactg

SEQ ID NO: 56620 - DNA, 20 bp, Homo sapiens
gatctggagccagactgctt

SEQ ID NO: 56621 - DNA, 20 bp, Homo sapiens
gatcaatctgaggagactta

SEQ ID NO: 56622 - DNA, 20 bp, Homo sapiens
gatccagccatctcattcta

SEQ ID NO: 56623 - DNA, 20 bp, Homo sapiens
gatccccactacactgtgga

SEQ ID NO: 56624 - DNA, 20 bp, Homo sapiens
gatcctcctgtacatagact

SEQ ID NO: 56625 - DNA, 20 bp, Homo sapiens
gatctatagattcacagaaa

SEQ ID NO: 56626 - DNA, 20 bp, Homo sapiens
gatcatatatcataaaggat

SEQ ID NO: 56627 - DNA, 20 bp, Homo sapiens
gatcgggagctacaatatgt

SEQ ID NO: 56628 - DNA, 20 bp, Homo sapiens
gatctcactaagctgtccag

SEQ ID NO: 56629 - DNA, 20 bp, Homo sapiens
gatctggagaaggccaagac

SEQ ID NO: 56630 - DNA, 20 bp, Homo sapiens
gatcacaggtataagaatga

SEQ ID NO: 56631 - DNA, 20 bp, Homo sapiens
gatcactattaaaaatttta

SEQ ID NO: 56632 - DNA, 20 bp, Homo sapiens
gatcattgctgaactcagag

SEQ ID NO: 56633 - DNA, 20 bp, Homo sapiens
gatctctgcgtttctcttct

SEQ ID NO: 56634 - DNA, 20 bp, Homo sapiens
gatcttgaatgattcctaca

SEQ ID NO: 56635 - DNA, 20 bp, Homo sapiens
gatcatgaaggtggacgccc

SEQ ID NO: 56636 - DNA, 20 bp, Homo sapiens
gatcctctagctaggcaggg

SEQ ID NO: 56637 - DNA, 20 bp, Homo sapiens
gatcatttaagacactaaat

SEQ ID NO: 56638 - DNA, 20 bp, Homo sapiens
gatccagagggaaatgaaag

SEQ ID NO: 56639 - DNA, 20 bp, Homo sapiens
gatccttgcagaatgctgtc

SEQ ID NO: 56640 - DNA, 20 bp, Homo sapiens
gatcctagggagttgaataa

SEQ ID NO: 56641 - DNA, 20 bp, Homo sapiens
gatcctttagaaaaaattca

SEQ ID NO: 56642 - DNA, 20 bp, Homo sapiens
gatctcaatgtttattaatt

SEQ ID NO: 56643 - DNA, 20 bp, Homo sapiens
gatcccgtcaagacatctgg

SEQ ID NO: 56644 - DNA, 20 bp, Homo sapiens
gatctatgcttgtttgtttt

SEQ ID NO: 56645 - DNA, 20 bp, Homo sapiens
gatccagtttacaaactgtg

SEQ ID NO: 56646 - DNA, 20 bp, Homo sapiens
gatcgccagcgtcctgcagg

SEQ ID NO: 56647 - DNA, 20 bp, Homo sapiens
gatcatcccactcctgactg

SEQ ID NO: 56648 - DNA, 20 bp, Homo sapiens
gatcccagtgctttcacctg

SEQ ID NO: 56649 - DNA, 20 bp, Homo sapiens
gatctttctgcccagaaagg

SEQ ID NO: 56650 - DNA, 20 bp, Homo sapiens
gatctcactttaatggagag

SEQ ID NO: 56651 - DNA, 20 bp, Homo sapiens
gatcatcttatgggttattt

SEQ ID NO: 56652 - DNA, 20 bp, Homo sapiens
gatctgtgccggctacaggg

SEQ ID NO: 56653 - DNA, 20 bp, Homo sapiens
gatccaggccaggtagtagg

SEQ ID NO: 56654 - DNA, 20 bp, Homo sapiens
gatccccagctgatgatgcc

SEQ ID NO: 56655 - DNA, 20 bp, Homo sapiens
gatccgggagcacaccgttt

SEQ ID NO: 56656 - DNA, 20 bp, Homo sapiens
gatcgggctgtggtgaccgc

SEQ ID NO: 56657 - DNA, 20 bp, Homo sapiens
gatccagtaatatataattc

SEQ ID NO: 56658 - DNA, 20 bp, Homo sapiens
gatctatacttagaatgcaa

SEQ ID NO: 56659 - DNA, 20 bp, Homo sapiens
gatcaatgaccttctgtatc

SEQ ID NO: 56660 - DNA, 20 bp, Homo sapiens
gatcagtttggagagtaggg

SEQ ID NO: 56661 - DNA, 20 bp, Homo sapiens
gatccgcatcactgacaaca

SEQ ID NO: 56662 - DNA, 20 bp, Homo sapiens
gatccgggtggagtccttgc

SEQ ID NO: 56663 - DNA, 20 bp, Homo sapiens
gatcaagaagataacggcaa

SEQ ID NO: 56664 - DNA, 20 bp, Homo sapiens
gatcatagaatgtatatatt

SEQ ID NO: 56665 - DNA, 20 bp, Homo sapiens
gatcattgctttttctcttt

SEQ ID NO: 56666 - DNA, 20 bp, Homo sapiens
gatcgggaagatggaatgct

SEQ ID NO: 56667 - DNA, 20 bp, Homo sapiens
gatctttggtctactctatc

SEQ ID NO: 56668 - DNA, 20 bp, Homo sapiens
gatcactttggacccagcgg

SEQ ID NO: 56669 - DNA, 20 bp, Homo sapiens
gatccaaaacgaattcacgg

SEQ ID NO: 56670 - DNA, 20 bp, Homo sapiens
gatccaagtgaaaaaggtag

SEQ ID NO: 56671 - DNA, 20 bp, Homo sapiens
gatcttaacaccggaaattg

SEQ ID NO: 56672 - DNA, 20 bp, Homo sapiens
gatctgtccaatatcttcct

SEQ ID NO: 56673 - DNA, 20 bp, Homo sapiens
gatcaaatattgaccaaagt

SEQ ID NO: 56674 - DNA, 20 bp, Homo sapiens
gatcactgaattttaaccgg

SEQ ID NO: 56675 - DNA, 20 bp, Homo sapiens
gatcagagacggaaagcccc

SEQ ID NO: 56676 - DNA, 20 bp, Homo sapiens
gatcagcagaagcaacttga

SEQ ID NO: 56677 - DNA, 20 bp, Homo sapiens
gatcatacttagtgagaggc

SEQ ID NO: 56678 - DNA, 20 bp, Homo sapiens
gatcccggtagcttgatatt

SEQ ID NO: 56679 - DNA, 20 bp, Homo sapiens
gatccggttccataagaggt

SEQ ID NO: 56680 - DNA, 20 bp, Homo sapiens
gatcctctgacactcggttg

SEQ ID NO: 56681 - DNA, 20 bp, Homo sapiens
gatcggcttcacttccggcc

SEQ ID NO: 56682 - DNA, 20 bp, Homo sapiens
gatcgtctgcctggtcctaa

SEQ ID NO: 56683 - DNA, 20 bp, Homo sapiens
gatctaagttgcatctttaa

SEQ ID NO: 56684 - DNA, 20 bp, Homo sapiens
gatctatgctatattcaaaa

SEQ ID NO: 56685 - DNA, 20 bp, Homo sapiens
gatctgagaagcagaattga

SEQ ID NO: 56686 - DNA, 20 bp, Homo sapiens
gatcatgaaggaacacatag

SEQ ID NO: 56687 - DNA, 20 bp, Homo sapiens
gatcaggcccttcttcccac

SEQ ID NO: 56688 - DNA, 20 bp, Homo sapiens
gatccatataaacagggatt

SEQ ID NO: 56689 - DNA, 20 bp, Homo sapiens
gatcccagaaaacagtgttc

SEQ ID NO: 56690 - DNA, 20 bp, Homo sapiens
gatcccatttcctgccaaag

SEQ ID NO: 56691 - DNA, 20 bp, Homo sapiens
gatcctacataaataaatat

SEQ ID NO: 56692 - DNA, 20 bp, Homo sapiens
gatctcagtgaacaaataca

SEQ ID NO: 56693 - DNA, 20 bp, Homo sapiens
gatctgatgttaaccagccg

SEQ ID NO: 56694 - DNA, 20 bp, Homo sapiens
gatctggtatttgttggctt

SEQ ID NO: 56695 - DNA, 20 bp, Homo sapiens
gatctgtcaaagaaaacttc

SEQ ID NO: 56696 - DNA, 20 bp, Homo sapiens
gatcttcatactcatcttcc

SEQ ID NO: 56697 - DNA, 20 bp, Homo sapiens
gatcgctccactttgaccct

SEQ ID NO: 56698 - DNA, 20 bp, Homo sapiens
gatcatcgccaaaatcaaag

SEQ ID NO: 56699 - DNA, 20 bp, Homo sapiens
gatccatcctgttcagcaca

SEQ ID NO: 56700 - DNA, 20 bp, Homo sapiens
gatcctagtgacaagttttt

SEQ ID NO: 56701 - DNA, 20 bp, Homo sapiens
gatccttgtctactttggtt

SEQ ID NO: 56702 - DNA, 20 bp, Homo sapiens
gatctacagtctttggaaga

SEQ ID NO: 56703 - DNA, 20 bp, Homo sapiens
gatctggttggtggatgaac

SEQ ID NO: 56704 - DNA, 20 bp, Homo sapiens
gatcaatgacagtattctca

SEQ ID NO: 56705 - DNA, 20 bp, Homo sapiens
gatcagtctggctggtggtt

SEQ ID NO: 56706 - DNA, 20 bp, Homo sapiens
gatcatgacaactatgaagg

SEQ ID NO: 56707 - DNA, 20 bp, Homo sapiens
gatcgtctctgaattacagt

SEQ ID NO: 56708 - DNA, 20 bp, Homo sapiens
gatctctgtcccacgtgctg

SEQ ID NO: 56709 - DNA, 20 bp, Homo sapiens
gatctgatggcagtgaaaac

SEQ ID NO: 56710 - DNA, 20 bp, Homo sapiens
gatcttcttctgcgcagttc

SEQ ID NO: 56711 - DNA, 20 bp, Homo sapiens
gatcttgacctgttgctgtt

SEQ ID NO: 56712 - DNA, 20 bp, Homo sapiens
gatcttggaagcaagaggca

SEQ ID NO: 56713 - DNA, 20 bp, Homo sapiens
gatcaactctagttgtctcc

SEQ ID NO: 56714 - DNA, 20 bp, Homo sapiens
gatctgaagattatggcaga

SEQ ID NO: 56715 - DNA, 20 bp, Homo sapiens
gatccaaaattggtaaagaa

SEQ ID NO: 56716 - DNA, 20 bp, Homo sapiens
gatcacacagcattaaaact

SEQ ID NO: 56717 - DNA, 20 bp, Homo sapiens
gatcatgacatgattcttaa

SEQ ID NO: 56718 - DNA, 20 bp, Homo sapiens
gatcccaaattggccatgga

SEQ ID NO: 56719 - DNA, 20 bp, Homo sapiens
gatcttaagagagcactaat

SEQ ID NO: 56720 - DNA, 20 bp, Homo sapiens
gatcaggcgccgcatcgtcg

SEQ ID NO: 56721 - DNA, 20 bp, Homo sapiens
gatccaccatcgtgtttcca

SEQ ID NO: 56722 - DNA, 20 bp, Homo sapiens
gatcccgcccttccgcgagg

SEQ ID NO: 56723 - DNA, 20 bp, Homo sapiens
gatctggtccttaaatgcct

SEQ ID NO: 56724 - DNA, 20 bp, Homo sapiens
gatcctaactgagaattttc

SEQ ID NO: 56725 - DNA, 20 bp, Homo sapiens
gatcgcagacctcaggaatg

SEQ ID NO: 56726 - DNA, 20 bp, Homo sapiens
gatcttcagaaggctagagg

SEQ ID NO: 56727 - DNA, 20 bp, Homo sapiens
gatctagtgtaattcataca

SEQ ID NO: 56728 - DNA, 20 bp, Homo sapiens
gatctgtgtatgttctaagt

SEQ ID NO: 56729 - DNA, 20 bp, Homo sapiens
gatcaggcatttctttccaa

SEQ ID NO: 56730 - DNA, 20 bp, Homo sapiens
gatcacacacatctttgttt

SEQ ID NO: 56731 - DNA, 20 bp, Homo sapiens
gatcattcccctgggtggct

SEQ ID NO: 56732 - DNA, 20 bp, Homo sapiens
gatccaggaaacaccaaagt

SEQ ID NO: 56733 - DNA, 20 bp, Homo sapiens
gatctctgatgacctaacct

SEQ ID NO: 56734 - DNA, 20 bp, Homo sapiens
gatctggaggatgttttgcc

SEQ ID NO: 56735 - DNA, 20 bp, Homo sapiens
gatctttcctgaacgcctca

SEQ ID NO: 56736 - DNA, 20 bp, Homo sapiens
gatcaacttcttcatcttcg

SEQ ID NO: 56737 - DNA, 20 bp, Homo sapiens
gatccactttccccagccac

SEQ ID NO: 56738 - DNA, 20 bp, Homo sapiens
gatcctagagcctgacgttc

SEQ ID NO: 56739 - DNA, 20 bp, Homo sapiens
gatctcattctgcttgtatt

SEQ ID NO: 56740 - DNA, 20 bp, Homo sapiens
gatcaccagaactcatcaac

SEQ ID NO: 56741 - DNA, 20 bp, Homo sapiens
gatccaatgttttttctaaa

SEQ ID NO: 56742 - DNA, 20 bp, Homo sapiens
gatcccagcacacaggggtc

SEQ ID NO: 56743 - DNA, 20 bp, Homo sapiens
gatctaatggaccagactgg

SEQ ID NO: 56744 - DNA, 20 bp, Homo sapiens
gatcagggattcagaattgt

SEQ ID NO: 56745 - DNA, 20 bp, Homo sapiens
gatcgtaaactggaaacaga

SEQ ID NO: 56746 - DNA, 20 bp, Homo sapiens
gatcttaaaaaataattata

SEQ ID NO: 56747 - DNA, 20 bp, Homo sapiens
gatcggtcatgagggaaaat

SEQ ID NO: 56748 - DNA, 20 bp, Homo sapiens
gatctcctactccatccagt

SEQ ID NO: 56749 - DNA, 20 bp, Homo sapiens
gatctcctcattctgacagt

SEQ ID NO: 56750 - DNA, 20 bp, Homo sapiens
gatctgtgtgttgagcagtt

SEQ ID NO: 56751 - DNA, 20 bp, Homo sapiens
gatccaagagaaaacaaaaa

SEQ ID NO: 56752 - DNA, 20 bp, Homo sapiens
gatcctaatgagaagaaatc

SEQ ID NO: 56753 - DNA, 20 bp, Homo sapiens
gatcggttaaatatcaagtc

SEQ ID NO: 56754 - DNA, 20 bp, Homo sapiens
gatcttacccatgaatgtgc

SEQ ID NO: 56755 - DNA, 20 bp, Homo sapiens
gatcaaagccaccatcaaaa

SEQ ID NO: 56756 - DNA, 20 bp, Homo sapiens
gatctccagcctccactgct

SEQ ID NO: 56757 - DNA, 20 bp, Homo sapiens
gatcatagtaaagagtagtc

SEQ ID NO: 56758 - DNA, 20 bp, Homo sapiens
gatccaattaatagaagaaa

SEQ ID NO: 56759 - DNA, 20 bp, Homo sapiens
gatcaaagtgtgggatgtgc

SEQ ID NO: 56760 - DNA, 20 bp, Homo sapiens
gatcgatgacagcagccgca

SEQ ID NO: 56761 - DNA, 20 bp, Homo sapiens
gatctgggagctcagtgcca

SEQ ID NO: 56762 - DNA, 20 bp, Homo sapiens
gatctgggccgcttgcctcc

SEQ ID NO: 56763 - DNA, 20 bp, Homo sapiens
gatcattatcttttcacctt

SEQ ID NO: 56764 - DNA, 20 bp, Homo sapiens
gatctcattgtttattaacc

SEQ ID NO: 56765 - DNA, 20 bp, Homo sapiens
gatctgacagtgcacaatat

SEQ ID NO: 56766 - DNA, 20 bp, Homo sapiens
gatcttggaaacggccaaag

SEQ ID NO: 56767 - DNA, 20 bp, Homo sapiens
gatcttcaatcacctaaaaa

SEQ ID NO: 56768 - DNA, 20 bp, Homo sapiens
gatcttttacttcagaggaa

SEQ ID NO: 56769 - DNA, 20 bp, Homo sapiens
gatcctgagaacttcaagct

SEQ ID NO: 56770 - DNA, 20 bp, Homo sapiens
gatctcaagggcacctttgc

SEQ ID NO: 56771 - DNA, 20 bp, Homo sapiens
gatctctcagcagaatagat

SEQ ID NO: 56772 - DNA, 20 bp, Homo sapiens
gatcatccaggtgctttatg

SEQ ID NO: 56773 - DNA, 20 bp, Homo sapiens
gatctcttagcagaatagat

SEQ ID NO: 56774 - DNA, 20 bp, Homo sapiens
gatccggaatgcagtaacct

SEQ ID NO: 56775 - DNA, 20 bp, Homo sapiens
gatcaacgaccggatacggc

SEQ ID NO: 56776 - DNA, 20 bp, Homo sapiens
gatccagtccacatagttgg

SEQ ID NO: 56777 - DNA, 20 bp, Homo sapiens
gatccagataaactttcctg

SEQ ID NO: 56778 - DNA, 20 bp, Homo sapiens
gatcccactcttagctggta

SEQ ID NO: 56779 - DNA, 20 bp, Homo sapiens
gatctgcagaacacctttag

SEQ ID NO: 56780 - DNA, 20 bp, Homo sapiens
gatctgcatgcacatttctg

SEQ ID NO: 56781 - DNA, 20 bp, Homo sapiens
gatcttaaaaatatgattca

SEQ ID NO: 56782 - DNA, 20 bp, Homo sapiens
gatctttcatacaccctttt

SEQ ID NO: 56783 - DNA, 20 bp, Homo sapiens
gatccagggagacctgggtt

SEQ ID NO: 56784 - DNA, 20 bp, Homo sapiens
gatcaatgaacaatggctgc

SEQ ID NO: 56785 - DNA, 20 bp, Homo sapiens
gatcagcgtggcacctgtgg

SEQ ID NO: 56786 - DNA, 20 bp, Homo sapiens
gatcccagtcgcataccagg

SEQ ID NO: 56787 - DNA, 20 bp, Homo sapiens
gatccgctgcactgggtttg

SEQ ID NO: 56788 - DNA, 20 bp, Homo sapiens
gatcctgggtggacacctgg

SEQ ID NO: 56789 - DNA, 20 bp, Homo sapiens
gatcttaagctttgataaga

SEQ ID NO: 56790 - DNA, 20 bp, Homo sapiens
gatcaaggtgaaggagaaca

SEQ ID NO: 56791 - DNA, 20 bp, Homo sapiens
gatcaatcatgacgacttac

SEQ ID NO: 56792 - DNA, 20 bp, Homo sapiens
gatcacctggtgaaacacgg

SEQ ID NO: 56793 - DNA, 20 bp, Homo sapiens
gatcatctccagactgcatt

SEQ ID NO: 56794 - DNA, 20 bp, Homo sapiens
gatccaggaatatgtggact

SEQ ID NO: 56795 - DNA, 20 bp, Homo sapiens
gatcttcaccaaaccggtgc

SEQ ID NO: 56796 - DNA, 20 bp, Homo sapiens
gatccactcccggaagtcac

SEQ ID NO: 56797 - DNA, 20 bp, Homo sapiens
gatcccagccgcgtaccagg

SEQ ID NO: 56798 - DNA, 20 bp, Homo sapiens
gatcctaagctttgataaga

SEQ ID NO: 56799 - DNA, 20 bp, Homo sapiens
gatctttttttaaatgcagt

SEQ ID NO: 56800 - DNA, 20 bp, Homo sapiens
gatcaagggggacaaagtct

SEQ ID NO: 56801 - DNA, 20 bp, Homo sapiens
gatcagaaagacactgttgt

SEQ ID NO: 56802 - DNA, 20 bp, Homo sapiens
gatcaaatggaaaggagagg

SEQ ID NO: 56803 - DNA, 20 bp, Homo sapiens
gatcactcacatggaccccc

SEQ ID NO: 56804 - DNA, 20 bp, Homo sapiens
gatccaatttgtctgcaatg

SEQ ID NO: 56805 - DNA, 20 bp, Homo sapiens
gatccatggggcttgaatgg

SEQ ID NO: 56806 - DNA, 20 bp, Homo sapiens
gatcggacaatgtaaggtaa

SEQ ID NO: 56807 - DNA, 20 bp, Homo sapiens
gatctctcttctcaggccat

SEQ ID NO: 56808 - DNA, 20 bp, Homo sapiens
gatctgtgtaccgactccct

SEQ ID NO: 56809 - DNA, 20 bp, Homo sapiens
gatcaaggagaagatagtgg

SEQ ID NO: 56810 - DNA, 20 bp, Homo sapiens
gatctcaaatttaaacactt

SEQ ID NO: 56811 - DNA, 20 bp, Homo sapiens
gatccctttgctggcccctg

SEQ ID NO: 56812 - DNA, 20 bp, Homo sapiens
gatcctggaatttctctact

SEQ ID NO: 56813 - DNA, 20 bp, Homo sapiens
gatcggaagagagatggctt

SEQ ID NO: 56814 - DNA, 20 bp, Homo sapiens
gatctccagggcacattcct

SEQ ID NO: 56815 - DNA, 20 bp, Homo sapiens
gatcaagtttcagcaggcag

SEQ ID NO: 56816 - DNA, 20 bp, Homo sapiens
gatcacaaaagcacttcttc

SEQ ID NO: 56817 - DNA, 20 bp, Homo sapiens
gatcacaccaatgaggttca

SEQ ID NO: 56818 - DNA, 20 bp, Homo sapiens
gatccaggtgaccttgagca

SEQ ID NO: 56819 - DNA, 20 bp, Homo sapiens
gatctagtcaaaatgtagtc

SEQ ID NO: 56820 - DNA, 20 bp, Homo sapiens
gatcttggcccaaaccagcc

SEQ ID NO: 56821 - DNA, 20 bp, Homo sapiens
gatcacacctcagtgggaag

SEQ ID NO: 56822 - DNA, 20 bp, Homo sapiens
gatcaggggagaccccaact

SEQ ID NO: 56823 - DNA, 20 bp, Homo sapiens
gatcattccatcctttggga

SEQ ID NO: 56824 - DNA, 20 bp, Homo sapiens
gatcggtggcttcttagccc

SEQ ID NO: 56825 - DNA, 20 bp, Homo sapiens
gatcctatataagtaaataa

SEQ ID NO: 56826 - DNA, 20 bp, Homo sapiens
gatccacccgacttggcctc

SEQ ID NO: 56827 - DNA, 20 bp, Homo sapiens
gatcagcaagctggatgccc

SEQ ID NO: 56828 - DNA, 20 bp, Homo sapiens
gatcccacagagggggtgac

SEQ ID NO: 56829 - DNA, 20 bp, Homo sapiens
gatctgcgacctcctggtgg

SEQ ID NO: 56830 - DNA, 20 bp, Homo sapiens
gatcagcttctgccccttca

SEQ ID NO: 56831 - DNA, 20 bp, Homo sapiens
gatcatcaccaggggcttac

SEQ ID NO: 56832 - DNA, 20 bp, Homo sapiens
gatccgttctgtagtctttc

SEQ ID NO: 56833 - DNA, 20 bp, Homo sapiens
gatctagtgtttggaacgga

SEQ ID NO: 56834 - DNA, 20 bp, Homo sapiens
gatctcagtgaagaaagaaa

SEQ ID NO: 56835 - DNA, 20 bp, Homo sapiens
gatcaacaggaagaacatgg

SEQ ID NO: 56836 - DNA, 20 bp, Homo sapiens
gatcaccctgtggaacaggg

SEQ ID NO: 56837 - DNA, 20 bp, Homo sapiens
gatcactggcgacaagagag

SEQ ID NO: 56838 - DNA, 20 bp, Homo sapiens
gatccccacttcatcatcca

SEQ ID NO: 56839 - DNA, 20 bp, Homo sapiens
gatccccgtccacatagtag

SEQ ID NO: 56840 - DNA, 20 bp, Homo sapiens
gatcgaggtagacatcttcg

SEQ ID NO: 56841 - DNA, 20 bp, Homo sapiens
gatcgtggtggccgggcgcc

SEQ ID NO: 56842 - DNA, 20 bp, Homo sapiens
gatctgcccattaactgtga

SEQ ID NO: 56843 - DNA, 20 bp, Homo sapiens
gatcttctccgttgtcacct

SEQ ID NO: 56844 - DNA, 20 bp, Homo sapiens
gatcacctttgagctggtct

SEQ ID NO: 56845 - DNA, 20 bp, Homo sapiens
gatcagcaggccctccggaa

SEQ ID NO: 56846 - DNA, 20 bp, Homo sapiens
gatcaggatttgaggtggct

SEQ ID NO: 56847 - DNA, 20 bp, Homo sapiens
gatccagctgtgtctcgtgt

SEQ ID NO: 56848 - DNA, 20 bp, Homo sapiens
gatccatgagaacccagcct

SEQ ID NO: 56849 - DNA, 20 bp, Homo sapiens
gatccccagagcacctcctg

SEQ ID NO: 56850 - DNA, 20 bp, Homo sapiens
gatcctggatgacctcagcc

SEQ ID NO: 56851 - DNA, 20 bp, Homo sapiens
gatcgaagtgaccttcaaga

SEQ ID NO: 56852 - DNA, 20 bp, Homo sapiens
gatctccagcagcatcagat

SEQ ID NO: 56853 - DNA, 20 bp, Homo sapiens
gatccacccaaatatcaaac

SEQ ID NO: 56854 - DNA, 20 bp, Homo sapiens
gatctcagttgcgacctcgc

SEQ ID NO: 56855 - DNA, 20 bp, Homo sapiens
gatctccatgactgtgtgtt

SEQ ID NO: 56856 - DNA, 20 bp, Homo sapiens
gatctttcaccattttattt

SEQ ID NO: 56857 - DNA, 20 bp, Homo sapiens
gatctttcctctgcttgaga

SEQ ID NO: 56858 - DNA, 20 bp, Homo sapiens
gatcagtcttgatgttctaa

SEQ ID NO: 56859 - DNA, 20 bp, Homo sapiens
gatcatcacgaataggggaa

SEQ ID NO: 56860 - DNA, 20 bp, Homo sapiens
gatcatgaaactaattacca

SEQ ID NO: 56861 - DNA, 20 bp, Homo sapiens
gatcattcccagtggttgac

SEQ ID NO: 56862 - DNA, 20 bp, Homo sapiens
gatctttatttcacccagag

SEQ ID NO: 56863 - DNA, 20 bp, Homo sapiens
gatcagatggcgaataaaaa

SEQ ID NO: 56864 - DNA, 20 bp, Homo sapiens
gatcagtgccctctgctccg

SEQ ID NO: 56865 - DNA, 20 bp, Homo sapiens
gatccagctgtgacctccaa

SEQ ID NO: 56866 - DNA, 20 bp, Homo sapiens
gatccccatgcctagcagag

SEQ ID NO: 56867 - DNA, 20 bp, Homo sapiens
gatctgcttgttgcatttcc

SEQ ID NO: 56868 - DNA, 20 bp, Homo sapiens
gatcatgaggactgcacaaa

SEQ ID NO: 56869 - DNA, 20 bp, Homo sapiens
gatcttcctgttgctgttgg

SEQ ID NO: 56870 - DNA, 20 bp, Homo sapiens
gatcaaagagcccgaagcaa

SEQ ID NO: 56871 - DNA, 20 bp, Homo sapiens
gatctaagataaataaacaa

SEQ ID NO: 56872 - DNA, 20 bp, Homo sapiens
gatctgaccattggccttcg

SEQ ID NO: 56873 - DNA, 20 bp, Homo sapiens
gatctgtcacctatggaatc

SEQ ID NO: 56874 - DNA, 20 bp, Homo sapiens
gatcttcaaaataaaaagtc

SEQ ID NO: 56875 - DNA, 20 bp, Homo sapiens
gatctttgggactgagaaat

SEQ ID NO: 56876 - DNA, 20 bp, Homo sapiens
gatcacctcgaaaatcagga

SEQ ID NO: 56877 - DNA, 20 bp, Homo sapiens
gatcagatgagatttaatga

SEQ ID NO: 56878 - DNA, 20 bp, Homo sapiens
gatctttcgctttgatgttt

SEQ ID NO: 56879 - DNA, 20 bp, Homo sapiens
gatcagcagcccagaccccg

SEQ ID NO: 56880 - DNA, 20 bp, Homo sapiens
gatctggaacgcgcggtgga

SEQ ID NO: 56881 - DNA, 20 bp, Homo sapiens
gatcgccaacataatcccaa

SEQ ID NO: 56882 - DNA, 20 bp, Homo sapiens
gatctcattcagtcctgaac

SEQ ID NO: 56883 - DNA, 20 bp, Homo sapiens
gatccctgccgccctggttc

SEQ ID NO: 56884 - DNA, 20 bp, Homo sapiens
gatctgtatcctggtatttt

SEQ ID NO: 56885 - DNA, 20 bp, Homo sapiens
gatcatttatggaatcttcc

SEQ ID NO: 56886 - DNA, 20 bp, Homo sapiens
gatcctgacaatgtatcaca

SEQ ID NO: 56887 - DNA, 20 bp, Homo sapiens
gatcacagggaggttatttt

SEQ ID NO: 56888 - DNA, 20 bp, Homo sapiens
gatccctctcagcttctttg

SEQ ID NO: 56889 - DNA, 20 bp, Homo sapiens
gatctatccagctgcttcct

SEQ ID NO: 56890 - DNA, 20 bp, Homo sapiens
gatctcagccccgtattgtc

SEQ ID NO: 56891 - DNA, 20 bp, Homo sapiens
gatccttctaacatgctgtt

SEQ ID NO: 56892 - DNA, 20 bp, Homo sapiens
gatctttactgagtcagaag

SEQ ID NO: 56893 - DNA, 20 bp, Homo sapiens
gatcagccagggcgccgggc

SEQ ID NO: 56894 - DNA, 20 bp, Homo sapiens
gatccaggagagactccaca

SEQ ID NO: 56895 - DNA, 20 bp, Homo sapiens
gatcccagtgaacaggcagc

SEQ ID NO: 56896 - DNA, 20 bp, Homo sapiens
gatctgtcgcagccgatgct

SEQ ID NO: 56897 - DNA, 20 bp, Homo sapiens
gatcagccaagatttatagt

SEQ ID NO: 56898 - DNA, 20 bp, Homo sapiens
gatcctggcccagtgcctgc

SEQ ID NO: 56899 - DNA, 20 bp, Homo sapiens
gatcaggaaggacattaaac

SEQ ID NO: 56900 - DNA, 20 bp, Homo sapiens
gatccctgagagaattgatt

SEQ ID NO: 56901 - DNA, 20 bp, Homo sapiens
gatcctgggctgcattcgag

SEQ ID NO: 56902 - DNA, 20 bp, Homo sapiens
gatcgaagagagaatgaaaa

SEQ ID NO: 56903 - DNA, 20 bp, Homo sapiens
gatccagccggccttgggag

SEQ ID NO: 56904 - DNA, 20 bp, Homo sapiens
gatcaacatgataacattgc

SEQ ID NO: 56905 - DNA, 20 bp, Homo sapiens
gatccaatactagaagttgt

SEQ ID NO: 56906 - DNA, 20 bp, Homo sapiens
gatctgaaaataaagtgtca

SEQ ID NO: 56907 - DNA, 20 bp, Homo sapiens
gatccagtaccactctttgg

SEQ ID NO: 56908 - DNA, 20 bp, Homo sapiens
gatctttttctcaacgtgac

SEQ ID NO: 56909 - DNA, 20 bp, Homo sapiens
gatccgtgtgtgaggtggga

SEQ ID NO: 56910 - DNA, 20 bp, Homo sapiens
gatctgccacaaagacatct

SEQ ID NO: 56911 - DNA, 20 bp, Homo sapiens
gatctcttgaactctgggtt

SEQ ID NO: 56912 - DNA, 20 bp, Homo sapiens
gatctgggaaacagggaacg

SEQ ID NO: 56913 - DNA, 20 bp, Homo sapiens
gatctgtgaccagaacctga

SEQ ID NO: 56914 - DNA, 20 bp, Homo sapiens
gatccacggtgaggaacaaa

SEQ ID NO: 56915 - DNA, 20 bp, Homo sapiens
gatcagtgacacacctctcc

SEQ ID NO: 56916 - DNA, 20 bp, Homo sapiens
gatcgagaacataattagtg

SEQ ID NO: 56917 - DNA, 20 bp, Homo sapiens
gatctacccagtggccgagt

SEQ ID NO: 56918 - DNA, 20 bp, Homo sapiens
gatcacctcaatggccatgg

SEQ ID NO: 56919 - DNA, 20 bp, Homo sapiens
gatccagggaggctggtcct

SEQ ID NO: 56920 - DNA, 20 bp, Homo sapiens
gatccccgtggctctgccaa

SEQ ID NO: 56921 - DNA, 20 bp, Homo sapiens
gatcttatttctctagaggg

SEQ ID NO: 56922 - DNA, 20 bp, Homo sapiens
gatcttttttgtcagtttgt

SEQ ID NO: 56923 - DNA, 20 bp, Homo sapiens
gatcctccaccccaaacagc

SEQ ID NO: 56924 - DNA, 20 bp, Homo sapiens
gatcaccttaaacaaacact

SEQ ID NO: 56925 - DNA, 20 bp, Homo sapiens
gatcactaacagcaccaaca

SEQ ID NO: 56926 - DNA, 20 bp, Homo sapiens
gatcatgtagcaattaagtg

SEQ ID NO: 56927 - DNA, 20 bp, Homo sapiens
gatctagagccagttacttt

SEQ ID NO: 56928 - DNA, 20 bp, Homo sapiens
gatctgacaggaaatagact

SEQ ID NO: 56929 - DNA, 20 bp, Homo sapiens
gatcaaacaaagaaacaggt

SEQ ID NO: 56930 - DNA, 20 bp, Homo sapiens
gatctccttgccctagatga

SEQ ID NO: 56931 - DNA, 20 bp, Homo sapiens
gatcattactccaaagttgt

SEQ ID NO: 56932 - DNA, 20 bp, Homo sapiens
gatcagcggcgttccaagct

SEQ ID NO: 56933 - DNA, 20 bp, Homo sapiens
gatctgcctgccccctgaat

SEQ ID NO: 56934 - DNA, 20 bp, Homo sapiens
gatccatttggagccaagac

SEQ ID NO: 56935 - DNA, 20 bp, Homo sapiens
gatcccaactgctcctgcac

SEQ ID NO: 56936 - DNA, 20 bp, Homo sapiens
gatctcaagcgataaatgga

SEQ ID NO: 56937 - DNA, 20 bp, Homo sapiens
gatcaggtgaggctggagtt

SEQ ID NO: 56938 - DNA, 20 bp, Homo sapiens
gatctccgaatggacctcag

SEQ ID NO: 56939 - DNA, 20 bp, Homo sapiens
gatcccttactatttagaat

SEQ ID NO: 56940 - DNA, 20 bp, Homo sapiens
gatctggtcgagtttaaaac

SEQ ID NO: 56941 - DNA, 20 bp, Homo sapiens
gatcaaaaggagaaatgata

SEQ ID NO: 56942 - DNA, 20 bp, Homo sapiens
gatctgcagctgaggccatg

SEQ ID NO: 56943 - DNA, 20 bp, Homo sapiens
gatctttttctcaatgtgac

SEQ ID NO: 56944 - DNA, 20 bp, Homo sapiens
gatccgcatcgactgggagg

SEQ ID NO: 56945 - DNA, 20 bp, Homo sapiens
gatcactggcaagtggtttt

SEQ ID NO: 56946 - DNA, 20 bp, Homo sapiens
gatcagcaagtgagcgaaat

SEQ ID NO: 56947 - DNA, 20 bp, Homo sapiens
gatcaggacagagacttggg

SEQ ID NO: 56948 - DNA, 20 bp, Homo sapiens
gatccaagcaaccttctttt

SEQ ID NO: 56949 - DNA, 20 bp, Homo sapiens
gatccaaggctgtgtcctgc

SEQ ID NO: 56950 - DNA, 20 bp, Homo sapiens
gatcccattgtgtgccaacc

SEQ ID NO: 56951 - DNA, 20 bp, Homo sapiens
gatcctcagggacaccaaga

SEQ ID NO: 56952 - DNA, 20 bp, Homo sapiens
gatcgtgtcctctgtcttgt

SEQ ID NO: 56953 - DNA, 20 bp, Homo sapiens
gatctcctgaaccgacttat

SEQ ID NO: 56954 - DNA, 20 bp, Homo sapiens
gatctgggcttccagcagag

SEQ ID NO: 56955 - DNA, 20 bp, Homo sapiens
gatctttctcagagagtacc

SEQ ID NO: 56956 - DNA, 20 bp, Homo sapiens
gatccggtccagggtggcgt

SEQ ID NO: 56957 - DNA, 20 bp, Homo sapiens
gatcactagtgttcccagag

SEQ ID NO: 56958 - DNA, 20 bp, Homo sapiens
gatcgaggagaataaaagac

SEQ ID NO: 56959 - DNA, 20 bp, Homo sapiens
gatccaactatttctttcat

SEQ ID NO: 56960 - DNA, 20 bp, Homo sapiens
gatccatgtctgatgtactg

SEQ ID NO: 56961 - DNA, 20 bp, Homo sapiens
gatcgcagctttgcccagtt

SEQ ID NO: 56962 - DNA, 20 bp, Homo sapiens
gatctccatcaacagattca

SEQ ID NO: 56963 - DNA, 20 bp, Homo sapiens
gatcagtgtggtgattttaa

SEQ ID NO: 56964 - DNA, 20 bp, Homo sapiens
gatctaaagctcttgaaaat

SEQ ID NO: 56965 - DNA, 20 bp, Homo sapiens
gatctcatgcatcccaatat

SEQ ID NO: 56966 - DNA, 20 bp, Homo sapiens
gatcaatgcctgagtaacct

SEQ ID NO: 56967 - DNA, 20 bp, Homo sapiens
gatccttgccttgaagcaaa

SEQ ID NO: 56968 - DNA, 20 bp, Homo sapiens
gatcttttcagtgttttttc

SEQ ID NO: 56969 - DNA, 20 bp, Homo sapiens
gatcaaaacaatatggtact

SEQ ID NO: 56970 - DNA, 20 bp, Homo sapiens
gatcactgtagctttgtagt

SEQ ID NO: 56971 - DNA, 20 bp, Homo sapiens
gatccaggagggagccaccc

SEQ ID NO: 56972 - DNA, 20 bp, Homo sapiens
gatctcttagagacactcct

SEQ ID NO: 56973 - DNA, 20 bp, Homo sapiens
gatctggttggtggatgcac

SEQ ID NO: 56974 - DNA, 20 bp, Homo sapiens
gatcaccttgttcaccctcc

SEQ ID NO: 56975 - DNA, 20 bp, Homo sapiens
gatcactactgctcttggag

SEQ ID NO: 56976 - DNA, 20 bp, Homo sapiens
gatcctgtatgaattaagca

SEQ ID NO: 56977 - DNA, 20 bp, Homo sapiens
gatcgccgggtgcaatttgg

SEQ ID NO: 56978 - DNA, 20 bp, Homo sapiens
gatccagaaaagagatatga

SEQ ID NO: 56979 - DNA, 20 bp, Homo sapiens
gatcgttgtctggattcctg

SEQ ID NO: 56980 - DNA, 20 bp, Homo sapiens
gatcccagaattaacctgat

SEQ ID NO: 56981 - DNA, 20 bp, Homo sapiens
gatcaaatattccccgtgag

SEQ ID NO: 56982 - DNA, 20 bp, Homo sapiens
gatcactattttcttgaccc

SEQ ID NO: 56983 - DNA, 20 bp, Homo sapiens
gatcctgagacaggagacct

SEQ ID NO: 56984 - DNA, 20 bp, Homo sapiens
gatcttttctatttatttgt

SEQ ID NO: 56985 - DNA, 20 bp, Homo sapiens
gatcagaagtacttcgcatc

SEQ ID NO: 56986 - DNA, 20 bp, Homo sapiens
gatctgatgttcaggaaaag

SEQ ID NO: 56987 - DNA, 20 bp, Homo sapiens
gatccaagttttgcggggtc

SEQ ID NO: 56988 - DNA, 20 bp, Homo sapiens
gatccagtcgaggtagcggc

SEQ ID NO: 56989 - DNA, 20 bp, Homo sapiens
gatccatgggcacatcagag

SEQ ID NO: 56990 - DNA, 20 bp, Homo sapiens
gatcaggtaggggattacct

SEQ ID NO: 56991 - DNA, 20 bp, Homo sapiens
gatccggagggcccaggaga

SEQ ID NO: 56992 - DNA, 20 bp, Homo sapiens
gatcttcaagatatgtctga

SEQ ID NO: 56993 - DNA, 20 bp, Homo sapiens
gatcatgaactaactgaaac

SEQ ID NO: 56994 - DNA, 20 bp, Homo sapiens
gatctgtttaaaccagagtg

SEQ ID NO: 56995 - DNA, 20 bp, Homo sapiens
gatctgggacgtggttcggc

SEQ ID NO: 56996 - DNA, 20 bp, Homo sapiens
gatcagggggccacctgagt

SEQ ID NO: 56997 - DNA, 20 bp, Homo sapiens
gatccaccccagcttcgtgc

SEQ ID NO: 56998 - DNA, 20 bp, Homo sapiens
gatccgcctcgagggtttgg

SEQ ID NO: 56999 - DNA, 20 bp, Homo sapiens
gatccgttccacgctgcgcc

SEQ ID NO: 57000 - DNA, 20 bp, Homo sapiens
gatctttggacagaagcagc

SEQ ID NO: 57001 - DNA, 20 bp, Homo sapiens
gatcagaaagaaaccttttg

SEQ ID NO: 57002 - DNA, 20 bp, Homo sapiens
gatcagcctgtactgcctgg

SEQ ID NO: 57003 - DNA, 20 bp, Homo sapiens
gatccagtggtcatcatttc

SEQ ID NO: 57004 - DNA, 20 bp, Homo sapiens
gatcgtccacaacggttact

SEQ ID NO: 57005 - DNA, 20 bp, Homo sapiens
gatcgtcgacacagactacg

SEQ ID NO: 57006 - DNA, 20 bp, Homo sapiens
gatctgccatcgcagtaacc

SEQ ID NO: 57007 - DNA, 20 bp, Homo sapiens
gatccctgtacacgtggtgt

SEQ ID NO: 57008 - DNA, 20 bp, Homo sapiens
gatccttacttaggacacca

SEQ ID NO: 57009 - DNA, 20 bp, Homo sapiens
gatctgtgcagaggacaaat

SEQ ID NO: 57010 - DNA, 20 bp, Homo sapiens
gatcttcagaggaggggtgc

SEQ ID NO: 57011 - DNA, 20 bp, Homo sapiens
gatcaaagtctattttgcat

SEQ ID NO: 57012 - DNA, 20 bp, Homo sapiens
gatcggcggcggccgcgccg

SEQ ID NO: 57013 - DNA, 20 bp, Homo sapiens
gatcaaggacatctctcttg

SEQ ID NO: 57014 - DNA, 20 bp, Homo sapiens
gatcagaggagataagacac

SEQ ID NO: 57015 - DNA, 20 bp, Homo sapiens
gatcagcgatgccagagaga

SEQ ID NO: 57016 - DNA, 20 bp, Homo sapiens
gatcaggctgccaatgaatg

SEQ ID NO: 57017 - DNA, 20 bp, Homo sapiens
gatctgtgctgtagctgagc

SEQ ID NO: 57018 - DNA, 20 bp, Homo sapiens
gatcacttctgcggcccagg

SEQ ID NO: 57019 - DNA, 20 bp, Homo sapiens
gatcagcaatgccagagaga

SEQ ID NO: 57020 - DNA, 20 bp, Homo sapiens
gatcaggctgccaataaatg

SEQ ID NO: 57021 - DNA, 20 bp, Homo sapiens
gatcggccagcgagtcctcc

SEQ ID NO: 57022 - DNA, 20 bp, Homo sapiens
gatctgtgctctcctagccc

SEQ ID NO: 57023 - DNA, 20 bp, Homo sapiens
gatcaagaaaggtatgagag

SEQ ID NO: 57024 - DNA, 20 bp, Homo sapiens
gatcaacgattacgtggaga

SEQ ID NO: 57025 - DNA, 20 bp, Homo sapiens
gatcacccaaccttcaacaa

SEQ ID NO: 57026 - DNA, 20 bp, Homo sapiens
gatcacccccaacctggctg

SEQ ID NO: 57027 - DNA, 20 bp, Homo sapiens
gatcataggttccagtaatg

SEQ ID NO: 57028 - DNA, 20 bp, Homo sapiens
gatcatggtgggatgtatct

SEQ ID NO: 57029 - DNA, 20 bp, Homo sapiens
gatccatgaaggcttccagg

SEQ ID NO: 57030 - DNA, 20 bp, Homo sapiens
gatccccagggagatgctgc

SEQ ID NO: 57031 - DNA, 20 bp, Homo sapiens
gatcctcagccagggagaca

SEQ ID NO: 57032 - DNA, 20 bp, Homo sapiens
gatctgaagagcgtcctggg

SEQ ID NO: 57033 - DNA, 20 bp, Homo sapiens
gatctgagcctccggaatct

SEQ ID NO: 57034 - DNA, 20 bp, Homo sapiens
gatctgtttcttggcctctt

SEQ ID NO: 57035 - DNA, 20 bp, Homo sapiens
gatcaagagagggctccact

SEQ ID NO: 57036 - DNA, 20 bp, Homo sapiens
gatctatgaagaaacctctg

SEQ ID NO: 57037 - DNA, 20 bp, Homo sapiens
gatcctggagggcctgggat

SEQ ID NO: 57038 - DNA, 20 bp, Homo sapiens
gatcctggcctctgtccact

SEQ ID NO: 57039 - DNA, 20 bp, Homo sapiens
gatcgtgccgtggcccagtt

SEQ ID NO: 57040 - DNA, 20 bp, Homo sapiens
gatcagatctgtgattttcc

SEQ ID NO: 57041 - DNA, 20 bp, Homo sapiens
gatcagggaggatgaagagt

SEQ ID NO: 57042 - DNA, 20 bp, Homo sapiens
gatccctgacaggtcagcct

SEQ ID NO: 57043 - DNA, 20 bp, Homo sapiens
gatcttttccaccagcaccc

SEQ ID NO: 57044 - DNA, 20 bp, Homo sapiens
gatcaacagctatgtcaaga

SEQ ID NO: 57045 - DNA, 20 bp, Homo sapiens
gatcatgatgatgaagggct

SEQ ID NO: 57046 - DNA, 20 bp, Homo sapiens
gatcccacagaaatgttttg

SEQ ID NO: 57047 - DNA, 20 bp, Homo sapiens
gatccctggttcccaaagtc

SEQ ID NO: 57048 - DNA, 20 bp, Homo sapiens
gatctttcatgttgttgatt

SEQ ID NO: 57049 - DNA, 20 bp, Homo sapiens
gatcagatgttttctcagat

SEQ ID NO: 57050 - DNA, 20 bp, Homo sapiens
gatccacttcttctttgcca

SEQ ID NO: 57051 - DNA, 20 bp, Homo sapiens
gatcccggaggccaccaacc

SEQ ID NO: 57052 - DNA, 20 bp, Homo sapiens
gatcgacaaggcccatgtct

SEQ ID NO: 57053 - DNA, 20 bp, Homo sapiens
gatctgttcagccctgaaaa

SEQ ID NO: 57054 - DNA, 20 bp, Homo sapiens
gatcttctgttctgagccct

SEQ ID NO: 57055 - DNA, 20 bp, Homo sapiens
gatcacagtgaacgaggaag

SEQ ID NO: 57056 - DNA, 20 bp, Homo sapiens
gatccagcgtcttaacatcc

SEQ ID NO: 57057 - DNA, 20 bp, Homo sapiens
gatcccatgagctccttaag

SEQ ID NO: 57058 - DNA, 20 bp, Homo sapiens
gatccttccctgcctcggtt

SEQ ID NO: 57059 - DNA, 20 bp, Homo sapiens
gatctcgaggagccgtggga

SEQ ID NO: 57060 - DNA, 20 bp, Homo sapiens
gatcccagcaagaggcagat

SEQ ID NO: 57061 - DNA, 20 bp, Homo sapiens
gatctacacagctgccacaa

SEQ ID NO: 57062 - DNA, 20 bp, Homo sapiens
gatctctaaaagtgtctgat

SEQ ID NO: 57063 - DNA, 20 bp, Homo sapiens
gatctctcagcaaacaaccc

SEQ ID NO: 57064 - DNA, 20 bp, Homo sapiens
gatcttgtccttgctcgttg

SEQ ID NO: 57065 - DNA, 20 bp, Homo sapiens
gatccggaatccgcctggtt

SEQ ID NO: 57066 - DNA, 20 bp, Homo sapiens
gatcactgtgcgaaagctct

SEQ ID NO: 57067 - DNA, 20 bp, Homo sapiens
gatcagaactgtaaagctat

SEQ ID NO: 57068 - DNA, 20 bp, Homo sapiens
gatcataagatagcaaaacc

SEQ ID NO: 57069 - DNA, 20 bp, Homo sapiens
gatcctggtgcttagttcat

SEQ ID NO: 57070 - DNA, 20 bp, Homo sapiens
gatctttaacatgttagtga

SEQ ID NO: 57071 - DNA, 20 bp, Homo sapiens
gatcatgtaccagatggcct

SEQ ID NO: 57072 - DNA, 20 bp, Homo sapiens
gatcatttgtattgcaatgg

SEQ ID NO: 57073 - DNA, 20 bp, Homo sapiens
gatcgccaccgttcttctgg

SEQ ID NO: 57074 - DNA, 20 bp, Homo sapiens
gatctgcctggtgaatgctg

SEQ ID NO: 57075 - DNA, 20 bp, Homo sapiens
gatcctatggtagggcctcc

SEQ ID NO: 57076 - DNA, 20 bp, Homo sapiens
gatcgccctgctggctgccg

SEQ ID NO: 57077 - DNA, 20 bp, Homo sapiens
gatctgttgccatgctcaaa

SEQ ID NO: 57078 - DNA, 20 bp, Homo sapiens
gatcatgaggtcagaagata

SEQ ID NO: 57079 - DNA, 20 bp, Homo sapiens
gatccaggcgctgcccgtgc

SEQ ID NO: 57080 - DNA, 20 bp, Homo sapiens
gatcactggaacttttaaac

SEQ ID NO: 57081 - DNA, 20 bp, Homo sapiens
gatcaaagccagccaccccc

SEQ ID NO: 57082 - DNA, 20 bp, Homo sapiens
gatcagagcctccaggttcc

SEQ ID NO: 57083 - DNA, 20 bp, Homo sapiens
gatccccacattgaagccct

SEQ ID NO: 57084 - DNA, 20 bp, Homo sapiens
gatcaaacttattaggaatt

SEQ ID NO: 57085 - DNA, 20 bp, Homo sapiens
gatcaaatctaatgtaagaa

SEQ ID NO: 57086 - DNA, 20 bp, Homo sapiens
gatcaatccttcttatgttt

SEQ ID NO: 57087 - DNA, 20 bp, Homo sapiens
gatcactttgttaaaaatat

SEQ ID NO: 57088 - DNA, 20 bp, Homo sapiens
gatcaggtgaaaccttttta

SEQ ID NO: 57089 - DNA, 20 bp, Homo sapiens
gatcagtgctccagttggtg

SEQ ID NO: 57090 - DNA, 20 bp, Homo sapiens
gatcatatagcgtgggttat

SEQ ID NO: 57091 - DNA, 20 bp, Homo sapiens
gatcccctggttcatggtgg

SEQ ID NO: 57092 - DNA, 20 bp, Homo sapiens
gatcagcctgcagccatccc

SEQ ID NO: 57093 - DNA, 20 bp, Homo sapiens
gatcacttgtgtattttata

SEQ ID NO: 57094 - DNA, 20 bp, Homo sapiens
gatcatcctattattgtaaa

SEQ ID NO: 57095 - DNA, 20 bp, Homo sapiens
gatcctccaaattccaagca

SEQ ID NO: 57096 - DNA, 20 bp, Homo sapiens
gatcgtgtgcatttcttcgt

SEQ ID NO: 57097 - DNA, 20 bp, Homo sapiens
gatctacaagaaaataagtt

SEQ ID NO: 57098 - DNA, 20 bp, Homo sapiens
gatcttactatgatttgaaa

SEQ ID NO: 57099 - DNA, 20 bp, Homo sapiens
gatctattgggaatgctaaa

SEQ ID NO: 57100 - DNA, 20 bp, Homo sapiens
gatcaaacagctaatttgac

SEQ ID NO: 57101 - DNA, 20 bp, Homo sapiens
gatcatatagtctaacctta

SEQ ID NO: 57102 - DNA, 20 bp, Homo sapiens
gatccatacaaattaaagtg

SEQ ID NO: 57103 - DNA, 20 bp, Homo sapiens
gatcatatattctaatctta

SEQ ID NO: 57104 - DNA, 20 bp, Homo sapiens
gatctgagcactatcagaat

SEQ ID NO: 57105 - DNA, 20 bp, Homo sapiens
gatcagaagaaaaatcacag

SEQ ID NO: 57106 - DNA, 20 bp, Homo sapiens
gatcagtttcaatctgtaat

SEQ ID NO: 57107 - DNA, 20 bp, Homo sapiens
gatcctccaactttttaaat

SEQ ID NO: 57108 - DNA, 20 bp, Homo sapiens
gatctgaacatacagagccc

SEQ ID NO: 57109 - DNA, 20 bp, Homo sapiens
gatcaccctgggtagagagt

SEQ ID NO: 57110 - DNA, 20 bp, Homo sapiens
gatcagagatgcagaggttt

SEQ ID NO: 57111 - DNA, 20 bp, Homo sapiens
gatcccagacttttttaaat

SEQ ID NO: 57112 - DNA, 20 bp, Homo sapiens
gatcccatgactcaactcac

SEQ ID NO: 57113 - DNA, 20 bp, Homo sapiens
gatcccttccttgttaaaag

SEQ ID NO: 57114 - DNA, 20 bp, Homo sapiens
gatctgccatcttctcttgg

SEQ ID NO: 57115 - DNA, 20 bp, Homo sapiens
gatcttatatggagaatgac

SEQ ID NO: 57116 - DNA, 20 bp, Homo sapiens
gatcttctctatggttcttc

SEQ ID NO: 57117 - DNA, 20 bp, Homo sapiens
gatcaattaaaggatattta

SEQ ID NO: 57118 - DNA, 20 bp, Homo sapiens
gatcctcctcattcacatcg

SEQ ID NO: 57119 - DNA, 20 bp, Homo sapiens
gatcgacttgccaaatttag

SEQ ID NO: 57120 - DNA, 20 bp, Homo sapiens
gatcttatcaatataaatgt

SEQ ID NO: 57121 - DNA, 20 bp, Homo sapiens
gatcaactgtgagtgatagg

SEQ ID NO: 57122 - DNA, 20 bp, Homo sapiens
gatcgcaggtagtgatagcc

SEQ ID NO: 57123 - DNA, 20 bp, Homo sapiens
gatcaaccactgcagatttg

SEQ ID NO: 57124 - DNA, 20 bp, Homo sapiens
gatcagggttttttccccca

SEQ ID NO: 57125 - DNA, 20 bp, Homo sapiens
gatcatctgcgttcccatct

SEQ ID NO: 57126 - DNA, 20 bp, Homo sapiens
gatcatgaatggagaagctg

SEQ ID NO: 57127 - DNA, 20 bp, Homo sapiens
gatccacagactttctatta

SEQ ID NO: 57128 - DNA, 20 bp, Homo sapiens
gatccatgagtttgccctgg

SEQ ID NO: 57129 - DNA, 20 bp, Homo sapiens
gatccatgggctaagaatct

SEQ ID NO: 57130 - DNA, 20 bp, Homo sapiens
gatcttattgtagagcaggc

SEQ ID NO: 57131 - DNA, 20 bp, Homo sapiens
gatcttggcgatgcagtctt

SEQ ID NO: 57132 - DNA, 20 bp, Homo sapiens
gatcaatttctcattacccc

SEQ ID NO: 57133 - DNA, 20 bp, Homo sapiens
gatcgctggcaccatagcct

SEQ ID NO: 57134 - DNA, 20 bp, Homo sapiens
gatctctcccactaacagag

SEQ ID NO: 57135 - DNA, 20 bp, Homo sapiens
gatcggtgcgaggcgccccc

SEQ ID NO: 57136 - DNA, 20 bp, Homo sapiens
gatcaggcagctttattcca

SEQ ID NO: 57137 - DNA, 20 bp, Homo sapiens
gatcccaagttagaccaggg

SEQ ID NO: 57138 - DNA, 20 bp, Homo sapiens
gatcaaaccattcctgactg

SEQ ID NO: 57139 - DNA, 20 bp, Homo sapiens
gatcattgctttcacttgtg

SEQ ID NO: 57140 - DNA, 20 bp, Homo sapiens
gatctaacacaagcaaaaat

SEQ ID NO: 57141 - DNA, 20 bp, Homo sapiens
gatcaaaacatacaagaaaa

SEQ ID NO: 57142 - DNA, 20 bp, Homo sapiens
gatcaaagacaccagagggg

SEQ ID NO: 57143 - DNA, 20 bp, Homo sapiens
gatcaattgcaaccatctgc

SEQ ID NO: 57144 - DNA, 20 bp, Homo sapiens
gatcagatggacaatgcaaa

SEQ ID NO: 57145 - DNA, 20 bp, Homo sapiens
gatcaggatgacatgtgcca

SEQ ID NO: 57146 - DNA, 20 bp, Homo sapiens
gatcccaaagagaaaaccac

SEQ ID NO: 57147 - DNA, 20 bp, Homo sapiens
gatccttaaccaataatggt

SEQ ID NO: 57148 - DNA, 20 bp, Homo sapiens
gatcgttttggggtagccac

SEQ ID NO: 57149 - DNA, 20 bp, Homo sapiens
gatcaaaaagaatggaagct

SEQ ID NO: 57150 - DNA, 20 bp, Homo sapiens
gatcaaccagtgaagcccct

SEQ ID NO: 57151 - DNA, 20 bp, Homo sapiens
gatcatgttgaattcttgat

SEQ ID NO: 57152 - DNA, 20 bp, Homo sapiens
gatcattaattactgtcttc

SEQ ID NO: 57153 - DNA, 20 bp, Homo sapiens
gatcgagcagtcttctggat

SEQ ID NO: 57154 - DNA, 20 bp, Homo sapiens
gatccaaagtatgctgagta

SEQ ID NO: 57155 - DNA, 20 bp, Homo sapiens
gatccatttcatgcaggatt

SEQ ID NO: 57156 - DNA, 20 bp, Homo sapiens
gatcattaattactctcttc

SEQ ID NO: 57157 - DNA, 20 bp, Homo sapiens
gatcagccctcaccctcttc

SEQ ID NO: 57158 - DNA, 20 bp, Homo sapiens
gatcatcttcaacccctcgg

SEQ ID NO: 57159 - DNA, 20 bp, Homo sapiens
gatccagagaccctgagcct

SEQ ID NO: 57160 - DNA, 20 bp, Homo sapiens
gatcgcatcttgggttcttc

SEQ ID NO: 57161 - DNA, 20 bp, Homo sapiens
gatcacaccctctgcttcct

SEQ ID NO: 57162 - DNA, 20 bp, Homo sapiens
gatctggggtgtgtggctga

SEQ ID NO: 57163 - DNA, 6491 bp, Homo sapiens
ccgccccggcgcccaggctcggtgctggagagtcatgcctgtgagccctgggcacctcctgatgtcctgcgaggtcacggtgttcccaaacctcagggttgccctgccccactccagaggctctcaggccccaccccggagccctctgtgcggagccgcctcctcctggccagttccccagtagtcctgaagggagacctgctgtgtggagcctcttctgggacccagccatgagtgtggagctgagcaactgaacctgaaactcttccactgtgagtcaaggaggcttttccgcacatgaaggacgctgagcgggaaggactcctctctgcctgcagttgtagcgagtggaccagcaccaggggctctctagactgcccctcctccatcgccttccctgcctctccaggacagagcagccacgtctgcacacctcgccctctttacactcagttttcagagcacgtttctcctatttcctgcgggttgcagcgcctacttgaacttactcagaccacctacttctctagcagcactgggcgtccctttcagcaagacgatggctgtgctcaggcagctggcgctcctcctctggaagaactacaccctgcagaagcggaaggtcctggtgacggtcctggaactcttcctgccattgctgtttcctgggatcctcatctggctccgcttgaagattcagtcggaaaatgtgcccaacgccaccatctacccgggccagtccatccaggagctgcctctgttcttcaccttccctccgccaggagacacctgggagcttgcctacatcccttctcacagtgacgctgccaagaccgtcactgagacagtgcgcagggcacttgtgatcaacatgcgagtgcgcggctttccctccgagaaggactttgaggactacattaggtacgacaactgctcgtccagcgtgctggccgccgtggtcttcgagcaccccttcaaccacagcaaggagcccctgccgctggcggtgaaatatcacctacggttcagttacacacggagaaattacatgtggacccaaacaggctcctttttcctgaaagagacagaaggctggcacactacttcccttttcccgcttttcccaaacccaggaccaagggaactaacatcccctgatggcggagaacctgggtacatccgggaaggcttcctggccgtgcagcatgctgtggaccgggccatcatggagtaccatgccgatgccgccacacgccagctgttccagagactgacggtgaccatcaagaggttcccgtacccgccgttcatcgcagaccccttcctcgtggccatccagtaccagctgcccctgctgctgctgctcagcttcacctacaccgcgctcaccattgcccgtgctgtcgtgcaggagaaggaaaggaggctgaaggagtacatgcgcatgatggggctcagcagctggctgcactggagtgcctggttcctcttgttcttcctcttcctcctcatcgccgcctccttcatgaccctgctcttctgtgtcaaggtgaagccaaatgtagccgtgctgtcccgcagcgacccctccctggtgctcgccttcctgctgtgcttcgccatctctaccatctccttcagcttcatggtcagcaccttcttcagcaaagccaacatggcagcagccttcggaggcttcctctacttcttcacctacatcccctacttcttcgtggcccctcggtacaactggatgactctgagccagaagctctgctcctgcctcctgtctaatgtcgccatggcaatgggagcccagctcattgggaaatttgaggcgaaaggcatgggcatccagtggcgagacctcctgagtcccgtcaacgtggacgacgacttctgcttcgggcaggtgctggggatgctgctgctggactctgtgctctatggcctggtgacctggtacatggaggccgtcttcccagggcagttcggcgtgcctcagccctggtacttcttcatcatgccctcctattggtgtgggaagccaagggcggttgcagggaaggaggaagaagacagtgaccccgagaaagcactcagaaacgagtactttgaagccgagccagaggacctggtggcggggatcaagatcaagcacctgtccaaggtgttcagggtgggaaataaggacagggcggccgtcagagacctgaacctcaacctgtacgagggacagatcaccgtcctgctgggccacaacggtgccgggaagaccaccaccctctccatgctcacaggtctctttccccccaccagtggacgggcatacatcagcgggtatgaaatttcccaggacatggttcagatccggaagagcctgggcctgtgcccgcagcacgacatcctgtttgacaacttgacagtcgcagagcacctttatttctacgcccagctgaagggcctgtcacgtcagaagtgccctgaagaagtcaagcagatgctgcacatcatcggcctggaggacaagtggaactcacggagccgcttcctgagcgggggcatgaggcgcaagctctccatcggcatcgccctcatcgcaggctccaaggtgctgatactggacgagcccacctcgggcatggacgccatctccaggagggccatctgggatcttcttcagcggcagaaaagtgaccgcaccatcgtgctgaccacccacttcatggacgaggctgacctgctgggagaccgcatcgccatcatggccaagggggagctgcagtgctgcgggtcctcgctgttcctcaagcagaaatacggtgccggctatcacatgacgctggtgaaggagccgcactgcaacccggaagacatctcccagctggtccaccaccacgtgcccaacgccacgctggagagcagcgctggggccgagctgtctttcatccttcccagagagagcacgcacaggtttgaaggtctctttgctaaactggagaagaagcagaaagagctgggcattgccagctttggggcatccatcaccaccatggaggaagtcttccttcgggtcgggaagctggtggacagcagtatggacatccaggccatccagctccctgccctgcagtaccagcacgagaggcgcgccagcgactgggctgtggacagcaacctctgtggggccatggacccctccgacggcattggagccctcatcgaggaggagcgcaccgctgtcaagctcaacactgggctcgccctgcactgccagcaattctgggccatgttcctgaagaaggccgcatacagctggcgcgagtggaaaatggtggcggcacaggtcctggtgcctctgacctgcgtcaccctggccctcctggccatcaactactcctcggagctcttcgacgaccccatgctgaggctgaccttgggcgagtacggcagaaccgtcgtgcccttctcagttcccgggacctcccagctgggtcagcagctgtcagagcatctgaaagacgcactgcaggctgagggacaggagccccgcgaggtgctcggtgacctggaggagttcttgatcttcagggcttctgtggaggggggcggctttaatgagcggtgccttgtggcagcgtccttcagagatgtgggagagcgcacggtcgtcaacgccttgttcaacaaccaggcgtaccactctccagccactgccctggccgtcgtggacaaccttctgttcaagctgctgtgcgggcctcacgcctccattgtggtctccaacttcccccagccccggagcgccctgcaggctgccaaggaccagtttaacgagggccggaagggattcgacattgccctcaacctgctcttcgccatggcattcttggccagcacgttctccatcctggcggtcagcgagagggccgtgcaggccaagcatgtgcagtttgtgagtggagtccacgtggccagtttctggctctctgctctgctgtgggacctcatctccttcctcatccccagtctgctgctgctggtggtgtttaaggccttcgacgtgcgtgccttcacgcgggacggccacatggctgacaccctgctgctgctcctgctctacggctgggccatcatccccctcatgtacctgatgaacttcttcttcttgggggcggccactgcctacacgaggctgaccatcttcaacatcctgtcaggcatcgccaccttcctgatggtcaccatcatgcgcatcccagctgtaaaactggaagaactttccaaaaccctggatcacgtgttcctggtgctgcccaaccactgtctggggatggcagtcagcagtttctacgagaactacgagacgcggaggtactgcacctcctccgaggtcgccgcccactactgcaagaaatataacatccagtaccaggagaacttctatgcctggagcgccccgggggtcggccggtttgtggcctccatggccgcctcagggtgcgcctacctcatcctgctcttcctcatcgagaccaacctgcttcagagactcaggggcatcctctgcgccctccggaggaggcggacactgacagaattatacacccggatgcctgtgcttcctgaggaccaagatgtagcggacgagaggacccgcatcctggcccccagcccggactccctgctccacacacctctgattatcaaggagctctccaaggtgtacgagcagcgggtgcccctcctggccgtggacaggctctccctcgcggtgcagaaaggggagtgcttcggcctgctgggcttcaatggagccgggaagaccacgactttcaaaatgctgaccggggaggagagcctcacttctggggatgcctttgtcgggggtcacagaatcagctctgatgtcggaaaggtgcggcagcggatcggctactgcccgcagtttgatgccttgctggaccacatgacaggccgggagatgctggtcatgtacgctcggctccggggcatccctgagcgccacatcggggcctgcgtggagaacactctgcggggcctgctgctggagccacatgccaacaagctggtcaggacgtacagtggtggtaacaagcggaagctgagcaccggcatcgccctgatcggagagcctgctgtcatcttcctggacgagccgtccactggcatggaccccgtggcccggcgcctgctttgggacaccgtggcacgagcccgagagtctggcaaggccatcatcatcacctcccacagcatggaggagtgtgaggccctgtgcacccggctggccatcatggtgcaggggcagttcaagtgcctgggcagcccccagcacctcaagagcaagttcggcagcggctactccctgcgggccaaggtgcagagtgaagggcaacaggaggcgctggaggagttcaaggccttcgtggacctgacctttccaggcagcgtcctggaagatgagcaccaaggcatggtccattaccacctgccgggccgtgacctcagctgggcgaaggttttcggtattctggagaaagccaaggaaaagtacggcgtggacgactactccgtgagccagatctcgctggaacaggtcttcctgagcttcgcccacctgcagccgcccaccgcagaggaggggcgatgaggggtggcggctgtctcgccatcaggcagggacaggacgggcaagcagggcccatcttacatcctctctctccaagtttatctcatcctttatttttaatcacttttttctatgatggatatgaaaaattcaaggcagtatgcacagaatggacgagtgcagcccagccctcatgcccaggatcagcatgcgcatctccatgtctgcatactctggagttcactttcccagagctggggcaggccgggcagtctgcgggcaagctccggggtctctgggtggagagctgacccaggaagggctgcagctgagctgggggttgaatttctccaggcactccctggagagaggacccagtgacttgtccaagtttacacacgacactaatctcccctggggaggaagcgggaagccagccaggttgaactgtagcgaggcccccaggccgccaggaatggaccatgcagatcactgtcagtggagggaagctgctgactgtgattaggtgctggggtcttagcgtccagcgcagcccgggggcatcctggaggctctgctcccttagggcatggtagtcaccgcgaagccgggcaccgtcccacagcatctcctagaagcagccggcacaggagggaaggtggccaggctcgaagcagtctctgtttccagcactgcaccctcaggaagtcgcccgccccaggacacgcagggaccaccctaagggctgggtggctgtctcaaggacacattgaatacgttgtgaccatccagaaaataaatgctgaggggacacaaaaaaaaaaaaaaaaaaaaaaaa

SEQ ID NO: 57164 - DNA, 4028 bp, Homo sapiens
acagggtcgctgagaccagtgcacgagcctcttcggaagatgcatcctggactcttggccgcagaggagaaagcggttggggtctcccagggactctttctaaagggtcagtccagcatggtaggggttaacgtgggtccacgcgtagagggaaaggaaagaagttgtagttgacacttcaggggggcgggtggcggacgggtctcgctgcctgattggttttgcatttcatcccaatttttttttctccactctctctccctcttttcagtttctctctctgatcccaggggaggggaaacgggaatagtgagagatcaaaaataaacctcttatgtcaagccgggaaggaagtataaataagaagggctcggcagcccactcggtgcttcccggggtggggaggaggcaggaggcggctgcgcggggctggcgcgggcaggggcggaggacgggcgcacgcgggccggggccagctgctcgcgctcggctcgggggcggcggcgcgggaggagcgggctgcgccagccagaggggccgccgggggagcgctcccgccgccgggccccgcgggccgagtcggccttgcacccgattgattccgcttttcctggagagagcggccgggccgcgctcgggccgccagcacctgcccgcgcctggcgggcttcttccctctcctgcgcgcagccaccgccgcagcccccatgctccccgcccccgccgccccccggtggcctccgctcctgctgctgctgctgctgctgctgccgctggcccgcggcgccccggcccggcccgcagccggggggcaggcctcggagctggtggtgcccacgcggttgcccggcagcgcgggcgagctcgcgctccacctgtccgccttcggcaagggcttcgtgctgcgcctggcgcccgacgacagcttcctagcgcccgagttcaagatcgagcgcctcgggggctccggccgggcgaccgggggcgagcgggggctgcgcggctgcttcttctccggcaccgtgaatggggagcccgagtcgctggcggcggtcagcctgtgccgcgggctgagcggctccttcctgctggacggcgaggagttcaccatccagccgcagggcgcggggggctccctggctcagccgcaccgcctgcagcgctggggtcccgccggagcccgccccctcccgcgaggacccgagtgggaggtggagacgggagagggtcagaggcaggagagaggagaccaccaggaggacagcgaggaggagagccaagaagaggaggcagaaggcgctagcgagccgccaccgcccctgggggccacgagtaggaccaagcggtttgtgtctgaggcgcgcttcgtggagacgctgctggtggccgatgcgtccatggctgccttctacggggccgacctgcagaaccacatcctgacgttaatgtctgtggcagcccgaatctacaagcaccccagcatcaagaattccatcaacctgatggtggtaaaagtgctgatcgtagaagatgaaaaatggggcccagaggtgtccgacaatggggggcttacactgcgtaacttctgcaactggcagcggcgtttcaaccagcccagcgaccgccacccagagcactacgacacggccatcctgctcaccagacagaacttctgtgggcaggaggggctgtgtgacaccctgggtgtggcagacatcgggaccatttgtgaccccaacaaaagctgctccgtgatcgaggatgaggggctccaggcggcccacaccctggcccatgaactagggcacgtcctcagcatgccccacgacgactccaagccctgcacacggctcttcgggcccatgggcaagcaccacgtgatggcaccgctgttcgtccacctgaaccagacgctgccctggtccccctgcagcgccatgtatctcacagagcttctggacggcgggcacggagactgtctcctggatgcccctggtgcggccctgcccctccccacaggcctcccgggccgcatggccctgtaccagctggaccagcagtgcaggcagatctttgggccggatttccgccactgccccaacacctctgctcaggacgtctgcgcccagctttggtgccacactgatggggctgagcccctgtgccacacgaagaatggcagcctgccctgggctgacggcacgccgtgcgggcctgggcacctctgctcagaaggcagctgtctacctgaggaggaagtggagaggcccaagcccgtggtagatggaggctgggcaccgtggggaccctggggagaatgttctcggacctgtggaggaggagtacagttttcacaccgtgagtgcaaggaccccgagcctcagaatggaggaagatactgcctgggtcggagagccaagtaccagtcatgccacacggaggaatgcccccctgacgggaaaagcttcagggagcagcagtgtgagaagtataatgcctacaattacactgacatggacgggaatctcctgcagtgggtccccaagtatgctggggtgtccccccgggaccgctgcaagttgttctgccgagcccgggggaggagcgagttcaaagtgttcgaggccaaggtgattgatggcaccctgtgtgggccagaaacactggccatctgtgtccgtggccagtgtgtcaaggccggctgtgaccatgtggtggactcgcctcggaagctggacaaatgcggggtgtgtgggggcaaaggcaactcctgcaggaaggtctccgggtccctcacccccaccaattatggctacaatgacattgtcaccatcccagctggtgccactaatattgacgtgaagcagcggagccacccgggtgtgcagaacgatgggaactacctggcgctgaagacggctgatgggcagtacctgctcaacggcaacctggccatctctgccatagagcaggacatcttggtgaaggggaccatcctgaagtacagcggctccatcgccaccctggagcgcctgcagagcttccggcccttgccagagcctctgacagtgcagctcctgacagtccctggcgaggtcttccccccaaaagtcaaatacaccttctttgttcctaatgacgtggactttagcatgcagagcagcaaagagagagcaaccaccaacatcatccagccgctgctccacgcacagtgggtgctgggggactggtctgagtgctctagcacctgcggggccggctggcagaggcgaactgtagagtgcagggacccctccggccaggcctctgccacctgcaacaaggctctgaaacccgaggatgccaagccctgcgaaagccagctgtgccccctgtgattcaggggggcaggggccagtcttgtgctcctggacatgcggtactgaggtgcagacaagggtctccactgtggtgactgggtcccttggccatatcaaggcagcacggcccacccaggcctcccattgccgcaacccctccagtactgcacaaattcctaagggggaagaggagagggtatggggcggcagaccctatcatcaactgtccagtggactggaccttgctcgggttcaagtagagggcataggttaaaaggtaaaagtgcacttattgactcagacaggacactcagcgtcagtctgtttgcaaaggactagcaaacttaaatgaaaaaaaaaattctatctggtttccccgataaataatctacctcacaggggaaaaaattagtacaagagaggcgtggggcagggagtcaatggtgaatgtcaaagcaggctccaaagctggaccccaagctgtcttcaagaatgaccacgactgtcttcagtgttaaaatccatcacctaaagggccgcagcgtcgcagggtttggagagccacatgttctcaggctgccacctgcaggggtggatccatttcaagtatttatgcaaatgtgtctctgaactaaagtgtgatcttatgccaaaaaaaaaaaaaaaaaa

SEQ ID NO: 57165 - DNA, 2580 bp, Homo sapiens
tcgggccccgcggccgcctttataaggcggcgggggtggtggcccgggccgcgttgcgctcccgccactccgcgcccgctatcctggctccgtgctcccacgcgcttgtgcctggacggaccctcgccagtgctctgcgcaggattggaacatcagttaacatctgaccactgccagcccaccccctcccacccacgtcgattgcatctctgggctccagggataaagcaggtcttggggtgcaccatgatttcaccattcttagtactggccattggcacctgccttactaactccttagtgccagagaaagagaaagaccccaagtactggcgagaccaagcgcaagagacactgaaatatgccctggagcttcagaagctcaacaccaacgtggctaagaatgtcatcatgttcctgggagatgggatgggtgtctccacagtgacggctgcccgcatcctcaagggtcagctccaccacaaccctggggaggagaccaggctggagatggacaagttccccttcgtggccctctccaagacgtacaacaccaatgcccaggtccctgacagcgccggcaccgccaccgcctacctgtgtggggtgaaggccaatgagggcaccgtgggggtaagcgcagccactgagcgttcccggtgcaacaccacccaggggaacgaggtcacctccatcctgcgctgggccaaggacgctgggaaatctgtgggcattgtgaccaccacgagagtgaaccatgccacccccagcgccgcctacgcccactcggctgaccgggactggtactcagacaacgagatgccccctgaggccttgagccagggctgtaaggacatcgcctaccagctcatgcataacatcagggacattgacgtgatcatggggggtggccggaaatacatgtaccccaagaataaaactgatgtggagtatgagagtgacgagaaagccaggggcacgaggctggacggcctggacctcgttgacacctggaagagcttcaaaccgagatacaagcactcccacttcatctggaaccgcacggaactcctgacccttgacccccacaatgtggactacctattgggtctcttcgagccaggggacatgcagtacgagctgaacaggaacaacgtgacggacccgtcactctccgagatggtggtggtggccatccagatcctgcggaagaaccccaaaggcttcttcttgctggtggaaggaggcagaattgaccacgggcaccatgaaggaaaagccaagcaggccctgcatgaggcggtggagatggaccgggccatcgggcaggcaggcagcttgacctcctcggaagacactctgaccgtggtcactgcggaccattcccacgtcttcacatttggtggatacaccccccgtggcaactctatctttggtctggcccccatgctgagtgacacagacaagaagcccttcactgccatcctgtatggcaatgggcctggctacaaggtggtgggcggtgaacgagagaatgtctccatggtggactatgctcacaacaactaccaggcgcagtctcctgtgcccctgcgccacgagacccacggcggggaggacgtggccgtcttctccaagggccccatggcgcacctgctgcacggcgtccacgagcagaactacgtcccccacgtgatggcgtatgcagcctgcatcggggccaacctcggccactgtgctcctgccagctcggcaggcagccttgctgcaggccccctgctgctcgctctggccctctaccccctgagcgtcctgttctgagggcccagggcccgggcacccacaagcccgtgacagatgccaacttcccacacggcagcccccccctcaaggggcagggaggtgggggcctcctcagcctctgcaactgcaagaaaggggacccaggaaaccaaagtctgccgcccacctcgctcccctctggaatcttccccaagggccaaacccacttctggcctccagcctttgctccctccccgctgccctttggccaccagggtagatttctcttgggcaggcagagagtacagactgcagacattctcaaagcctcttatttttctagcgaacgtatttctccagacccagaggccctgaagcctccgtggaacattgtggatctgaccctcccagtctcatctcctgaccctcccactcccatctccttacctctggaaccccccaggccctacaatgctcatgtccctgtccccaggcgagccctccttcaggggagttgaggtctttctcctcaggacaaggccttgctcactcactcactccaagaccaccagggtcccaggaagccggtgcctgggtggccatcctacccagcgtgcccaggccgggaagagccacctggcagggctcacactcctgggctctgaacacacacgccagctcctctctgaagcgactctcctgtttggaacggcaaaaaaaaatttttttttctctttttggtggtggttaaaagggaacacaaaacatttaaataaaactttccaaatatttccgagg

SEQ ID NO: 57166 - DNA, 885 bp, Homo sapiens
agcctacgcacgaaagtgactagggaggaaggatattataaagtgatgcaaacagaaattccaccagcctccatgtatcatcatgtgtcataactcagtcaagctcagtgagcattctcagcacattgcctcaacagcttcaaggtgagccagctcaagactttgctctccaccaggcagaagatgacagactgtgaatttggatatatttacaggctggctcaggactatctgcagtgcgtcctacagataccacaacctggatcaggtccaagcaaaacgtccagagtgctacaaaatgttgcgttctcagtccaaaaagaagtggaaaagaatctgaagtcatgcttggacaatgttaatgttgtgtccgtagacactgccagaacactattcaaccaagtgatggaaaaggagtttgaagacggcatcattaactggggaagaattgtaaccatatttgcatttgaaggtattctcatcaagaaacttctacgacagcaaattgccccggatgtggatacctataaggagatttcatattttgttgcggagttcataatgaataacacaggagaatggataaggcaaaacggaggctgggaaaatggctttgtaaagaagtttgaacctaaatctggctggatgacttttctagaagttacaggaaagatctgtgaaatgctatctctcctgaagcaatactgttgaccagaaaggacactccatattgtgaaaccggcctaatttttctgactgatatggaaacgattgccaacacatacttctacttttaaataaacaactttgatgatgtaacttgaccttccagagttatggaaattttgtccccatgtaatgaataaattgtatgtatttttctct

SEQ ID NO: 57167 - DNA, 3646 bp, Homo sapiens
agagaaagaggcaactacattgcctggaggaagcctaaggaacccaggcatccagctgcccacgcccgagtccaagattcttcccaggaacacaaacgtaggagacccacgctcctggaagcaccagcctttatctcttcaccttcaagtcccctttctcaagaatcctctgttctttgccctctaaagtcttggtacatctaggacccaggcatcttgctttccagccacaaagagacagatgaagatgcagaaaggaaatgttctccttatgtttggtctactattgcatttagaagctgcaacaaattccaatgagactagcacctctgccaacactggatccagtgtgatctccagtggagccagcacagccaccaactctgggtccagtgtgacctccagtggggtcagcacagccaccatctcagggtccagcgtgacctccaatggggtcagcatagtcaccaactctgagttccatacaacctccagtgggatcagcacagccaccaactctgagttcagcacagcgtccagtgggatcagcatagccaccaactctgagtccagcacaacctccagtggggccagcacagccaccaactctgagtccagcacaccctccagtggggccagcacagccaccaactctgactccagcacaacctccagtggggctagcacagccaccaactctgactccagcacaacctccagtgaggccagcacagccaccaactctgagtccagcacaacctccagtggggccagcacagccaccaactctgagtccagcacagtgtccagtagggccagcactgccaccaactctgagtccagcacaacctccagtggggccagcacagccaccaactctgagtccagaacgacctccaatggggctggcacagccaccaactctgagtccagcacgacctccagtggggccagcacagccaccaactctgagtccagcacaccctccagtggggccggcacagccaccaactctgagtccagcacgacctccagtggggccggcacagccaccaactctgagtccagcacagtgtccagtgggatcagcacagtcaccaattctgagtccagcacaccctccagtggggccaacacagccaccaactctgagtccagtacaacctccagtggggccaacacagccaccaactctgactccagcacaacctccagtggggccagcacagccaccaactctgagtccagcacgacctccagtggggccagcacagccaccaactctgagtccagcacaacctccagtggggccagcacagccaccaactctgggtccagcacgacctccagtgggaccagcacagccaccaactctgagtccagcacagtgtccagtggggccagcacagccaccacctctgagtccagcacgacctccagtggggccagcacagccaccaactctgagtccagcacagtgtccagtggggccagcactgccaccaattctgagtccagcacaacctccagtggggccaacacagccaccaactctgggtccagtgtgacctctgcaggctctggaacagcagctctgactggaatgcacacaacttcccatagtgcatctactgcagtgagtgaggcgaagcctggtgggtccctggtgccgtgggaaatcttcctcatcaccctggtctcggttgtggcggccgtggggctctttgctgggctcttcttctgtgtgagaaacagcctgtccctgagaaacacctttaacacagctgtctaccaccctcatggcctcaaccatggccttggtccaggccctggagggaatcatggagccccccacaggcccaggtggagtcctaactggttctggaggagaccagtatcctcgatagccatggagatgagcgggaggaacagcgggccctgagcagccccggaagcaagtgccgcattcttcaggaaggaagagacctgggcacccaagacctggtttcctttcattcatcccaggagacccctcccagctttgtttgagatcctgaaaatcttgaagaaggtattcctcacctttcttgcctttaccagacactggaaagagaatactatattgctcatttagctaagaaataaatacatctcatctaacacacacgacaaagagaagctgtgcgtgccccggggtgggtatctagctctgagatgaactcagttataggagaaaacctccatgctggactccatctggcattcaaaatctccacagtaaaatccaaagacctcattcttatctgtgtgtctgcattttctaatcctttttgccccaggcaaggtccctgtatctctgagacaccccgattggctggagaattgacttgggagagataaggagggagggcgggtgccagcatgctatgggctcctgcgtgaggcctgtggtacacagagattaggttgtgatacatgaagagccaagagcaggatgaggtggaggcgttacaactacctgctctgtgtgtggggggggaggggggaggggggtacgcatattcacttgaagtcgaggttcccagggcatttccatgtgctccaggcctgactacccatcagggtggaggagctggtgacactcatctccctgagtgctccctggtttcccaagggaaagactttctggcctgctgaggtcgaatcttccaagaggctcttgcaaagacccgagattctcataaatccccgcccagaagagctgcacgtatccctttcatgagtccagggaagagggtcctccaggtcttggaagacagaggggagctgctttagaggctaagttgctttgagcccacaaggtaatggagggctcctacttgggacagagccctcagcagagaattagcagtctgttggtgggttcaccccaactcacagcagtagaaactgctccatcttccaccacttattgggtttctccagtgtcagcaaaccaaagaattggatcttaccaatgcggctataggaaaacagcctgttgcatggtaagagtgataccatcttgaagtgaaaccaccacaatggccattttttttttagatggagttttgcagtggtgcaatcatagctcattgcagccttcaattcctgggctcaggcaatcctcctgcctcagcctcctgagtagctgggactacagtttcgtgtgccaccatgcctggctaatttttagaattttttgtagggacagggcctcactctgttgcacaagctggtcttgaactcctggcctccttgaactcctcctgccttggcctcccaaaatgctgagattacaggtgtgagccactgcacctcgccagatgtccaatgtctgactcctgcataccaaggtgttctgtatcaagggctttaaaacaatgcctgtagcgtaattaacctctcacaaagatgcttatctaacctccccagcagtcatgggtttcagcaagaaagtctgtgatgtgaccagttgcacatgttttcccctaaaagcttactctagaaaggatattttttggagagggagtgtgggaatccaccatcctgtggccacctcagacatcacttctctttggaagactccattaaatatttctctgtg

SEQ ID NO: 57168 - DNA, 5343 bp, Homo sapiens
gccccccctccccgcggcgccgcatcttgaatggaaacatggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactgcccagcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttcaaa

SEQ ID NO: 57169 - DNA, 5337 bp, Homo sapiens
gccccccctccccgcggcgccgcatcttgaatggaaacatggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttcaaa

SEQ ID NO: 57170 - DNA, 915 bp, Homo sapiens
ccgccgctgccaccgcctctgatccaagccacctcccgccaggtgagccccgagattctggctcagagaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcaggactatgtgcagatgaaggccagtgagctggagcaggagcaagagagagagggctccagaatcattgcccagaagagagcctgtgacactgccacctgtgtgactcatcggctggcaggcttgctgagcagatcagggggtgtggtgaagaacaactttgtgcccaccaatgtgggttccaaagcctttggcaggcgccgcagggaccttcaagcctgagcagctgaatgactcaagaaggtcacaataaagctgaactccttttaatgtgtaatgaaagcaatttgtaggaaaggctccatggaagacatacatataggcatccttcttgatactgaaaactatcttctttgtttgaaaggaactattgctaaatgcagaacaagctcattgcagttacctattgtgcatctttttaaatacttgattatgtaaccataaatctgacagcatgtctcattggcttatctggtagcaaatctaggccccgtcagccaccctattgacattggtggctctgctaaacctcagggggacatgaaatcactgcctcttgggcatctggggacacatggtaatgctgtgccttgacagaagtatttgtttaaagaaatgtcaatgctgtcatttgtgaactctatcaaaattaaaaatgtattttctatacccttc

SEQ ID NO: 57171 - DNA, 793 bp, Homo sapiens
aggagttgtgagtttccaagccccagctcactctgaccacttctctgcctgcccagcatcatgaagggccttgcagctgccctccttgtcctcgtctgcaccatggccctctgctcctgtgcacaagttggtaccaacaaagagctctgctgcctcgtctatacctcctggcagattccacaaaagttcatagttgactattctgaaaccagcccccagtgccccaagccaggtgtcatcctcctaaccaagagaggccggcagatctgtgctgaccccaataagaagtgggtccagaaatacatcagcgacctgaagctgaatgcctgaggggcctggaagctgcgagggcccagtgaacttggtgggcccaggagggaacaggagcctgagccagggcaatggccctgccaccctggaggccacctcttctaagagtcccatctgctatgcccagccacattaactaactttaatcttagtttatgcatcatatttcattttgaaattgatttctattgttgagctgcattatgaaattagtattttctctgacatctcatgacattgtctttatcatcctttcccctttcccttcaactcttcgtacattcaatgcatggatcaatcagtgtgattagctttctcagcagacattgtgccatatgtatcaaatgacaaatctttattgaatggttttgctcagcaccaccttttaatatattggcagtacttattatataaaaggtaaaccagcattctcactgtgaaaaaaaaaaaaaaaaaaaaaaaa

SEQ ID NO: 57172 - DNA, 1644 bp, Homo sapiens
tggacggctgcttcccaccagcaaagaccacgactggagagccgagccggaggcagctgggaaacatgaagagcgtcttgctgctgaccacgctcctcgtgcctgcacacctggtggccgcctggagcaataattatgcggtggactgccctcaacactgtgacagcagtgagtgcaaaagcagcccgcgctgcaagaggacagtgctcgacgactgtggctgctgccgagtgtgcgctgcagggcggggagaaacttgctaccgcacagtctcaggcatggatggcatgaagtgtggcccggggctgaggtgtcagccttctaatggggaggatccttttggtgaagagtttggtatctgcaaagactgtccctacggcaccttcgggatggattgcagagagacctgcaactgccagtcaggcatctgtgacagggggacgggaaaatgcctgaaattccccttcttccaatattcagtaaccaagtcttccaacagatttgtttctctcacggagcatgacatggcatctggagatggcaatattgtgagagaagaagttgtgaaagagaatgctgccgggtctcccgtaatgaggaaatggttaaatccacgctgatcccggctgtgatttctgagagaaggctctattttcgtgattgttcaacacacagccaacattttaggaactttctagattatagcataaggacatgtaatttttgaagaccaaatgtgatgcatggtggatccagaaaacaaaaagtaggatacttacaatccataacatccatatgactgaacacttgtatgtgtttgttaaatattcgaatgcatgtagatttgttaaatgtgtgtgtatagtaacactgaagaactaaaaatgcaatttaggtaatcttacatggagacaggtcaaccaaagagggagctaggcaaagctgaagaccgcagtgagtcaaattagttctttgactttgatgtacattaatgttgggatatggaatgaagacttaagagcaggagaagatggggagggggtgggagtgggaaataaaatatttagcccttccttggtaggtagcttctctagaatttaattgtgctttttttttttttttggctttgggaaaagtcaaaataaaacaaccagaaaacccctgaaggaagtaagatgtttgaagcttatggaaatttgagtaacaaacagctttgaactgagagcaatttcaaaaggctgctgatgtagttcccgggttacctgtatctgaaggacggttctggggcataggaaacacatacacttccataaatagctttaacgtatgccacctcagagataaatctaagaagtattttacccactggtggtttgtgtgtgtatgaaggtaaatatttatatatttttataaataaatgtgttagtgcaagtcatcttccctacccatatttatcatcctcttgaggaaagaaatctagtattatttgttgaaaatggttagaataaaactatgactctataaggttttcaaacatctgaggcatgataaatttattatccataattatagtaataataaccttaataagcataagaaaaacagagtcactctggatttcaaaaatgtcaaaaaaaaaaaaaa

SEQ ID NO: 57173 - DNA, 2128 bp, Homo sapiens
caagacttctctgcattttctgccaaaatctgtgtcagatttaagacacatgcttctgcaagcttccatgaaggttgtgcaaaaaagtttcaatccagagttgggttccagctttctgtagctgtaagcattggtggccacaccacctccttacaaagcaactagaacctgcggcatacattggagagatttttttaattttctggacatgaagtaaatttagagtgctttctaatttcaggtagaagacatgtccaccttctgattatttttggagaacattttgatttttttcatctctctctccccacccctaagattgtgcaaaaaaagcgtaccttgcctaattgaaataatttcattggattttgatcagaactgattatttggttttctgtgtgaagttttgaggtttcaaactttccttctggagaatgccttttgaaacaattttctctagctgcctgatgtcaactgcttagtaatcagtggatattgaaatattcaaaatgtacagagagtgggtagtggtgaatgttttcatgatgttgtacgtccagctggtgcagggctccagtaatgaacatggaccagtgaagcgatcatctcagtccacattggaacgatctgaacagcagatcagggctgcttctagtttggaggaactacttcgaattactcactctgaggactggaagctgtggagatgcaggctgaggctcaaaagttttaccagtatggactctcgctcagcatcccatcggtccactaggtttgcggcaactttctatgacattgaaacactaaaagttatagatgaagaatggcaaagaactcagtgcagccctagagaaacgtgcgtggaggtggccagtgagctggggaagagtaccaacacattcttcaagcccccttgtgtgaacgtgttccgatgtggtggctgttgcaatgaagagagccttatctgtatgaacaccagcacctcgtacatttccaaacagctctttgagatatcagtgcctttgacatcagtacctgaattagtgcctgttaaagttgccaatcatacaggttgtaagtgcttgccaacagccccccgccatccatactcaattatcagaagatccatccagatccctgaagaagatcgctgttcccattccaagaaactctgtcctattgacatgctatgggatagcaacaaatgtaaatgtgttttgcaggaggaaaatccacttgctggaacagaagaccactctcatctccaggaaccagctctctgtgggccacacatgatgtttgacgaagatcgttgcgagtgtgtctgtaaaacaccatgtcccaaagatctaatccagcaccccaaaaactgcagttgctttgagtgcaaagaaagtctggagacctgctgccagaagcacaagctatttcacccagacacctgcagctgtgaggacagatgcccctttcataccagaccatgtgcaagtggcaaaacagcatgtgcaaagcattgccgctttccaaaggagaaaagggctgcccaggggccccacagccgaaagaatccttgattcagcgttccaagttccccatccctgtcatttttaacagcatgctgctttgccaagttgctgtcactgtttttttcccaggtgttaaaaaaaaaatccattttacacagcaccacagtgaatccagaccaaccttccattcacaccagctaaggagtccctggttcattgatggatgtcttctagctgcagatgcctctgcgcaccaaggaatggagaggaggggacccatgtaatccttttgtttagttttgtttttgttttttggtgaatgagaaaggtgtgctggtcatggaatggcaggtgtcatatgactgattactcagagcagatgaggaaaactgtagtctctgagtcctttgctaatcgcaactcttgtgaattattctgattcttttttatgcagaatttgattcgtatgatcagtactgactttctgattactgtccagcttatagtcttccagtttaatgaactaccatctgatgtttcatatttaagtgtatttaaagaaaataaacaccattattcaagccaaaaaaaaaaaaaaaaaa

SEQ ID NO: 57174 - DNA, 2807 bp, Homo sapiens
gtgcgactagcggcggccggcgaagcccgcgccagccccgcgggtcgctgcggcatcctcccgccgcccagcccccgcacgctccctgcagtttaaaaggacctcccgccgcttctcggcgctgccccgggattccccagccccgcgcggctccctactccacttcgcagcaacttcggcgaccgcgcgccgcccgccctcgcccgcctttgaagtttgctgtgccgaccgcaaagttgggacacttcagcggattgaatttttctcttttatctgcctccgtccccgccctccaggcttctcgttcctggatattggtgcttagcatcttggcagggtccggggacgtggactatttcgcacaccacaccacggggagggatttttttctattttccctacgaaaaacagatctttttaaggatggtgctgctccactggtgcctgctgtggctcctgtttccactcagctcaaggacccagaagttacccacccgggatgaggaactttttcagatgcagatccgggacaaggcattttttcatgattcgtcagtaattccagatggagctgaaattagcagttatctctttagagatacacctaaaaggtatttctttgtggttgaagaagacaatactccattatcagtcacagtgacgccctgtgatgcgcctttggagtggaagctgagcctccaggagctgccagaggacaggagcggggaaggctcaggtgatctggaacctcttgagcagcagaagcagcagatcattaatgaggaaggcactgagttattctcctacaaaggcaatgatgttgagtattttatatcgtctagttccccatccggtttatatcagttggatcttctttcaacagagaaagacacacatttcaaagtatatgccaccacaactccagaatctgatcagccataccctgagttaccctatgacccaagagtagatgtgacctcactggggcgcaccacggtcactttggcctggaaaccaagccccactgcctctttgctgaaacaacccattcagtactgtgtggtcatcaacaaagagcacaatttcaaaagtctctgtgcagtggaagcaaaactgagtgcagatgatgcttttatgatggcaccgaaacctggtctggacttcagcccctttgactttgcccactttggatttccttctgataattcaggtaaagaacgcagtttccaggcaaagccttctccaaaactggggcgtcatgtctactccaggcccaaggttgatattcagaaaatctgcataggaaacaagaacatcttcaccgtctctgatctgaaacccgacacgcagtactactttgacgtatttgtggtcaacatcaacagcaacatgagcaccgcttatgtaggtacctttgccaggaccaaggaagaagccaaacagaagacagtcgagctcaaagatgggaagataacagatgtatttgttaaaaggaagggagcaaagtttctacggtttgctccagtctcttctcaccaaaaagtcaccttctttattcactcttgtctggatgctgtccaaatccaagtgagaagagatgggaaacttcttctgtctcagaatgtggaaggcattcagcagtttcagcttagaggaaaacctaaagctaaatacctcgttcgactgaaaggaaacaagaaaggagcatctatgttgaaaattctagctaccacaaggcctactaagcagtcatttccctctcttcctgaagacacaagaatcaaagcctttgacaagctccgtacctgttcctcggccaccgtggcttggctaggcactcaggaaaggaacaagttttgcatctacaaaaaagaagtggatgataactacaatgaagaccagaagaaaagagagcaaaaccaatgtctaggaccagatataaggaagaagtcagaaaaggtcctctgtaaatatttccacagtcaaaacctgcagaaagcagtgaccacagaaacaattaaaggtcttcagcctggcaaatcttacctgctggatgtttatgtcataggacatggggggcactctgtaaagtatcagagtaaggttgtgaaaactagaaagttctgttagttaccttcttatagagatatattatgtagaactccaggagggacattaaatcactttaagtataaactgactactcccacagttgagagaagttgtgacctgtacttgtactatggaaggaaggatatcaacgtgtgtatattgatgtttatataagtaactcttgaaggagacttgttctagcgtgccccatggtacctagtgtgtgtctgatgccggttggtgtcaaagatagagggcttcttgaaggaacttgccattccttgctttgaccactgcatgaactgcttctaaattattttattacctaaaaatttaaaatatgccattcattgcacacacccacaaatgcaaatcattcctctctatagatgctaggatatatataaattattttataaattcttgttttaaatgtcagtgtttctatgattgtaaactattaaattcttttcctattaaagtacagatctaatctaagtattattaagttgatagccctctagtcagttatattgctattgtaaattcttgtttgttgagtaaaatgtttaaatactatatgtatctcatgtacaaagttgacatacattatattcatgtacataaaattaaagagattagattatatactgttaaaaaaaaaaaaaaaaaaaaaaaaaaaaaaaaaaaaaaaa

SEQ ID NO: 57175 - DNA, 2211 bp, Homo sapiens
gcagatgcaggtgccggctgctgcagtgcagtagctgctggaggctggggaggcccggacccggtgcaggaagacgccgaccacgcgggctcctgatcgcgggcgcccacagcgcggacatggcgggctggtggccggcgttgtcgcgcgcggcccggcgccacccgtggcccaccaacgtgctgctttacggctcgctcgtctcggccggggacgcgctgcaacagcggctgcagggccgcgaggccaactggcgccagacgcggcgcgtggccacgttggtggtgaccttccacgccaacttcaactacgtgtggctgcgcctgctggagcgcgcgctcccgggccgagcgccgcacgccctgctggccaagttgctgtgcgaccaggtggtcggtgcgcccatcgcggtctcggccttctatgtcgagtggattgatgtactggccctttgtacagctgaccaacttcagccttgttcctgttcaatggagaacagcttacgctggagtctgtggttttctctgggccaccttcatctgtttttcccagcagagtggtgacggcacattcaagtcagctttcaccattttatatacaaaggggaccagtgccacagaagggtacccgaagaaatgagaagtcaaggactctcttaaagggaccacattttttacctaaaatgcacagaattgcctgcagacaaaatatttgatgtgccaattatgcacttcattttgaggaattactactatttatagacccactttttaaaaaattatcaatgattatttttgaattgtattcagacttttttcctgttctagtctgaaatattacttctctaatattttggttaatatgaataatagtggcaaaatggcattttagaattattaatatttctaatattttaacacaagtttcaggaaacttggttttgattgttcacatttctattctaaaatctcaggttatctcctgaacacttttgggcagatgaagttttataccaaaaaatagttcttagagtgaattttaatttacatagaactcaatcgaaatgaagatttaataaccagatttctttctccaaaacatacacaatttgttattttagtaaatacctttttttttttttttttttttgtggtggagtcttgctgtctccccggctggagcgcagtggcacgatcgcggctcactgcagcctccatcctctgggttcaagcaattctcctgcctcaggctcctgagtagctgggattacaggcacgtgacaccaggcccagctgatttttgtatttttgttcatttgcttttgtttttgacacagagtctcgctctgtcgcccaggctggaatgcagttgtgagatctcggctcactgcaagctccgcctcccgggttcacgccattctgcgtcagcctcccaagtagctgggactacaggcacctgccacgatgcctagctaattttttgtatttttagtagagatgaagtttcaccgtgttggccaggatggtcttgatctcctgaccgcataatccacccacctcggcctcccaaagtgctgggattacaggcgtgagccaccacaaccgacttttttttttttttttttgagacagagactcgctctgtcacccaggctggagtgcagtggcatgatttcggctcactgcaacctctgtctcctgggttcaaacgatcctactgcctcatccttcggagtagctgggattacaggcaggtgccaccatgcctggctcatttttgtatttttagtagagagggcgttttgccatgttggctaggctggtctctgtccgtcctctgagctcaagctaagccatcatatcccagtgacctgcacatatacatccagatggcctgaagttactgaagatccacagaagtgaaaatagccttaactgatgacattgcaccattgtgatatgttactgccccaccctaactgatcaatgtactttgtaatcctcccacccttaagaaggttctttttaattctccccacccttgagaatgtactttgtgagatccacccctgcccgcaaaacattgctccaaactccaccacctatccccaaacctgtaagaactaatgataatccaccaccctttgctgactccttttttggactcagcccgcctgcactcaggtgaaataaacagccatgttgctcatac

SEQ ID NO: 57176 - DNA, 4134 bp, Homo sapiens
ttctgcctggtatcattaaaaaggaggtgacaatttggcctaagaaaattcacggaatccattttgaaagaaaattatgagtggaaaacacctgagttgaaaagtggggaagtttctcaatctgcttactccaaggaaattcttaaaggaattataaacacttaacctaataagttaatttttaattgtaaaatagaccatcttcaattttttgaagagccctcgtgtggaggaatgcgatctcatggaaacagtggcctaaagaaagttctcctattgctttttacttccctttgcttgaaaaaagataaacagcatagaaacctccaagaggctaccgagttctctttgaacttttttctctgcagctgcgcctggaactgctccctgctgcactttactacctctgtttataagagcaacagtccctctcctgaaaattggactgaattccaacaagtcggcaacttgcatgaagacaagatgtactgcagtgccatgctgggtatcttaaagaacaaggcattgtcctctgcagacacccaggctgcagacttcaaggactggaagaagagctttgcgtcttctctcttctctatacagacacaatctgtagcagcaaatgtgttacagatggacagaagctggggaacatggatgaagctggaaaccatcattctcagcaaactaacagaggaacagaaaagcaaacaccgtatgttctcactcatgattgggagttgaacaatgagaacacatggacacagggaggggaatattacacaccggggcctatcagagcgtgggaggctacgagagggatagcattaggagaaatacctaatgtagatgacgggttgatgggtgcagcaaaccaccatggctcatgtatacccatgtaacagacctacacattctgcacatgtatcccagaacttaaagtatgatttaaaaatatatatagagagagagatatataaattgctgagagtggattttaagtgttctcaccacacaacaaaataagtatgtgaagtaaacatatattagttagcttgatttagccatttcacactatataaatatttcaaaacaacatgttgcacactatagacaatttttattggtcaactaaaaataaaatttttaaagggagaaaataagagagaattggcatcagggttgcaaaggaatgaataaatacatgggccatgaaaaactgatcaatataagggtttgagaggaaggtgaacagtttgcaaagttgtaactttgaaagatctcccttattaatttatttgctcgtttaaaagagtcagggtacaatggaatattcaacttaatctagaagaggtagagtggactgaaattaatttccctctaacatgcatttgttgctctaatcaactatctagagctacacaaaatacatacgattttctaaaattatttaaattcttgaaggtaaatgccatttcttctcttatagatgatagaccttcagactttcacatgactctttataaatagtccccatgctcaaaacgacaaacaccactctcttagatttcaacttagcaaggcatcccaaactaaacttcacatccaagggagaaggcaaatgaaggagagtaatgaccagctatttgtttgagacaataggtacattcatcagattacctccaaacatcagccaagggattttagtttggaacaaagatagttggaatattaattattttcaaatggtggaagagctgccatagagaattagagaaaattttaaactagaagtttgcaaaaaatatattcaaataatagctttgtttttattctaaaatgtgaccttggctaagccacataatctctctgggtctctgtatgtgggagctactgataatacctgtatctctgtttcaggtgatgatcaaaatgcctattttgtgatttgtgaaatgaaatgtgctgtaggcatgtaaggtgatttttacaaataattattttcttgttgtttttgaagttccagagtacaggaaaggaaacaggaaaaacataactgaggaatagttgttaggtcggtgagacattgaaccttctaacatctgaaactgtccactaactggcaagagcatttcaataaaaagcaaacacctcatcatattgaatcatagtgaatatataaaaagacactgtacacatttcttcagatatacatactgtaattgtcattctaaattgttaaaaaattactatatatagtaattctaaaatatataatatataatacataaatatatattatatatataaattatatatatatacacacatatatattagaatggatttcacactgggttttactcccattatgtgatgcataaaaaagtaaacaacaataaaacagttaaattaatgagcttggttggttttcaaaacatgttaggcccaatatgttagagaattaatatagggattttaaaaatgtgttaaactcaacatgttcttactaataacaggggatttctgatatcaaggaccagttaatgtggttaatattttgtattagaaggaaagggaagagatgtgctgggcaaaagaggaaaatatagattttttaaaaataaatagaaatctgagctaatattaataagggtaaaaaaggaaaaagtgataacatcatgtggaacattccagaagttatgtgcagggctcagtatgggggcaacacatcaatagcatatatatacaaggccaacctcttcctctccattcccagaaatctagtagtggggcactgtatgtgtacaggtaacatgttaaatagataggctgtgctggatgctatggttgcagaatgtggttgaagaagaattgcgaagccaacaaagcaagggttggggcagagtttatgagttatatgaagtttgtgtggggactgagaattctggattttagacatcctgtgtcctgcatggcaactcctccacccccaccagtcatgtcaggtggaggccactatagcagatatagtacgcctacattaagggaaggaggtagttctacgtaatgaaaactcactttccaagttgacccttcttaatcctctgctggaaaaccagtgtactgtgatacccaagggcatggttttatcctttggtgccactattcatcatatcctcattgcattggaaaaattaattgattactcttgacttcacttttctgtcaaattaaaattccattaccattcatttgaaaagatctgatgtggtttaagtgagattatatagtgtgtggatcattgctcagcatgtgataagcactcagacattttagctaaatgaaaacaacactaataccagtactactaaaactgagccctaaagtaatcacctgagttttatttaaacaaaaacataattttcttccatctttctgtaaaattgttcaacaagaaaatattaacattcatagatgatttcagagtttataggaacttttgcatacagctcacttatcagagcaactcagttggatcctgttattaatttcctcactttagaaatgaagggactgagatcaagaaaaggaagtgacttgctcaaggatacatatacaacaagtaaccatgctaagaattctcatttgatgtgcgatttcccccaatcagtgactatagatatatatagatacatagatgtgtatatatatagatgatagatagatacgtagatggggatacagatactacacctgtgtataccatatctatgtatgtttatatgctatttgtatgttccacttcggatatcttctcacattcagatatctagtgtccacatgtttttttccctggattcctctcgaaacataatcatatggcaaataaagtgagttctgcaataaactttaagatttaatataatacattttcagggagggtgtgggcagaaaaattgtgtggctttaagttttcttagcaaataagtgacttccctcctaagatgcagctgcttttcttcattttttgtaactgttttatgtttcacgaaattgctctgtcctgattttaactgtgtcatattccagctctcagagggtagccaaaatttggaaacaaaatgttgtttt

SEQ ID NO: 57177 - DNA, 4137 bp, Homo sapiens
ttctgcctggtatcattaaaaaggaggtgacaatttggcctaagaaaattcacggaatccattttgaaagaaaattatgagtggaaaacacctgagttgaaaagtggggaagtttctcaatctgcttactccaaggaaattcttaaaggaattataaacacttaacctaataagttaatttttaattgtaaaatagaccatcttcaattttttgaagagccctcgtgtggaggaatgcgatctcatggaaacagtggcctaaagaaagttctcctattgctttttacttccctttgcttgaaaaaagataaacagcatagaaacctccaagaggctaccgagttctctttgaacttttttctctgcagctgcgcctggaactgctccctgctgcactttactgcctctgtttataagagcaacagtccctctcctgaaaattggactgaattccaacaagtcggcaacttgcatgaagacaagatgtactgcagtgccatgctgggtatcttaaagaacaaggcattgtcctctgcagacacccaggctgcagacttcaaggactggaagaagagctttgcgtcttctctcttctctatacagacacaatctgtagcagcaaatgtgttacagatgaaggacagaagctggggaacatggatgaagctggaaaccatcattctcagcaaactaacacaggaacagaaaagcaaacaccgtatgttctcactcatgattgggagttgaacaatgagaacacatggacacagggaggggaatattacacaccggggcctatcagagcgtgggaggctacgagagggatagcattaggagaaatacctaatgtagatgacgggttgatgggtgcagcaaaccaccatggctcatgtatacccatgtaacagacctacacattctgcacatgtatcccagaacttaaagtatgatttaaaaatatatatagagagagagatatataaattgctgagagtggattttaagtgttctcaccacacaacaaaataagtatgtgaagtaaacatatattagttagcttgatttagccatttcacactatataaatatttcaaaacaacatgttgcacactatagacaatttttattggtcaactaaaaataaaatttttaaagggagaaaataagagagaattggcatcagggttgcaaaggaatgaataaatacatgggccatgaaaaactgatcaatataagggtttgagaggaaggtgaacagtttgcaaagttgtaactttgaaagatctcccttattaatttatttgctcgtttaaaagagtcagggtacaatggaatattcaacttaatctagaagaggtagagtggactgaaattaatttccctctaacatgcatttgttgctctaatcaactatctagagctacacaaaatacatacgattttctaaaattatttaaattcttgaaggtaaatgccatttcttctcttatagatgatagaccttcagactttcacatgactctttataaatagtccccatgctcaaaacgacaaacaccactctcttagatttcaacttagcaaggcatcccaaactaaacttcacatccaagggagaaggcaaatgaaggagagtaatgaccagctatttgtttgagacaataggtacattcatcagattacctccaaacatcagccaagggattttagtttggaacaaagatagttggaatattaattattttcaaatggtggaagagctgccatagagaattagagaaaattttaaactagaagtttgcaaaaaatatattcaaataatagctttgtttttattctaaaatgtgaccttggctaagccacataatctctctgggtctctgtatgtgggagctactgataatacctgtatctctgtttcaggtgatgatcaaaatgcctattttgtgatttgtgaaatgaaatgtgctgtaggcatgtaaggtgatttttacaaataattattttcttgttgtttttgaagttccagagtacaggaaaggaaacaggaaaaacataactgaggaatagttgttaggtcggtgagacattgaaccttctaacatctgaaactgtccactaactggcaagagcatttcaataaaaagcaaacacctcatcatattgaatcatagtgaatatataaaaagacactgtacacatttcttcagatatacatactgtaattgtcattctaaattgttaaaaaattactatatatagtaattctaaaatatataatatataatacataaatatatattatatatataaattatatatatatacacacatatatattagaatggatttcacactgggttttactcccattatgtgatgcataaaaaagtaaacaacaataaaacagttaaattaatgagcttggttggttttcaaaacatgttaggcccaatatgttagagaattaatatagggattttaaaaatgtgttaaactcaacatgttcttactaataacaggggatttctgatatcaaggaccagttaatgtggttaatattttgtattagaaggaaagggaagagatgtgctgggcaaaagaggaaaatatagattttttaaaaataaatagaaatctgagctaatattaataagggtaaaaaaggaaaaagtgataacatcatgtggaacattccagaagttatgtgcagggctcagtatgggggcaacacatcaatagcatatatatacaaggccaacctcttcctctccattcccagaaatctagtagtggggcactgtatgtgtacaggtaacatgttaaatagataggctgtgctggatgctatggttgcagaatgtggttgaagaagaattgcgaagccaacaaagcaagggttggggcagagtttatgagttatatgaagtttgtgtggggactgagaattctggattttagacatcctgtgtcctgcatggcaactcctccacccccaccagtcatgtcaggtggaggccactatagcagatatagtacgcctacattaagggaaggaggtagttctacgtaatgaaaactcactttccaagttgacccttcttaatcctctgctggaaaaccagtgtactgtgatacccaagggcatggttttatcctttggtgccactattcatcatatcctcattgcattggaaaaattaattgattactcttgacttcacttttctgtcaaattaaaattccattaccattcatttgaaaagatctgatgtggtttaagtgagattatatagtgtgtggatcattgctcagcatgtgataagcactcagacattttagctaaatgaaaacaacactaataccagtactactaaaactgagccctaaagtaatcacctgagttttatttaaacaaaaacataattttcttccatctttctgtaaaattgttcaacaagaaaatattaacattcatagatgatttcagagtttataggaacttttgcatacagctcacttatcagagcaactcagttggatcctgttattaatttcctcactttagaaatgaagggactgagatcaagaaaaggaagtgacttgctcaaggatacatatacaacaagtaaccatgctaagaattctcatttgatgtgcgatttcccccaatcagtgactatagatatatatagatacatagatgtgtatatatatagatgatagatagatacgtagatggggatacagatactacacctgtgtataccatatctatgtatgtttatatgctatttgtatgttccacttcggatatcttctcacattcagatatctagtgtccacatgtttttttccctggattcctctcgaaacataatcatatggcaaataaagtgagttctgcaataaactttaagatttaatataatacattttcagggagggtgtgggcagaaaaattgtgtggctttaagttttcttagcaaataagtgacttccctcctaagatgcagctgcttttcttcattttttgtaactgttttatgtttcacgaaattgctctgtcctgattttaactgtgtcatattccagctctcagagggtagccaaaatttggaaacaaaatgttgtttt

SEQ ID NO: 57178 - DNA, 3773 bp, Homo sapiens
gtgtgcagtaaactggaatgctctccctcgctcactcctcagtgtaggagtgatctgaagcaggacaagctcagcctgcagctgccgtgggctttgtgtggactggacgcagagcttgggagacgggggagggctattactccaattcactgtcaatggaattacagctatagcggcagtgtatataggattgctttttctcgtcttcctgggttctgaagtaacggaagctaccttgtataaagacctcaacactgctgaccatgatcagcgcagcctggagcatcttcctcatcgggactaaaattgggctgttccttcaagtagcacctctatcagttatggctaaatcctgtccatctgtgtgtcgctgcgatgcgggtttcatttactgtaatgatcgctttctgacatccattccaacaggaataccagaggatgctacaactctctaccttcagaacaaccaaataaataatgctgggattccttcagatttgaaaaacttgctgaaagtagaaagaatatacctataccacaacagtttagatgaatttcctaccaacctcccaaagtatgtaaaagagttacatttgcaagaaaataacataaggactatcacttatgattcactttcaaaaattccctatctggaagaattacatttagatgacaactctgtctctgcagttagcatagaagagggagcattccgagacagcaactatctccgactgcttttcctgtcccgtaatcaccttagcacaattccctggggtttgcccaggactatagaagaactacgcttggatgataatcgcatatccactatttcatcaccatctcttcaaggtctcactagtctaaaacgcctggttctagatggaaacctgttgaacaatcatggtttaggtgacaaagttttcttcaacctagttaatttgacagagctgtccctggtgcggaattccctgactgctgcaccagtaaaccttccaggcacaaacctgaggaagctttatcttcaagataaccacatcaatcgggtgcccccaaatgctttttcttatctaaggcagctctatcgactggatatgtccaataataacctaagtaatttacctcagggtatctttgatgatttggacaatataacacaactgattcttcgcaacaatccctggtattgcgggtgcaagatgaaatgggtacgtgactggttacaatcactacctgtgaaggtcaacgtgcgtgggctcatgtgccaagccccagaaaaggttcgtgggatggctattaaggatctcaatgcagaactgtttgattgtaaggacagtgggattgtaagcaccattcagataaccactgcaatacccaacacagtgtatcctgcccaaggacagtggccagctccagtgaccaaacagccagatattaagaaccccaagctcactaaggatcaccaaaccacagggagtccctcaagaaaaacaattacaattactgtgaagtctgtcacctctgataccattcatatctcttggaaacttgctctacctatgactgctttgagactcagctggcttaaactgggccatagcccggcatttggatctataacagaaacaattgtaacaggggaacgcagtgagtacttggtcacagccctggagcctgattcaccctataaagtatgcatggttcccatggaaaccagcaacctctacctatttgatgaaactcctgtttgtattgagactgaaactgcaccccttcgaatgtacaaccctacaaccaccctcaatcgagagcaagagaaagaaccttacaaaaaccccaatttacctttggctgccatcattggtggggctgtggccctggttaccattgcccttcttgctttagtgtgttggtatgttcataggaatggatcgctcttctcaaggaactgtgcatatagcaaagggaggagaagaaaggatgactatgcagaagctggcactaagaaggacaactctatcctggaaatcagggaaacttcttttcagatgttaccaataagcaatgaacccatctcgaaggaggagtttgtaatacacaccatatttcctcctaatggaatgaatctgtacaaaaacaatcacagtgaaagcagtagtaaccgaagctacagagacagtggtattccagactcagatcactcacactcatgatgctgaaggactcacagcagacttgtgttttgggttttttaaacctaagggaggtgatggtaggaaccctgttctactgcaaaacactggaaaaagagactgaaaaaaagcaatgtactgtacatttgccatataatttatatttaagaactttttattaaaagtttcaaatttcaggttactgctgcgattgatgtagtggagatgcctgaacacaattctatattttagtattttttagtaatttgtactgtattttccttgcaaatattggagttataaaccatttactttgtgttctactgagtaagatgacttgttgactgtgaaagtgaattttcttgctgtgtcgaacaatcaggactgcattcatatgagatccttgtagtataagcacaggccatttttcactttggtattaataaaatgtaaaaaaaaaaaactggctgaatggctgaatgagataaaatttaattttaaaaaatggttatgaaataatgttccaattattaaatttgtattatcccagtggtattcaataaatcaaaatgtgtgaagtaatgggcaatatcaaacttcctgcatatctccatttttgctctaggcaaattaattatccttaaaaaagttaagcatatcttctgaactgaatacatcagctggcataaaaggagcatgaagtctgttaaagccattgtcagcaaagctttgaaaataaaggacttcacaaaaacggtaatgtaaatgtgcttccaagttggggggaaaatgtgtacttaggaaaacatggaaacttagacttgtatagtgtaatgaacacaaataccaaaactgcattttggttttgcctataccatcctgatttttgaaaagtgaattataaacacaaaattgttagtgtttatgatgtttttatcataaaggatgtcagagaaactttatgcatattaaaaatgtaatgtaattataagcgattcccctcaacaatccagagaaagtagttctttaaataagagataatttaaagaaaaataaatactagacatcaaatttagatctggtttatgtcaaaggttttaacactgtacataaatgttcaatttacttttacaaagatcaagaatactgcccattactgtcacaattttccagatattatataatgaactcgtaatgtaacatttccttctagcttcctactgaattgtgagctgttacttgttgaaaaaccatatcacttttctgttgccatgattttttttttttcaacaaaaaaccaaagtgcattgtacgccctttggccagtcttgtatgtgccttgatccaacgctacatgtattcagcttttaaaactccacaaatttttcatactccttaaatatgaaaaattatggtcttattgctgaataaaacttttaaaaagtacagaataattgtgcttgctttttcaggattgtgttactatcactaagtagcaaattgcccagcacattagtcctaaacgtcccatgtatttttctaggcataaaaataaaagttggctaaaaattttaaaaaatc

SEQ ID NO: 57179 - DNA, 3977 bp, Homo sapiens
gaggtgggctgtgtgcagtaaactggaatgctctccctcgctcactcctcagtgtaggagtgatctgaagcaggacaagctcagcctgcagctgccgtgggctttgtgtggactggacgcagagcttgggagacgggggagggctattactccaattcactgtcaatggaattacagctatagcggcagtgtatataggattgctttttctcgtcttcctggagatgctcagtcccagtatattttaaggaagagaaatataaaggaaatttagtatgcctccttttctttaaatgaagaatttagtttcctttacttcttaaaagagaatacctgttcttgtataacgtgactgcaccagacattctgaaaaatcagcaagaagcaaaagctggaaatagctatttcacagcagggttctgaagtaacggaagctaccttgtataaagacctcaacactgctgaccatgatcagcgcagcctggagcatcttcctcatcgggactaaaattgggctgttccttcaagtagcacctctatcagttatggctaaatcctgtccatctgtgtgtcgctgcgatgcgggtttcatttactgtaatgatcgctttctgacatccattccaacaggaataccagaggatgctacaactctctaccttcagaacaaccaaataaataatgctgggattccttcagatttgaaaaacttgctgaaagtagaaagaatatacctataccacaacagtttagatgaatttcctaccaacctcccaaagtatgtaaaagagttacatttgcaagaaaataacataaggactatcacttatgattcactttcaaaaattccctatctggaagaattacatttagatgacaactctgtctctgcagttagcatagaagagggagcattccgagacagcaactatctccgactgcttttcctgtcccgtaatcaccttagcacaattccctggggtttgcccaggactatagaagaactacgcttggatgataatcgcatatccactatttcatcaccatctcttcaaggtctcactagtctaaaacgcctggttctagatggaaacctgttgaacaatcatggtttaggtgacaaagttttcttcaacctagttaatttgacagagctgtccctggtgcggaattccctgactgctgcaccagtaaaccttccaggcacaaacctgaggaagctttatcttcaagataaccacatcaatcgggtgcccccaaatgctttttcttatctaaggcagctctatcgactggatatgtccaataataacctaagtaatttacctcagggtatctttgatgatttggacaatataacacaactgattcttcgcaacaatccctggtattgcgggtgcaagatgaaatgggtacgtgactggttacaatcactacctgtgaaggtcaacgtgcgtgggctcatgtgccaagccccagaaaaggttcgtgggatggctattaaggatctcaatgcagaactgtttgattgtaaggacagtgggattgtaagcaccattcagataaccactgcaatacccaacacagtgtatcctgcccaaggacagtggccagctccagtgaccaaacagccagatattaagaaccccaagctcactaaggatcaccaaaccacagggagtccctcaagaaaaacaattacaattactgtgaagtctgtcacctctgataccattcatatctcttggaaacttgctctacctatgactgctttgagactcagctggcttaaactgggccatagcccggcatttggatctataacagaaacaattgtaacaggggaacgcagtgagtacttggtcacagccctggagcctgattcaccctataaagtatgcatggttcccatggaaaccagcaacctctacctatttgatgaaactcctgtttgtattgagactgaaactgcaccccttcgaatgtacaaccctacaaccaccctcaatcgagagcaagagaaagaaccttacaaaaaccccaatttacctttggctgccatcattggtggggctgtggccctggttaccattgcccttcttgctttagtgtgttggtatgttcataggaatggatcgctcttctcaaggaactgtgcatatagcaaagggaggagaagaaaggatgactatgcagaagctggcactaagaaggacaactctatcctggaaatcagggaaacttcttttcagatgttaccaataagcaatgaacccatctcgaaggaggagtttgtaatacacaccatatttcctcctaatggaatgaatctgtacaaaaacaatcacagtgaaagcagtagtaaccgaagctacagagacagtggtattccagactcagatcactcacactcatgatgctgaaggactcacagcagacttgtgttttgggttttttaaacctaagggaggtgatggtaggaaccctgttctactgcaaaacactggaaaaagagactgaaaaaaagcaatgtactgtacatttgccatataatttatatttaagaactttttattaaaagtttcaaatttcaggttactgctgcgattgatgtagtggagatgcctgaacacaattctatattttagtattttttagtaatttgtactgtattttccttgcaaatattggagttataaaccatttactttgtgttctactgagtaagatgacttgttgactgtgaaagtgaattttcttgctgtgtcgaacaatcaggactgcattcatatgagatccttgtagtataagcacaggccatttttcactttggtattaataaaatgtaaaaaaaaaaaactggctgaatggctgaatgagataaaatttaattttaaaaaatggttatgaaataatgttccaattattaaatttgtattatcccagtggtattcaataaatcaaaatgtgtgaagtaatgggcaatatcaaacttcctgcatatctccatttttgctctaggcaaattaattatccttaaaaaagttaagcatatcttctgaactgaatacatcagctggcataaaaggagcatgaagtctgttaaagccattgtcagcaaagctttgaaaataaaggacttcacaaaaacggtaatgtaaatgtgcttccaagttggggggaaaatgtgtacttaggaaaacatggaaacttagacttgtatagtgtaatgaacacaaataccaaaactgcattttggttttgcctataccatcctgatttttgaaaagtgaattataaacacaaaattgttagtgtttatgatgtttttatcataaaggatgtcagagaaactttatgcatattaaaaatgtaatgtaattataagcgattcccctcaacaatccagagaaagtagttctttaaataagagataatttaaagaaaaataaatactagacatcaaatttagatctggtttatgtcaaaggttttaacactgtacataaatgttcaatttacttttacaaagatcaagaatactgcccattactgtcacaattttccagatattatataatgaactcgtaatgtaacatttccttctagcttcctactgaattgtgagctgttacttgttgaaaaaccatatcacttttctgttgccatgattttttttttttcaacaaaaaaccaaagtgcattgtacgccctttggccagtcttgtatgtgccttgatccaacgctacatgtattcagcttttaaaactccacaaatttttcatactccttaaatatgaaaaattatggtcttattgctgaataaaacttttaaaaagtacagaataattgtgcttgctttttcaggattgtgttactatcactaagtagcaaattgcccagcacattagtcctaaacgtcccatgtatttttctaggcataaaaataaaagttggctaaaaattttaaaaaatc

SEQ ID NO: 57180 - DNA, 944 bp, Homo sapiens
tcaagattaaacgacaaggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcacatgtgtcttgagaattatttgg

SEQ ID NO: 57181 - DNA, 1032 bp, Homo sapiens
ggcaagggggagtgtagagcagagcagaagcctgagccagacggagagccacctcctctcccaggaactgaacccaaaggatcacctggtattccctgagagtacagatttctccggcgtggccctcaagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccg

SEQ ID NO: 57182 - DNA, 1104 bp, Homo sapiens
tggaggcctggctggtgctcacatacaataattaactgctgagtggccttcgcccaatcccaggctccactcctgggctccattcccactccctgcctgtctcctaggccactaaaccacagctgtcccctggaataaggcaagggggagtgtagagcagagcagaagcctgagccagacggagagccacctcctctcccagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccg

SEQ ID NO: 57183 - DNA, 939 bp, Homo sapiens
cattccttggtgccactgaccacagctctttcttcagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccg

SEQ ID NO: 57184 - DNA, 1331 bp, Homo sapiens
ggaaaggattttctcagcccccatccccagcactgtgtgttggccgcacccatgagagcctcagcactctgaaggtgcagggggcaaaggccaaaagagctctggcctgaacttgggtggtccctactgtgtgacttggggcatggccctcatctgtgctgaaatgattccacaaagattaaactggctatcatttgttgatttcccccttcttacatttaatccttgcaggagaaagctaagcctcaagatagtttgcttctctttcccccaaggccaaggagaaggtggagtgagggctggggtcgggacaggttgaacgggaaccctgtgctctaaacagttagggtttgttcccgcaggaactgaacccaaaggatcacctggtattccctgagagtacagatttctccggcgtggccctcaagggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgc

SEQ ID NO: 57185 - DNA, 929 bp, Homo sapiens
agggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcacatgtgtcttgagaattatttgg

SEQ ID NO: 57186 - DNA, 1108 bp, Homo sapiens
attgaatgcagcaagggtctggaggctgaggaccaggcagacaaacattcagagttgctggaatgcgacagagacagggagtcagactggtcatgcaaggtcctgggcctgcccttgggtcctggggagccacggaaggttgtgggtgccagagggttgtggtcagagccacagtcaggggccttctgagacctgtgccccctccccaccctccctccccacctccctaggccagctctggggtctcggcaggtggtccgcgacatgacctccgagttcttctctgcccagctccgggcccagatctctgacgacaccactcacccgatctcctactacaagcccgagttctacatgccggatgacgggggcactgctcacctgtctgtggtcgcagaggacggcagtgctgtgtccgccaccagcaccatcaacctctactttggctccaaggtgcgctccccagtcagcgggatcctgctcaataatgaaatggatgacttcagctctaccagcatcaccaacgagtttggggtacccccctcacctgccaatttcatccagccagggaagcagccgctctcgtccatgtgcccgacgatcatggtgggccaggacggccaggtccggatggtggtgggagctgccgggggcacgcagatcaccatggccactgcactggccatcatctacaacctctggttcggctatgacgtgaagtgggccgtggaggagccccggctgcacaaccagcttctgcccaacgtcacgacagtggagagaaacattgaccaggaagtgactgcagccctggagacccggcaccatcacacccagatcacgtccaccttcattgctgtggtgcaagccatcgtccgcatggctggtggctgggcagctgcctcggactccaggaaaggtggggaacctgctggctactgattgctccaggcggacaaggctgacaagcaatccaggaacaaaatactcaccaggacgaggaagaggactttgggggacaggcttctcctgtgagcagcagagcagcacaataaatgaggccactgtgccaggctccaggtggcctccctggcctgtctccccactc

SEQ ID NO: 57187 - DNA, 1049 bp, Homo sapiens
ctcgagagctgggctctgcgtcctcgtccagccgccaactcggccaaaggcgaagccagcagtttcttctgctgccgggcaacgcgccttttaaacctgagggagtgggcgcgtgagcacttaatggcgccggtgacagagtgagcttaacggattaataagcgcagccaggccagctctggggtctcggcaggtggtccgcgacatgacctccgagttcttctctgcccagctccgggcccagatctctgacgacaccactcacccgatctcctactacaagcccgagttctacatgccggatgacgggggcactgctcacctgtctgtggtcgcagaggacggcagtgctgtgtccgccaccagcaccatcaacctctactttggctccaaggtgcgctccccagtcagcgggatcctgctcaataatgaaatggatgacttcagctctaccagcatcaccaacgagtttggggtacccccctcacctgccaatttcatccagccagggaagcagccgctctcgtccatgtgcccgacgatcatggtgggccaggacggccaggtccggatggtggtgggagctgccgggggcacgcagatcaccatggccactgcactggccatcatctacaacctctggttcggctatgacgtgaagtgggccgtggaggagccccggctgcacaaccagcttctgcccaacgtcacgacagtggagagaaacattgaccaggaagtgactgcagccctggagacccggcaccatcacacccagatcacgtccaccttcattgctgtggtgcaagccatcgtccgcatggctggtggctgggcagctgcctcggactccaggaaaggtggggaacctgctggctactgattgctccaggcggacaaggctgacaagcaatccaggaacaaaatactcaccaggacgaggaagaggactttgggggacaggcttctcctgtgagcagcagagcagcacaataaatgaggccactgtgccaggctccaggtggcctccctggcctgtctccccactc

SEQ ID NO: 57188 - DNA, 977 bp, Homo sapiens
attgaatgcagcaagggtctggaggctgaggaccaggcagacaaacattcagagttgctggaatgcgacagagacagggagtcagactggtcatgcaaggccagctctggggtctcggcaggtggtccgcgacatgacctccgagttcttctctgcccagctccgggcccagatctctgacgacaccactcacccgatctcctactacaagcccgagttctacatgccggatgacgggggcactgctcacctgtctgtggtcgcagaggacggcagtgctgtgtccgccaccagcaccatcaacctctactttggctccaaggtgcgctccccagtcagcgggatcctgctcaataatgaaatggatgacttcagctctaccagcatcaccaacgagtttggggtacccccctcacctgccaatttcatccagccagggaagcagccgctctcgtccatgtgcccgacgatcatggtgggccaggacggccaggtccggatggtggtgggagctgccgggggcacgcagatcaccatggccactgcactggccatcatctacaacctctggttcggctatgacgtgaagtgggccgtggaggagccccggctgcacaaccagcttctgcccaacgtcacgacagtggagagaaacattgaccaggaagtgactgcagccctggagacccggcaccatcacacccagatcacgtccaccttcattgctgtggtgcaagccatcgtccgcatggctggtggctgggcagctgcctcggactccaggaaaggtggggaacctgctggctactgattgctccaggcggacaaggctgacaagcaatccaggaacaaaatactcaccaggacgaggaagaggactttgggggacaggcttctcctgtgagcagcagagcagcacaataaatgaggccactgtgccaggctccaggtggcctccctggcctgtctccccactc

SEQ ID NO: 57189 - DNA, 3522 bp, Homo sapiens
gccatttgaagcagaatccaaaccatgaattgtagagaattacccttgaccctttgggtgcttatatctgtaagcactgcagaatcttgtacttcacgtccccacattactgtggttgaaggggaacctttctatctgaaacattgctcgtgttcacttgcacatgagattgaaacaaccaccaaaagctggtacaaaagcagtggatcacaggaacatgtggagctgaacccaaggagttcctcgagaattgctttgcatgattgtgttttggagttttggccagttgagttgaatgacacaggatcttactttttccaaatgaaaaattatactcagaaatggaaattaaatgtcatcagaagaaataaacacagctgtttcactgaaagacaagtaactagtaaaattgtggaagttaaaaaattttttcagataacctgtgaaaacagttactatcaaacactggtcaacagcacatcattgtataagaactgtaaaaagctactactggagaacaataaaaacccaacgataaagaagaacgccgagtttgaagatcaggggtattactcctgcgtgcatttccttcatcataatggaaaactatttaatatcaccaaaaccttcaatataacaatagtggaagatcgcagtaatatagttccggttcttcttggaccaaagcttaaccatgttgcagtggaattaggaaaaaacgtaaggctcaactgctctgctttgctgaatgaagaggatgtaatttattggatgttcggggaagaaaatggatcggatcctaatatacatgaagagaaagaaatgagaattatgactccagaaggcaaatggcatgcttcaaaagtattgagaattgaaaatattggtgaaagcaatctaaatgttttatataattgcactgtggccagcacgggaggcacagacaccaaaagcttcatcttggtgagaaaagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacagatggaaaaacatatgatgcttttgtgtcttacctaaaagaatgccgacctgaaaatggagaggagcacacctttgctgtggagattttgcccagggtgttggagaaacattttgggtataagttatgcatatttgaaagggatgtagtgcctggaggagctgttgttgatgaaatccactcactgatagagaaaagccgaagactaatcattgtcctaagtaaaagttatatgtctaatgaggtcaggtatgaacttgaaagtggactccatgaagcattggtggaaagaaaaattaaaataatcttaattgaatttacacctgttactgacttcacattcttgccccaatcactaaagcttttgaaatctcacagagttctgaagtggaaggccgataaatctctttcttataactcaaggttctggaagaaccttctttacttaatgcctgcaaaaacagtcaagccaggtagagacgaaccggaagtcttgcctgttctttccgagtcttaatcttcagaaacagtgaacgccaaaaagaactcaagatattctggggactgagcatatgaacctgttcataacaaaggctgtgactcgaaataattaactttgtcaaaatcctgctcacaatttgaagatgaaacttgtcattaggttggcgggaatgagactaaagattgcgctgtgggctgtggtcacgtgctcccagaagacctggaattcaaaagaaatggagctattctttttctccctctttcataactggatgcagctgctcatactcaatcccatattcagcaagtgtgaagctggacgtgatgcaaaataaccgatgccctacaaaaagggcgcatctttaagagttttaatgccagtgcttaattcgaatgaggggattttaagtgtctgaagaggcattttctagggaccagtgggtgactgagtaactgaaatgctgctttcactccctaacaccatggatctggttgtgcataggatgtgggaggaggggctggcagggccgccttcagaggctgcagggcctcagcctcaggatgcatttaatgtatcctggccacagttgcagccaacggttcttgaaagctcggtaaggccctgcaacgcagagcctgcttatgtggatctatttatgggaacttcttaaaaggaccccagaatagctctttatctttcacaagagacacaaattctaattgagttaattatctgggcctttcactttggatgctctgaaacatttgttgattttgtgtgaatgtttatatcaaaatgtttgccaggttgtattagccattgaatagcaaaaaactgatagttacttgcttgttttttaaaaattacatattaaaaatgcccttggcataaggcagcatggtgtggcagttaagagatgggctgtgcagcccatcctgagctccagtcctgagtttgctacttacttctgtggcctctggaaccttatccaacctcttggtgcttcagtttcctcatctgtgaaattagaatttataataattgcacctacctcccaggggtaactaaatgaataaatataataaagtacttacagtggttcctgacacagactcagcactccgtcagtgttgccatgactatttttattatcattattaatgattacttagatcaattatttagcagtggactaatggaagctacagagcagggaagggaagcagatctagggaggaaggcagttttgatttgaggaggtttgcacatgtagagaagcatactggagaagcatatccagagggcgaaagatatctctccattgtgcatctgcctcttttgacgttggaagacacatgtcttactccccaaagggagcccagcactgggagccttcttgatgatctcaaaaataatagctattcaagaaaatcaccaagtgactgtgaaaccgtcagttcggaaggctggttagaacatgtgggagcaacatgaatgttctacaaaagtttaaagcagagattgtttcaaatgggtgtagtagatattactgaaaaccaaaaaagagtgagattgtcagtgtaagaatgtgatttaatgtttgtagtgcttacaattttgtgtaccaactggatgactaaaaagagtaaaataatttaattaatagctcatattttatgtgtgaaaacatgttagtgaacatatataatcaaaatagatttcattgctattgcatagtctctaatacatagaatgattttgcttttctcttttattatacttgctttaaaatacttgaaatatattttgcattaaatgcatttcaagttaaatgtcttaaatgtatacattagatgtgtgttttaaaatgcataaaacacgttgaaa

SEQ ID NO: 57190 - DNA, 2639 bp, Homo sapiens
acatttcagggacaccatgaagggtggcttcactgggggtgatgagtaccagaagcacttcctgcccagggactacttggctacttactacagcttcgatggcagcccctcacccgaggccgagatgctgaagtttaacttggaatgtctccacaagaccttcggccctggaggcctccaaggggacacgctgattgacattggctcaggtcctaccatctaccaagttcttgctgcctgtgattccttccaagacatcactctctccgactttaccgaccgcaaccgggaggagctggaaaagtggctgaagaaggagccgggggcctatgactggaccccagcggtgaaattcgcctgtgagctggaaggaaacagcggccgatgggaggagaaggaggagaagctgcgggcagcggtgaagcgggtgctcaagtgcgatgtccacctgggcaacccgctggccccggctgtgttgcctctcgccgactgtgtgctcaccctgctggccatggagtgtgcctgctgtagccttgatgcctaccgcgctgccctgtgcaaccttgcctcactgctcaagccgggtggccacctggtgaccactgtcacgcttcggctcccgtcctacatggtggggaagcgtgaattttcctgcgtggccctggagaaagaggaggtggagcaggctgtcctggatgctggctttgacattgaacagctcctacacagtccccagagctactctgtcaccaatgctgccaacaatggggtctgcttcattgtggctcgcaagaagcctgggccctgagccaggagggccagccagaggtctggtcaggctgtgaggccttggccatctgtatgctagagaggggtgaggaatggatactgtctaacagtctctgatttcaacactaacattccatcttctgaaattctgagattctaacatccttgttttagaattctaagtttccaacattcctcattctaggatcctaggagtggaattttccattttctaatatactaagccttacagctatcttagatgcgatctgactcctgtgtgactgtggagcacccagggacgtggttttagagtctacctaatatgttaaggacaaggaaacctctgagtctacctaatatgttaaggacaaggaaacctctggacagtggtatattggggaattttttttttttttttgagacggagtctggctctgtcacccaggctagagtgcaatggcacgatctcggctcactgcaagctctgcgtcctgggttgacgccattctcctgcctcagcctcccgagtagctgggactacaggagctcgccaccacacccagctaatttttttttttttttttttatttgagacggagtttcgctctgtcgcccaggctggagtgcagtggcgcgatctcgactcactgcaagctccgcctcccgggttcacgccattctcctgcctcagcctcccgtgtagctgggactacaggcacgcgccaccatgcccggctaatttttgtatttttagtagagatggggtttcaccgtgttagccaggatggtctcgatctcctgacctggtgatccacccaccttggcctcccaaagtgctgggattacaggcgtgagccaccgcacccagccagggggaatgttctataaccagctctgtaaaggaaaagcactgatgtgtggtagtcaccaatttctgtggtgtaaatactcccaccatggttgatttcaagccaccagtggtttaataaccagctcataaatctcctaaatattttacagttgactctcatgagctgattggagtcagctggaacataccactgcctctagactaaggtcagcagatttagcaaatacagactgccccagttcattgaattttagataaatgaaataaatctataaggttaagtatgtccccagaactgcatggaacatgcttaatctaaacaatgatttgttgttcacctgaaattcaaatttagctgggtgtcctgtatttcatctggcaaccctacttcagacccaggtgtaaggtacatggatgtgctttggtcaaggaataggccaaggcagagatccatgcctgcatgactcagtgggtttggtgcacaggcacacacctccacttgttatataacctgtttgtgtaagttcatacttggtctgagccactgttgtctgtaaaaggtaattgtcctgctaatgctgtacaggggctcttggggttcggctcagctcaacatggcttgacatggtgggcacactggcgcccagtaagagagagagagagccaaagctgtccgttttgcagatggacaggaaggagccaggacacagctcagcttgctcacgcccagagagagaaaaagttaagctgctgaccctgaaggcaagggagagcaggctgcacagctgtgtgtggaagccacgggctcaagcagccaaggcagggcggacagtgtgagagagctagtgtaagctgttgatgagagctgttgctgaataaaaccatattcacctgccaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 57191 - DNA, 450 bp, Homo sapiens
atggagccagtgctgaaaaaggaagacatcaggagctctaacacagatgacgggaatccccaggatgacatggagagcaaccagtccagattcaccgtgttcagcagcaccagccccacactcgcccccaccatggcctccatctcccggcttacctgcatctcctcggacctcattctgcacaacgatgaagtgaccgtcacggaggataagatcgatgccctcattaaagcaggcggtgtaaatgttgaactgttttggcctagcttgttggcaaaggccctggccagcgtcaacattgggagcctcatctgcaatgtaggagctggtggacctgctccagtagctggtgctgctccagctgaggaagaaagtggaagcaaagaaagaagaatccgaggatctgatgatgacatgggctttgggtttttgactaaacctctttcataa

SEQ ID NO: 57192 - DNA, 450 bp, Homo sapiens; identical to SEQ ID NO: 57191

SEQ ID NO: 57193 - DNA, 1985 bp, Homo sapiens
ggttcatttcttaggcctgtgtcatggctatgacccttggccggctggggtgggggctgtgtctatgacgccaccaaggccctgggtgtccccggggtccctcggaataggaggtggaaacgggtcggacaagagctggccgtgggggaagagcaatggtgtgcggaggtgggggaggccctatctagggacaagcagaaaacttagggtgggcagatccccccgacccctgtgcaggggctgccggagaccagagaggctgctgtgtgacctggaccaagccccttgccctctcatgcctcagtttccccttctctccacggagggattgagcaggacatggagggccccttccagtagccattctgggactccctgcacctgtccccaggggagggtcctgagctggcctccacgtggctgctgttccccatagtggaaccttgtgtgtggagacggctggaaggtcccgctggagcaggtgagccacctcctgggctggctgctgggctgtgtcatcctgggagcaggctgtgaccggtttggacgccgggcagtttttgtggcctccctggtgctgaccacaggcctgggggccagtgaggccctggctgccagcttccctaccctgctggtcctgcgcctactccacgggggcacattggcaggggccctcctcgccctgtatctggctcgcctggagttgtgtgaccctccccaccgcctggccttctccatgggggctggccttttctcggtggtgggcaccctgctgctgcccggcctggctgcgcttgtgcaggactggcgtcttctgcaggggctgggtgccctgatgagtggactcttgctgctcttttgggggttcccggccctgttccccgagtctccctgctggctgctggccacaggtcaggtagctcgagccaggaagatcctgtggcgctttgcagaagccagtggcgtgggccccggggacagttccttggaggagaactccctggctacagagctgaccatgctgtctgcacggagcccccagccccggtaccactccccactggggcttctgcgtacccgagtcacctggagaaacgggcttatcttgggcttcagctcgctggttggtggaggcatcagagctagcttccgccgcagcctggcacctcaggtgccgaccttctacctgccctacttcctggaggccggcctggaggcggcagccttggtcttcctgctcctgacggcagattgctgtggacgccgccccgtgctgctgctgggcaccatggtcacaggcctggcatccctgctgctcctcgctggggcccagtatctgccaggctggactgtgctgttcctctctgtcctggggctcctggcctcccgggctgtgtccgcactcagcagcctcttcgcggccgaggtcttccccacggtgatcaggggggccgggctgggcctggtgctgggggccgggttcctgggccaggcagccggccccctggacaccctgcacggccggcagggcttcttcctgcaacaagtcgtcttcgcctcccttgctgtccttgccctgctgtgtgtcctgctgctgcctgagagccgaagccgggggctgccccagtcactgcaggacgccgaccgcctgcgccgctccccactcctgcggggccgcccccgccaggaccacctgcctctgctgccgccctccaactcctactgggccggccacacccccgagcagcactagtcctgcctggtggccctgggagccaggatgggaccaaagtcaaggcctggggcatggctgagtaccccagacgtctggtccagggcagacacattcctctcagaagcccgtgtctcagtgcaggtggagccgtggggacagcgtgaaggtgtctccagccaggccccaggcactgggaggccctgggtctccccccagccacacccagtaggtgtggaggataaaggcttct

SEQ ID NO: 57194 - DNA, 2074 bp, Homo sapiens
cccgagtccctcttgaaatgggcagggcagggagggcgtgggtaccagcgcaggtgctggggttcatttcttaggcctgtgtcatggctatgacccttggccggctggggtgggggctgtgtctatgacgccaccaaggccctgggtgtccccggggtccctcggaataggaggtggaaacgggtcggacaagagctggccgtgggggaagagcaatggtgtgcggaggtgggggaggccctatctagggacaagcagaaaacttagggtgggcagatccccccgacccctgtgcaggggctgccggagaccagagaggctgctgtgtgacctggaccaagccccttgccctctcatgcctcagtttccccttctctccacggagggattgagcaggacatggagggccccttccagtagccattctgggactccctgcacctgtccccaggggagggtcctgagctggcctccacgtggctgctgttccccatagtggaaccttgtgtgtggagacggctggaaggtcccgctggagcagggttcagctagacctggtgctgccaggatgaaggttggaccctgggttatcctgaccctgtccaagcatgtcccccgctgcccaccaggtttggacgccgggcagtttttgtggcctccctggtgctgaccacaggcctgggggccagtgaggccctggctgccagcttccctaccctgctggtcctgcgcctactccacgggggcacattggcaggggccctcctcgccctgtatctggctcgcctggagttgtgtgaccctccccaccgcctggccttctccatgggggctggccttttctcggtggtgggcaccctgctgctgcccggcctggctgcgcttgtgcaggactggcgtcttctgcaggggctgggtgccctgatgagtggactcttgctgctcttttgggggttcccggccctgttccccgagtctccctgctggctgctggccacaggtcaggtagctcgagccaggaagatcctgtggcgctttgcagaagccagtggcgtgggccccggggacagttccttggaggagaactccctggctacagagctgaccatgctgtctgcacggagcccccagccccggtaccactccccactggggcttctgcgtacccgagtcacctggagaaacgggcttatcttgggcttcagctcgctggttggtggaggcatcagagctagcttccgccgcagcctggcacctcaggtgccgaccttctacctgccctacttcctggaggccggcctggaggcggcagccttggtcttcctgctcctgacggcagattgctgtggacgccgccccgtgctgctgctgggcaccatggtcacaggcctggcatccctgctgctcctcgctggggcccagtatctgccaggctggactgtgctgttcctctctgtcctggggctcctggcctcccgggctgtgtccgcactcagcagcctcttcgcggccgaggtcttccccacggtgatcaggggggccgggctgggcctggtgctgggggccgggttcctgggccaggcagccggccccctggacaccctgcacggccggcagggcttcttcctgcaacaagtcgtcttcgcctcccttgctgtccttgccctgctgtgtgtcctgctgctgcctgagagccgaagccgggggctgccccagtcactgcaggacgccgaccgcctgcgccgctccccactcctgcggggccgcccccgccaggaccacctgcctctgctgccgccctccaactcctactgggccggccacacccccgagcagcactagtcctgcctggtggccctgggagccaggatgggaccaaagtcaaggcctggggcatggctgagtaccccagacgtctggtccagggcagacacattcctctcagaagcccgtgtctcagtgcaggtggagccgtggggacagcgtgaaggtgtctccagccaggccccaggcactgggaggccctgggtctccccccagccacacccagtaggtgtggaggataaaggcttct

SEQ ID NO: 57195 - DNA, 2074 bp, Homo sapiens
cccgagtccctcttgaaatgggcagggcagggagggcgtgggtaccagcgcaggtgctggggttcatttcttaggcctgtgtcatggctatgacccttggccggctggggtgggggctgtgtctatgacgccaccaaggccctgggtgtccccggggtccctcggaataggaggtggaaacaggtcggacaagagctggccgtgggggaagagcaatggtgtgcggaggtgggggaggccctatctagggacaagcagaaaacttagggtgggcagatccccccgacccctgtgcaggggctgccggagaccagagaggctgctgtgtgacctggaccaagccccttgccctctcatgcctcagtttccccttctctccacggagggattgagcaggacatggagggccccttccagtagccattctgggactccctgcacctgtccccaggggagggtcctgagctggcctccacgtggctgctgttccccatagtggaaccttgtgtgtggagacggctggaaggtcccgctggagcagggttcagctagacctggtgctgccaggatgaaggttggaccctgggttatcctgaccctgtccaagcatgtcccccgctgcccaccaggtttggacgccgggcagtttttgtggcctccctggtgctgaccacaggcctgggggccagtgaggccctggctgccagcttccctaccctgctggtcctgcgcctactccacgggggcacattggcaggggccctcctcgccctgtatctggctcgcctggagttgtgtgaccctccccaccgcctggccttctccatgggggctggccttttctcggtggtgggcaccctgctgctgcccggcctggctgcgcttgtgcaggactggcgtcttctgcaggggctgggtgccctgatgagtggactcttgctgctcttttgggggttcccggccctgttccccgagtctccctgctggctgctggccacaggtcaggtagctcgagccaggaagatcctgtggcgctttgcagaagccagtggcgtgggccccggggacagttccttggaggagaactccctggctacagagctgaccatgctgtctgcacggagcccccagccccggtaccactccccactggggcttctgcgtacccgagtcacctggagaaacgggcttatcttgggcttcagctcgctggttggtggaggcatcagagctagcttccgccgcagcctggcacctcaggtgccgaccttctacctgccctacttcctggaggccggcctggaggcggcagccttggtcttcctgctcctgacggcagattgctgtggacgccgccccgtgctgctgctgggcaccatggtcacaggcctggcatccctgctgctcctcgctggggcccagtatctgccaggctggactgtgctgttcctctctgtcctggggctcctggcctcccgggctgtgtccgcactcagcagcctcttcgcggccgaggtcttccccacggtgatcaggggggccgggctgggcctggtgctgggggccgggttcctgggccaggcagccggcctcctggacaccctgcacggccggcagggcttcttcctgcaacaagtcgtcttcgcctcccttgctgtccttgccctgctgtgtgtcctgctgctgcctgagagccgaagccgggggctgccccagtcactgcaggacgccgaccgcctgcgccgctccccactcctgcggggccgcccccgccaggaccacctgcctctgctgccgccctccaactcctactgggccggccacacccccgagcagcactagtcctgcctggtggccctgggagccaggatgggaccaaagtcaaggcctggggcatggctgagtaccccagacgtctggtccagggcagacacattcctctcagaagcccgtgtctcagtgcaggtggagccgtggggacagcgtgaaggtgtctccagccaggccccaggcactgggaggccctgggtctccccccagccacacccagtaggtgtggaggataaaggcttct

SEQ ID NO: 57196 - DNA, 1985 bp, Homo sapiens
ggttcatttcttaggcctgtgtcatggctatgacccttggccggctggggtgggggctgtgtctatgacgccaccaaggccctgggtgtccccggggtccctcggaataggaggtggaaacaggtcggacaagagctggccgtgggggaagagcaatggtgtgcggaggtgggggaggccctatctagggacaagcagaaaacttagggtgggcagatccccccgacccctgtgcaggggctgccggagaccagagaggctgctgtgtgacctggaccaagccccttgccctctcatgcctcagtttccccttctctccacggagggattgagcaggacatggagggccccttccagtagccattctgggactccctgcacctgtccccaggggagggtcctgagctggcctccacgtggctgctgttccccatagtggaaccttgtgtgtggagacggctggaaggtcccgctggagcaggtgagccacctcctgggctggctgctgggctgtgtcatcctgggagcaggctgtgaccggtttggacgccgggcagtttttgtggcctccctggtgctgaccacaggcctgggggccagtgaggccctggctgccagcttccctaccctgctggtcctgcgcctactccacgggggcacattggcaggggccctcctcgccctgtatctggctcgcctggagttgtgtgaccctccccaccgcctggccttctccatgggggctggccttttctcggtggtgggcaccctgctgctgcccggcctggctgcgcttgtgcaggactggcgtcttctgcaggggctgggtgccctgatgagtggactcttgctgctcttttgggggttcccggccctgttccccgagtctccctgctggctgctggccacaggtcaggtagctcgagccaggaagatcctgtggcgctttgcagaagccagtggcgtgggccccggggacagttccttggaggagaactccctggctacagagctgaccatgctgtctgcacggagcccccagccccggtaccactccccactggggcttctgcgtacccgagtcacctggagaaacgggcttatcttgggcttcagctcgctggttggtggaggcatcagagctagcttccgccgcagcctggcacctcaggtgccgaccttctacctgccctacttcctggaggccggcctggaggcggcagccttggtcttcctgctcctgacggcagattgctgtggacgccgccccgtgctgctgctgggcaccatggtcacaggcctggcatccctgctgctcctcgctggggcccagtatctgccaggctggactgtgctgttcctctctgtcctggggctcctggcctcccgggctgtgtccgcactcagcagcctcttcgcggccgaggtcttccccacggtgatcaggggggccgggctgggcctggtgctgggggccgggttcctgggccaggcagccggcctcctggacaccctgcacggccggcagggcttcttcctgcaacaagtcgtcttcgcctcccttgctgtccttgccctgctgtgtgtcctgctgctgcctgagagccgaagccgggggctgccccagtcactgcaggacgccgaccgcctgcgccgctccccactcctgcggggccgcccccgccaggaccacctgcctctgctgccgccctccaactcctactgggccggccacacccccgagcagcactagtcctgcctggtggccctgggagccaggatgggaccaaagtcaaggcctggggcatggctgagtaccccagacgtctggtccagggcagacacattcctctcagaagcccgtgtctcagtgcaggtggagccgtggggacagcgtgaaggtgtctccagccaggccccaggcactgggaggccctgggtctccccccagccacacccagtaggtgtggaggataaaggcttct

SEQ ID NO: 57197 - DNA, 573 bp, Homo sapiens
atgctggaactccagggccccagggaatgcatcaagaagggaaagtgggaaccagagccgcagccggtgctggcattggtgctggaactgaggctgggaccgctgccggggctggggctggcgtggctggaggagcacttgctggtaccgccggtgtggccatcttgtggagaaagaaagcctgggaggaccatggcagtgatgttcacacctctgacagtgaaatatgtatactgtgacactgaacgcattggagttgacctgatcgtgaagacctgctttagccccaacagagtgattggactctcaggtgacttgcagcaagtaggaggggcatccgctcgcatccgggatgccttgagcagagtgttgcaatatgcagaggatgtactctctggaaaggtgtcggttggccgcttcctggtgaacctggttaaccaagtacccaaaatagttcccgatgacttcgagatcatgctcaacggtaacatcaacgacctgttgatggtgacctacctggccaacctcacacagtcacagattgccctcagtgaaaaacttgtaaacctgtga

SEQ ID NO: 57198 - DNA, 573 bp, Homo sapiens; identical to SEQ ID NO: 57197

SEQ ID NO: 57199 - DNA, 2020 bp, Homo sapiens
tttgggaggccgaggctggcggatcacgaggtcaggagatcgagaccatcctggctaacacggcaggagtgcagatgtgatctcggcacaccgcaacctctgcctcttggattcaagcaattctcctgcctcagcctcccaagtggctgggattacaggcatgcgccaccacgcccagggtttggcaaatggattctgcagagtcagatgccttaacttcgtgtagtggtcttgtggatggcttactgccttggagttaatttcgttccttctcgtttctgctaccagcttcacaggcttctgctaaggtgtaccttccggtttcccagcacggccatcaagatccagttcacgtcgctctatcacaaagaagaggccccagcctccccgctgcggccactgtacccccagatctcccctctgaagatccacatcccggagccggacctccggagcatggtcagccccgtcccctccccgacgggcaccatcagtgtccccaactcctgcccagccagtccacgcggtgccggctcctccagttaccgctttgtgcagaacgtgacctcggacctgcagctggcagcagagtttgcagcaaaggccgcgtcggagcagcaggcagacacgtctggaggagacagccccaaggatgagtcaaagccgccgttctcctacgcgcagctgatcgtgcaggccatctcctccgcccaggaccggcagctgaccctgagcgggatctacgcccacatcaccaagcattacccctactaccggacggccgacaaaggctggcagaattctatccggcacaacctctctttgaaccgttactttatcaaagtcccacgttcccaggaggagcctgggaaggggtccttttggcgaatagaccctgcctctgaagccaagctcgtggaacaggcattccggaaacggaggcagaggggtgtctcctgcttccgcacccccttcgggcctctgtcctcaaggagcgctccagcttcgcccacacaccccgggctgatgtcccctcgctccggcggcctgcagaccccagagtgcctgtctcgggagggctcccccattccacacgaccctgagtttgggtccaagttagcttctgtcccagagtaccggtattcccaaagcgcacccggctcccccgtcagcgcccagccagtgatcatggccgtgcctccccgaccgtccagcctcgtggccaagcccgtggcctacatgcccgcctccatcgtaacctcacagcagcccgcgggccacgccatccacgtcgtgcagcaggcccccaccgtcaccatggtcagggtggtcaccacatctgccaactcggccaacggatacatcctcaccagccagggcgcggcggggggctcccatgatgcggcgggcgcagccgtgctggacctgggcagcgaggccagaggcctggaggagaaacccaccattgcgtttgccacaatccccgcggctggtggagtcatccagacggtggccagccagatggcccccggggtccccggacacacggtcaccatcctgcagcccgccacacccgtgaccctcgggcagcaccaccttccagtccgggccgtgacccagaacggaaagcatgcggttcccacgaacagtttagccggcaacgcttacgccctcaccagccctttgcagctccttgcgacccaagcgagttcatccgcgccggtggtggtcacccgggtgtgcgaggtggggcccaaggagccagcagcagccgtcgcggccacggccaccaccaccccagccactgccaccaccgcctctgcctccgcctcttccactggagagcccgaggtcaaaaggtcccgggtggaggagcccagtggtgctgtaaccacaccggctggagtgatcgcagctgccggcccccaggggccaggcaccggggagtgaggtcacctgcaacgcgggggagtgggactcacccagcggcgaccccgaagctggacccggcagctcaggc

SEQ ID NO: 57200 - DNA, 174 bp, Homo sapiens
atggcggctcagatcatcaagcgcaagtgggaggcagaagaatttgcagagcagatcagggcctacctggagggcacgtgcgtggagaggctcgcagacacctggagaacgggaaggagacgctgcagctcactggtaccagggaacacaagacgtctccctgatcgcctgtag

SEQ ID NO: 57201 - DNA, 2020 bp, Homo sapiens; identical to SEQ ID NO: 57199

SEQ ID NO: 57202 - DNA, 739 bp, Homo sapiens
tcctctatccctgaaccaggtcagacatagatggaatcagagcaggagttggtgttgatgtggtttcaggtccacctatcagagtttgagagatttaggccatgaaccattatgaatatagatgagaacctttgtaattgctgaaggaggtagtagtgcaggcaagtcctgtgtgcaagacctgctgctcccagttagtacggacccctgtgacattcacagaagttcagaatgtctgagatgctctgcaggctaccttatctccgtctgcagctacacctccagtgatcacaatcagtgctacgctggcacagccagcctggccctgctctggattggaggcatcctcaagggctgcttgctgtggaagcagtttcgctggaccgagaggagccactggaattttgggtactgggccttagggtcacccgggaatgggaatggctgctgtgtggccctgtttgccagagggggccattggtgatgagccccatgcaagtggcatctgcccttcacctgctccttctaagccagcgggatggagaccctccagagagaatatgtgagttcctctccttatgagagccgtggtatgggcattgagatgactgacttgtcaaattagttcggaaagatttttgacaactactacaagatcataatgtacttgaacaaaaacctgtgatatgtgttatttgtttgtttttagatattggagaagggaataaattttagcaag

SEQ ID NO: 57203 - DNA, 284 bp, Homo sapiens
acctcgttgcactcctgagagcaagatgggtcaccagcagctgtactggagccacccgcgaaaattcggccagggttctcgctcttgttgcgtgtgttcaaacaaccggcacggtctgatccggaaatatggcctcaatatgtgccgccagtgtttccgtcagtacgcgaaggatatcggtttcattaagttggactaaatgatcttccttcaaaggattatccaaggcatatactcaatgaaaaaccatgatagttctttgtacataaaataaacatttgaaa

SEQ ID NO: 57204 - DNA, 1741 bp, Homo sapiens
atggcaccctgtgtcccagccactgtagctccagccgtggctaaaagggaccacagtacagctcgggccatgccttcagagggtgcacaacccaagccttggtggcttccaagtggtgttgggcctgcagctgagcagaagacaagagctgagatcccgcagcccggggggctcgccgagccgccgactcctcgtcacaggctcagctgccgcggccgaggtggcggcgacgagcggccgccgcgtcctgccggcgcgcgccccaggcccccctacctggctgcccgccgagccatgtcgttgagcccaaagcacacgacgcccttctccgtgtccgacatcctgagccccatcgaggagacctacaagaagttcagcggcgccatggacggcgcgccacccggcctgggggcgcccctgggggccgcggccgcctaccgcgcgccgccacctgggccctcctcgcaggcggcgaccgtggcgggcatgcagccttctcacgccatggcgggtcacaacgcggcggccgcggcggcggcggcagcagctgcggcggcggcggccgccacctaccacatgccgcccggcgtctcgcagttcccgcacggcgccatgggcagctactgcaacggcggcctgggcaacatgggcgagctgcccgcctacacggacggcatgcggggcggcgcggccaccggctggtacggcgccaacccggacccacgctactcgtcaatctccaggttcatggggccgtcggcgggcgtgaatgtggccggcatggggtcgctgaccggcatcgcggacgccgccaagtcgctgggcccgctgcacgcggcggcggcggcagccgctccgcgaaggaagcgccgcgtgctcttctcgcaggcgcaggtctacgagctggagcggcgcttcaagcagcagaagtacctgtcggcgcccgagcgcgagcacctggccagcatgatccacctgacgcccacgcaggtcaagatctggttccagaaccaccggtacaagatgaaacggcaggccaaggacaaggcggcgcagcagctgcagcaggagggcggcctgggcccgccgccgcctccgccgccgtccccgcgccgcgtggcggtgcctgtgctggtcaaggacggcaagccgtgccagaacggcgccagcacgcccacccccggccaggccggtccgcagccgccggccccgacgccagcacctgagctggaggagctgtcgcccagcccacccgcgctgcacggcccggggggcggcctggcggccctggacgcggccgccggggagtacagcggcggcgtcctgggcgccaacctgctctatggcaggacgtggtgacagcgagggcgccccggggctaggtcctggtgcacccgaagggtctgcaagaaactgctagaacggatgggggaggcatgcgaaaaccgactcgcgcgtgtaaactgcgattcaaaacgaaccggtctcagagaggagcaggctgtgaacctcttgctgggggcgggggacagcgacagcccggaaaccgagtagtgtaacattatgccacgaggctttgaggtggtgattttctcctcctagaagttcttaaatgacgcgaaaaggtggagaagttcacacggcattcttaactacagctctcaaagttggaaactttgttggcgtttgtaactataaaaatcaacccagctttaacaatcagtcctttttgaagtggaat

SEQ ID NO: 57205 - DNA, 537 bp, Homo sapiens
atggctccgggggctctgcctgaacttggggaagaggaaggacacggcgcgagcggcctctcggcggagctggggcgtctgagcgcgggctcggtgggtccgcgtggcgcggagctgggtatcggggccggtgcgggctcctccgcgggcggctcctggcactctggcgccctcttctggccgctctcgcgcacctccgccacgccgggcccaggcctgcgcagctgtcacatgtcctggcccaggaggtcgctatcccttgcccatggacaggcccgctctggcaatgccctgcacctcctccccgccccggccaggttgcaccccgatggtctccctgctcaaggaggagagaagagaagggacgccacgagagggtggacatcggccaaagccaccttgtctttgctcttaccctgtgtcttccatgatttggaggtggtgggaaacccgaggctgctcaaaactcgtggagaattcctcctgcaggatgacatgaatgcaccttcccattgcctaccaacagatcttttttga

SEQ ID NO: 57206 - DNA, 855 bp, Homo sapiens
atgaaggctgcactcccaacttcaacccggggacggccacggagcctcccgacgtcccttcgtcgcgtccccggcacccccgcgcccgcgtcacttactcctttgccgtcgccacctgtctgggtgccggtctccttcgtgcccggcagcggcgggtcctccctgtcctcgcagtcctcgggctgtgcgcttcccccctccagctacagccccagcctcttctcttcgggagggacgtcctcctcctcctcccttctgggccggccatccctgcctcggggcttgccagtggcttcggagctgctggaagggctggccatggctccgggggctctgcctgaacttggggaagaagaaggacacggcgcgagcggcctctcggcggagctggggcgtctgagcacgggctcggtgggtccgcgcggcgcggagctgggtatcggggccggtgcgggctcctccgcgggcggctcctggcactctggcgccctcttctggccgctctcgcgcacctccgccacgccgggcccaggcctgcgtagctctcacatgtcctggcccaggaggtcgctatcccttgcccatggacaggcccgctctggcaatgccctgcacctcctccccgccccggccaggttgcaccccgatggtctccctgctcaaggaggagagaagagaagggacgccacgagagggtggacatcggccaaagccaccttgtctttgctcttaccctgtgtcttccatgatttggaggtggtgggaaacccgaggctgctcaaaactcgtggagaattcctcctgcaggatgacatgaatgcaccttcccattgcctaccaacagatcttttttga

SEQ ID NO: 57207 - DNA, 1077 bp, Homo sapiens
atgccccagacaggatgcccggggcaacccccgccccttcccctgctaggggcccccaggacgcggggctccccctctccttttggccagccacagagtccagcggatctcccggccagggatgtcgtgggagaatcaggaagtcgaagccacacagccgagaaggggcagctggcgtctcggaggccgtcacgagctgtcactccgcgcccgccggacttgcagctcaattaccaacttcaacccagggccggccccggagcctcccgccgcccctaccccgcgcccctggcacccccggacctccgcgcccgcgtcacttactcctctgccgtcgccacctgtctgggtcccggtctcctccctgcctggccgcggcacgtcctccccgtcctcgcagtcctcaggttctgcgcttcccccctccagcaacagccgcagcctcttctcttcgggagggacgtcgtcctcttccctcctgggccggccatccctgcctcggggcttgccagtggcttcggagctgccggaagggctggccatgactccgggggctctgcctgcacctggggaagaggaaggacccggcgcgagcggcctctcggcggagctggggcgtctgagcgagggctcggtgggtcagcgcggcgcggggctgggcatcccggcgggcgcgggctcctccgcgggccgctcctggctctctggcgccctctgccggccgcttgcgcgcaccgcggacacgccgggtactggcctgcccggctctcacctgcccaggcccaagcagtcgctgtcccctgcctgtggccaggcccgctctggccaggccctgcacctcctccccgccccagccaggttgcacccgatggtctccctgcccaaggaggagagaagagaaaggacgccccgagatggtggacatcggccacaaccaccttgtctttgctcttaccctgtgtcttccatgatttggaggtggtgggaaacccgaggctgctcaaaactcgtggagaattccgcctgcaggatgacatgaatgcaccttcccattgcctaccaacagatcttttttga

SEQ ID NO: 57208 - DNA, 739 bp, Homo sapiens; identical to SEQ ID NO: 57202

SEQ ID NO: 57209 - DNA, 2020 bp, Homo sapiens
tttgggaggccgaggctggcggatcacgaggtcaggagatcgagaccatcctggctaacacggcaggagtgcagatgtgatctcggcacaccgcaacctctgcctcttggattcaagcaattctcctgcctcagcctcccaagtggctgggattacaggcatgcgccaccacgcccagggtttggcaaatggattctgcagagtcagatgccttaacttcgtgtagtggtcttgtggatggcttactgccttggagttaatttcgttccttctcgtttctgctaccagcttcacaggcttctgctaaggtgtaccttccggtttcccagcacggccatcaagatccagttcacttcgctctatcacaaagaagaggccccagcctccccgctgcggccactgtacccccagatctcccctctgaagatccacatcccggagccggacctccggagcatggtcagccccgtcccctccccgacgggcaccatcagtgtccccaactcctgcccagccagtccacgcggtgccggctcctccagttaccgctttgtgcagaacgtgacctcggacctgcagctggcagcagagtttgcagcaaaggccgcgtcggagcagcaggcagacacgtctggaggagacagccccaaggatgagtcaaagccgccgttctcctacgcgcagctgatcgtgcaggccatctcctccgcccaggaccggcagctgaccctgagcgggatctacgcccacatcaccaagcattacccctactaccggacggccgacaaaggctggcagaattctatccggcacaacctctctttgaaccgttactttatcaaagtcccacgttcccaggaggagcctgggaaggggtccttttggcgaatagaccctgcctctgaagccaagctcgtggaacaggcattccggaaacggaggcagaggggtgtctcctgcttccgcacccccttcgggcctctgtcctcaaggagcgctccagcttcgcccacacaccccgggctgatgtcccctcgctccggcggcctgcagaccccagagtgcctgtctcgggagggctcccccattccacacgaccctgagtttgggtccaagttagcttctgtcccagagtaccggtattcccaaagcgcacccggctcccccgtcagcgcccagccagtgatcatggccgtgcctccccgaccgtccagcctcgtggccaagcccgtggcctacatgcccgcctccatcgtaacctcacagcagcccgcgggccacgccatccacgtcgtgcagcaggcccccaccgtcaccatggtcagggtggtcaccacatctgccaactcggccaacggatacatcctcaccagccagggcgcggcggggggctcccatgatgcggcgggcgcagccgtgctggacctgggcagcgaggccagaggcctggaggagaaacccaccattgcgtttgccacaatccccgcggctggtggagtcatccagacggtggccagccagatggcccccggggtccccggacacacggtcaccatcctgcagcccgccacacccgtgaccctcgggcagcaccaccttccagtccgggccgtgacccagaacggaaagcatgcggttcccacgaacagtttagccggcaacgcttacgccctcaccagccctttgcagctccttgcgacccaagcgagttcatccgcgccggtggtggtcacccgggtgtgcgaggtggggcccaaggagccagcagcagccgtcgcggccacggccaccaccaccccagccactgccaccaccgcctctgcctccgcctcttccactggagagcccgaggtcaaaaggtcccgggtggaggagcccagtggggctgtaaccacaccggctggagtgatcgcagctgccggcccccaggggccaggcaccggggagtgaggtcacctgcaacgcgggggagtgggactcacccagcggcgaccccgaagctggacccggcagctcaggc

SEQ ID NO: 57210 - DNA, 1741 bp, Homo sapiens
atggcaccctgtgtcccagccactgtagctccagccgtggctaaaagggaccacagtacagctcgggccatgccttcagagggtgcacaccccaagccttggtggcttccaagtggtgttgggcctgcagctgagcagaagacaagagctgagatcccgcagcccggggggctcgccgagccgccgactcctcgtcacaggctcagctgccgcggccgaggtggcggcgacgagcggccgccgcgtcctgccggcgcgcgccccaggcccccctacctggctgcccgccgagccatgtcgttgagcccaaagcacacgacgcccttctccgtgtccgacatcctgagccccatcgaggagacctacaagaagttcagcggcgccatggacggcgcgccacccggcctgggggcgcccctgggggccgcggccgcctaccgcgcgccgccacctgggccctcctcgcaggcggcgaccgtggcgggcatgcagccttctcacgccatggcgggtcacaacgcggcggccgcggcggcggcggcagcagctgcggcggcggcggccgccacctaccacatgccgcccggcgtctcgcagttcccgcacggcgccatgggcagctactgcaacggcggcctgggcaacatgggcgagctgcccgcctacacggacggcatgcggggcggcgcggccaccggctggtacggcgccaacccggacccacgctactcgtcaatctccaggttcatggggccgtcggcgggcgtgaatgtggccggcatggggtcgctgaccggcatcgcggacgccgccaagtcgctgggcccgctgcacgcggcggcggcggcagccgctccgcgaaggaagcgccgcgtgctcttctcgcaggcgcaggtctacgagctggagcggcgcttcaagcagcagaagtacctgtcggcgcccgagcgcgagcacctggccagcatgatccacctgacgcccacgcaggtcaagatctggttccagaaccaccggtacaagatgaaacggcaggccaaggacaaggcggcgcagcagctgcagcaggagggcggcctgggcccgccgccgcctccgccgccgtccccgcgccgcgtggcggtgcctgtgctggtcaaggacggcaagccgtgccagaacggcgccagcacgcccacccccggccaggccggtccgcagccgccggccccgacgccagcacctgagctggaggagctgtcgcccagcccacccgcgctgcacggcccggggggcggcctggcggccctggacgcggccgccggggagtacagcggcggcgtcctgggcgccaacctgctctatggcaggacgtggtgacagcgagggcgccccggggctaggtcctggtgcacccgaagggtctgcaagaaactgctagaacggatgggggaggcatgcgaaaaccgactcgcgcgtgtaaactgcgattcaaaacgaaccggtctcagagaggagcaggctgtgaacctcttgctgggggcgggggacagcgacagcccggaaaccgagtagtgtaacattatgccacgaggctttgaggtggtgattttctcctcctagaagttcttaaatgacgcgaaaaggtggagaagttcacacggcattcttaactacagctctcaaagttggaaactttgttggcgtttgtaactataaaaatcaacccagctttaacaatcagtcctttttgaagtggaat

SEQ ID NO: 57211 - DNA, 1101 bp, Homo sapiens
atggagagagataagagccccctccggcctcccggccccatcacctcggacccgggacccgatcccgcgccgagaggaggtcgggccaggtctcacccctccccgcccccaggctcccactccctgaggtatttctacaccgccgtgtcccggcccggcctcggggagccgcgcttcatctctgtcggctacgtggacgacacgcagttcgtgcggttcgacagcgactccgcgaatccgagggaagaaccgcgggcgccgtggatggagcaagaggggccggagtattgggatgagcagacgcgaatagtcaaggacaccgcacagtctttccgagtgggcctgaacaccctgcgcggctactacaaccagagcgaggccgggtctcacaccctccagctgatgtacggctgcgacgtggggccggacgggcgtttcctccgcgggttcatgcaggacgcctacgacggcagagattacatcgccctgaacgaggacctgcgctcctggaccgcggcggacacggcggctcagatcaccaagcgcaagcgggaggcggcaggtgctgcggagagacagaggaactacctggagggccggtgcgtggaggggctccgcagatacctggagaccgggaaggacgcgctgctgcgcgcagaccctccaaaggcacatgtgacccatcaccccatctctgagcgtgaggtcaccctgaggtgctgggccctgggcttctaccctgaggagatctcactgacctggcagcgcgagggggaggaccagacccaggacatggagcttgtggagaccaggccttcaggggatggaaccttccagaagtgggcagccctggtggtgccttctggagaggagcagagatacacgtgccgtgtgcagcatgaggggcttcaggagcccctcaccctgagatgggaacctcctcagacctccttcctcatcatgggcatcattgttggcctggttctcctcgtagtagctctggtggctggagctgtgatctggaggaagaagcgctcaggtagggaagggagggagggatctgagttttcttgtcacaatggggtttcagtccgagcatga

SEQ ID NO: 57212 - DNA, 704 bp, Homo sapiens
gaggggagggaggactgcatgacgcgggatggggtggggcgaggcggggcactgcagcacacaacgcaggcaccgacttcagtgtgcatgttccttggacacctgcctcagtgtgcatgttcactgggcatcttcccttcgacccctttgcccacgtggtgaccgctggggagctgtgagagtgtgaggggcacgttccagccgtctggactctttctctcctactgagacgcagcctataggtccgcaggccagtcctcccaggaactgaaatagtgaaatatgagttggcgaggaagatcaacatataggcctaggccaagaagaagtttacagcctcctgagctgattggggctatgcttgaacccactgatgaagagcctaaagaagagaaaccacccactaaaagtcggaatcctacacctgatcagaagagagaagatgatcagggtgcagctgagattcaagtgcctgacctggaagccgatctccaggagctatgtcagacaaagactggggatggatgtgaaggtggtactgatgtcaaggggaagattctaccaaaagcagagcactttaaaatgccagaagcaggtgaagggaaatcacaggtttaaaggaagataagctgaaacaacacaaactgtttttatattagatattttactttaaaatatcttaataaagttttaagcttttctcc

SEQ ID NO: 57213 - DNA, 9234 bp, Homo sapiens
cgctggctgcgggcggtgagctgagctcgcccccggggagctgtggccggcgcccctgccggttccctgagcagcggacgttcatgctgggagggcggcgggttggaagcaggtgccaccatggctagtggcagctgtcaggggtgcgaagaggacgaggaaactctgaagaagttgatagtcaggctgaacaatgtccaggaaggaaaacagatagaaacgctggtccaaatcctggaggatctgctggtgttcacgtactccgagcacgcctccaagttatttcaaggcaaaaatatccatgtgcctctgttgatcgtcttggactcctatatgagagtcgcgagtgtgcagcaggtgggttggtcacttctgtgcaaattaatagaagtctgtccaggtacaatgcaaagcttaatgggaccccaggatgttggaaatgattgggaagtccttggtgttcaccaattgattcttaaaatgctaacagttcataatgccagtgtaaacttgtcagtgattggactgaagaccttagatctcctcctaacttcaggtaaaatcaccttgctgatattggatgaagaaagtgatattttcatgttaatttttgatgccatgcactcatttccagccaatgatgaagtccagaaacttggatgcaaagctttacatgtgctgtttgagagagtctcagaggagcaactgactgaatttgttgagaacaaagattatatgatattgttaagtgcgtcaacaaattttaaagatgaagaggaaattgtgcttcatgtgctgcattgtttacattccctagcgattccttgcaataatgtggaagtcctcatgagtggcaatgtcaggtgttataatattgtggtggaagctatgaaagcattccctatgagtgaaagaattcaagaagtgagttgctgtttgctccataggcttacattaggtaattttttcaatatcctggtattaaacgaagtccatgagtttgtggtgaaagctgtgcagcagtacccagagaatgcagcattgcagatctcagcgctcagctgtttggccctcctcactgagactattttcttaaatcaagatttagaggaaaagaatgagaatcaagagaatgatgatgagggggaagaagataaattgttttggctggaagcctgttacaaagcattaacgtggcatagaaagaacaagcacgtgcaggaggccgcatgctgggcactaaataatctccttatgtaccaaaacagtttacatgagaagattggagatgaagatggccatttcccagctcatagggaagtgatgctctccatgctgatgcattcttcatcaaaggaagttttccaggcatctgcgaatgcattgtcaactctcttagaacaaaatgttaatttcagaaaaatactgttatcaaaaggaatacacctgaatgttttggagttaatgcagaagcatatacattctcctgaagtggctgaaagtggctgtaaaatgctaaatcatctttttgaaggaagcaacacttccctggatataatggcagcagtggtccccaaaatactaacagttatgaaacgtcatgagacatcattaccagtgcagctggaggcgcttcgagctattttacattttatagtgcctggcatgccagaagaatccagggaggatacagaatttcatcataagctaaatatggttaaaaaacagtgtttcaagaatgatattcacaaactggtcctagcagctttgaacaggttcattggaaatcctgggattcagaaatgtggattaaaagtaatttcttctattgtacattttcctgatgcattagagatgttatccctggaaggtgctatggattcagtgcttcacacactgcagatgtatccagatgaccaagaaattcagtgtctgggtttaagtcttataggatacttgattacaaagaagaatgtgttcataggaactggacatctgctggcaaaaattctggtttccagcttataccgatttaaggatgttgctgaaatacagactaaaggatttcagacaatcttagcaatcctcaaattgtcagcatctttttctaagctgctggtgcatcattcatttgacttagtaatattccatcaaatgtcttccaatatcatggaacaaaaggatcaacagtttctaaacctctgttgcaagtgttttgcaaaagtagctatggatgattacttaaaaaatgtgatgctagagagagcgtgtgatcagaataacagcatcatggttgaatgcttgcttctattgggagcagatgccaatcaagcaaaggagggatcttctttaatttgtcaggtatgtgagaaagagagcagtcccaaattggtggaactcttactgaatagtggatctcgtgaacaagatgtacgaaaagcgttgacgataagcattgggaaaggtgacagccagatcatcagcttgctcttaaggaggctggccctggatgtggccaacaatagcatttgccttggaggattttgtataggaaaagttgaaccttcttggcttggtcctttatttccagataagacttctaatttaaggaaacaaacaaatatagcatctacactagcaagaatggtgatcagatatcagatgaaaagtgctgtggaagaaggaacagcctcaggcagcgatggaaatttttctgaagatgtgctgtctaaatttgatgaatggacctttattcctgactcttctatggacagtgtgtttgctcaaagtgatgacctggatagtgaaggaagtgaaggctcatttcttgtgaaaaagaaatctaattcaattagtgtaggagaattttaccgagatgccgtattacagcgttgctcaccaaatttgcaaagacattccaattccttggggcccatttttgatcatgaagatttactgaagcgaaaaagaaaaatattatcttcagatgattcactcaggtcatcaaaacttcaatcccatatgaggcattcagacagcatttcttctctggcttctgagagagaatatattacatcactagacctttcagcaaatgaactaagagatattgatgccctaagccagaaatgctgtataagtgttcatttggagcatcttgaaaagctggagcttcaccagaatgcactcacgagctttccacaacagctatgtgaaactctgaagagtttgacacatttggacttgcacagtaataaatttacatcatttccttcttatttgttgaaaatgagttgtattgctaatcttgatgtctctcgaaatgacattggaccctcagtggttttagatcctacagtgaaatgtccaactctgaaacagtttaacctgtcatataaccagctgtcttttgtacctgagaacctcactgatgtggtagagaaactggagcagctcattttagaaggaaataaaatatcagggatatgctcccccttgagactgaaggaactgaagattttaaaccttagtaagaaccacatttcatccctatcagagaactttcttgaggcttgtcctaaagtggagagtttcagtgccagaatgaattttcttgctgctatgcctttcttgcctccttctatgacaatcctaaaattatctcagaacaaattttcctgtattccagaagcaattttaaatcttccacacttgcggtctttagatatgagcagcaatgatattcagtacctaccaggtcccgcacactggaaatctttgaacttaagggaactcttatttagccataatcagatcagcatcttggacttgagtgaaaaagcatatttatggtctagagtagagaaactgcatctttctcacaataaactgaaagagattcctcctgagattggctgtcttgaaaatctgacatctctggatgtcagttacaacttggaactaagatcctttcccaatgaaatggggaaattaagcaaaatatgggatcttcctttggatgaactgcatcttaactttgattttaaacatataggatgtaaagccaaagacatcataaggtttcttcaacagcgattaaaaaaggctgtgccttataaccgaatgaaacttatgattgtgggaaatactgggagtggtaaaaccaccttattgcagcaattaatgaaaaccaagaaatcagatcttggaatgcaaagtgccacagttggcatagatgtgaaagactggcctatccaaataagagacaaaagaaagagagatctcgtcctaaatgtgtgggattttgcaggtcgtgaggaattctatagtactcatccccattttatgacgcagcgagcattgtaccttgctgtctatgacctcagcaagggacaggctgaagttgatgccatgaagccttggctcttcaatataaaggctcgcgcttcttcttcccctgtgattctcgttggcacacatttggatgtttctgatgagaagcaacgcaaagcctgcatgagtaaaatcaccaaggaactcctgaataagcgagggttccctgccatacgagattaccactttgtgaatgccaccgaggaatctgatgctttggcaaaacttcggaaaaccatcataaacgagagccttaatttcaagatccgagatcagcttgttgttggacagctgattccagactgctatgtagaacttgaaaaaatcattttatcggagcgtaaaaatgtgccaattgaatttcccgtaattgaccggaaacgattattacaactagtgagagaaaatcagctgcagttagatgaaaatgagcttcctcacgcagttcactttctaaatgaatcaggagtccttcttcattttcaagacccagcactgcagttaagtgacttgtactttgtggaacccaagtggctttgtaaaatcatggcacagattttgacagtgaaagtggaaggttgtccaaaacaccctaagggcattatttcgcgtagagatgtggaaaaatttctttcaaaaaaaaggaaatttccaaagaactacatgtcacagtattttaagctcctagaaaaattccagattgctttgccaataggagaagaatatttgctggttccaagcagtttgtctgaccacaggcctgtgatagagcttccccattgtgagaactctgaaattatcatccgactatatgaaatgccttattttccaatgggattttggtcaagattaatcaatcgattacttgagatttcaccttacatgctttcagggagagaacgagcacttcgcccaaacagaatgtattggcgacaaggcatttacttaaattggtctcctgaagcttattgtctggtaggatctgaagtcttagacaatcatccagagagtttcttaaaaattacagttccttcttgtagaaaaggctgtattcttttgggccaagttgtggaccacattgattctctcatggaagaatggtttcctgggttgctggagattgatatttgtggtgaaggagaaactctgttgaagaaatgggcattatatagttttaatgatggtgaagaacatcaaaaaatcttacttgatgacttgatgaagaaagcagaggaaggagatctcttagtaaatccagatcaaccaaggctcaccattccaatatctcagattgcccctgacttgattttggctgacctgcctagaaatattatgttgaataatgatgagttggaatttgaacaagctccagagtttctcctaggtgatggcagttttggatcagtttaccgagcagcctatgaaggagaagaagtggctgtgaagatttttaataaacatacatcactcaggctgttaagacaagagcttgtggtgctttgccacctccaccaccccagtttgatatctttgctggcagctgggattcgtccccggatgttggtgatggagttagcctccaagggttccttggatcgcctgcttcagcaggacaaagccagcctcactagaaccctacagcacaggattgcactccacgtagctgatggtttgagatacctccactcagccatgattatataccgagacctgaaaccccacaatgtgctgcttttcacactgtatcccaatgctgccatcattgcaaagattgctgactacggcattgctcagtactgctgtagaatggggataaaaacatcagagggcacaccagggtttcgtgcacctgaagttgccagaggaaatgtcatttataaccaacaggctgatgtttattcatttggtttactactctatgacattttgacaactggaggtagaatagtagagggtttgaagtttccaaatgagtttgatgaattagaaatacaaggaaaattacctgatccagttaaagaatatggttgtgccccatggcctatggttgagaaattaattaaacagtgtttgaaagaaaatcctcaagaaaggcctacttctgcccaggtctttgacattttgaattcagctgaattagtctgtctgacgagacgcattttattacctaaaaacgtaattgttgaatgcatggttgctacacatcacaacagcaggaatgcaagcatttggctgggctgtgggcacaccgacagaggacagctctcatttcttgacttaaatactgaaggatacacttctgaggaagttgctgatagtagaatattgtgcttagccttggtgcatcttcctgttgaaaaggaaagctggattgtgtctgggacacagtctggtactctcctggtcatcaataccgaagatgggaaaaagagacataccctagaaaagatgactgattctgtcacttgtttgtattgcaattccttttccaagcaaagcaaacaaaaaaattttcttttggttggaaccgctgatggcaagttagcaatttttgaagataagactgttaagcttaaaggagctgctcctttgaagatactaaatataggaaatgtcagtactccattgatgtgtttgagtgaatccacaaattcaacggaaagaaatgtaatgtggggaggatgtggcacaaagattttctccttttctaatgatttcaccattcagaaactcattgagacaagaacaagccaactgttttcttatgcagctttcagtgattccaacatcataacagtggtggtagacactgctctctatattgctaagcaaaatagccctgttgtggaagtgtgggataagaaaactgaaaaactctgtggactaatagactgcgtgcactttttaagggaggtaatggtaaaagaaaacaaggaatcaaaacacaaaatgtcttattctgggagagtgaaaaccctctgccttcagaagaacactgctctttggataggaactggaggaggccatattttactcctggatctttcaactcgtcgacttatacgtgtaatttacaacttttgtaattcggtcagagtcatgatgacagcacagctaggaagccttaaaaatgtcatgctggtattgggctacaaccggaaaaatactgaaggtacacaaaagcagaaagagatacaatcttgcttgaccgtttgggacatcaatcttccacatgaagtgcaaaatttagaaaaacacattgaagtgagaaaagaattagctgaaaaaatgagacgaacatctgttgagtaagagagaaataggaattgtctttggataggaaaattattctctcctcttgtaaatatttattttaaaaatgttcacatggaaagggtactcacattttttgaaatagctcgtgtgtatgaaggaatgttattatttttaatttaaatatatgtaaaaatacttaccagtaaatgtgtattttaaagaactatttaaaacacaatgttatatttcttataaataccagttactttcgttcattaattaatgaaaataaatctgtgaagtacctaatttaagtactcatactaaaatttataaggccgataattttttgttttcttgtctgtaatggaggtaaactttattttaaattctgtgcttaagacaggactattgcttgtcgatttttctagaaatctgcacggtataatgaaaatattaagacagtttcccatgtaatgtattccttcttagattgcatcgaaatgcactatcatatatgcttgtaaatattcaaatgaatttgcactaataaagtcctttgttggtatgtgaattctctttgttgctgttgcaaacagtgcatcttacacaacttcactcaattcaaaagaaaactccattaaaagtactaatgaaaaaacatgacatactgtcaaagtcctcatatctaggaaagacacagaaactctctttgtcacagaaactctctgtgtctttcctagacataatagagttgtttttcaactctatgtttgaatgtggataccctgaattttgtataattagtgtaaatacagtgttcagtccttcaagtgatatttttatttttttattcataccactagctacttgttttctaatctgcttcattctaatgcttatattcatcttttccctaaatttgtgatgctgcagatcctacatcattcagatagaaacctttttttttttcagaattatagaattccacagctcctaccaagaccatgaggataaatatctaacacttttcagttgctgaaggagaaaggagctttagttatgatggataaaaatatctgccaccctaggcttccaaattatacttaaattgtttacatagcttaccacaataggagtatcagggccaaatacctatgtaataatttgaggtcatttctgctttaggaaaagtactttcggtaaattctttggccctgaccagtattcattatttcagataattccctgtgataggacaactagtacatttaatattctcagaacttatggcattttactatgtgaaaactttaaatttatttatattaagggtaatcaaattcttaaagatgaaagattttctgtattttaaaggaagctatgctttaacttgttatgtaattaacaaaaaaatcatatataatagagctctttgttccagtgttatctctttcattgttactttgtatttgcaattttttttaccaaagacaaattaaaaaaatgaataccatatttaaatggaataataaaggttttttaaaaactttaaaaaaaaaaaaa

SEQ ID NO: 57214 - DNA, 1557 bp, Homo sapiens
atcgccttgaagttacgcttgaaggaggaaaactcatcaattttcggggaatcccggctttggcagcgtgctgctcatggttcgccgcggccacgtgggcatcttcttcatcgagggcggcgtccccttctggggaggagcctgcttcatcatctccggatccctctcagtggcagccgagaagaaccacaccagttgcctggtgaggagcagcctgggcaccaacatcctcagcgtcatggcggcctttgctgggacagccattctgctcatggattttggtgttaccaaccgggatgtggacaggggctatctggccgtgcttactatcttcactgtcctggagttcttcacagcggtcattgccatgcacttcgggtgccaagccatccatgcccaggccagtgcacctgtgatcttcctgccaaacgccttcagcgcagacttcaacatccccagcccggcagcctctgcgccccctgcctatgacaatgtggcatatgcccaaggagtcgtctgagtagcagatgtggcacctgcgggtggagtccagccttttccctctgggcccagcctctccccacccccaccttgttcatcaggggccagccccatcccagctgccctccctcaccacatctacacatactccggcatctgagtgaagtgtccccagggacatctctcccacactttccccagtgctttctttctaaaagacaccgggctgacgtcaggggtgtgtgtccttcagctccctgagccctgtcacccttccaggacacccaccttgtgcatctaagcatttctctgctcattggggaaatcctggcctcattggagactcaggttcgaggcctgccctgaccctcgggcctcgggaaggtcagagagcccggaatcctccagaatggaagagtctgactctggcattccacagaggtgccgataccaggccaaggcctcacagcagggtagtggcctggccgcaggtctcctggccccaagatcagctctgtcctttgtcatctgttgccacatccatggaactcaggtttcctatttggaaactagagtgttgaaccagataaggttcatcaggcccttccagctccccaggctccctgaagtcctgggtctaggccaggcattgtccccctgcttcctggaaaccctcattttccttgtctgtaatatgaagtcagcattggccccgccccccaccccctaccatctcccaatggaggggaggttgcaggggagagctgccgccagcccactcctgaggcaccaccacagtcagcatcgacaggggcacagcagtggcagtttgggacctccctgtgcctctcagcactcccttccccacccccatagcccaaggacaaggctaccacagaaggttaccacaggacctgggcttcgtctccaggggacaaggagacactgtcagcctggtgttcaccaggcctggtagatgagatggcttgtctcatccacaccacagaaggaaataaaccatgtggcttaaattttaaaaaaaaaaaaaaaaaaaaa

SEQ ID NO: 57215 - DNA, 1923 bp, Homo sapiens
cgcgcgaggtgagacggcgagggctcccggggcgcaggtagagatgttccgtcggtgccgaaggcccggctagtgcggttgtgtggacggcgaaaaaaaccaggccaggcgtcaaagcaagtcacccatccgacctaaacccctctaagaccctggagtcacgtctccctccggggatcctcgtgaggtcttgggggtcccaccgccctgcgagccgcgcccgcgccccgccagacccggaactgcgtcgctagaacgtcgggacctggttccctctttaatcacacccccgggggcgcttcgtgtgaggttccacgggggaaggcgagaggcgcaggctgccacacacgcactgtttggaagaggggaagcattgccccccctgcaccacctcaccaagatggctactttgggacacacattccccttctatgctggccccaagccaaccttcccgatggacaccactttggccagcatcatcatgatctttctgactgcactggccacgttcatcgtcatcctgcctggcattcggggaaagacgaggctgttctggctgcttcgggtggtgaccagcttattcatcggggctgcaatcctggctgtgaatttcagttctgagtggtctgtgggccaggtcagcaccaacacatcatacaaggccttcagttctgagtggatcagcgctgatattgggctgcaggtcgggctgggtggagtcaacatcacactcacagggacccccgtgcagcagctgaatgagaccatcaattacaacgaggagttcacctggcgcctgggtgagaactatgctgaggagtatgcaaaggctctggagaaggggctgccagaccctgtgttgtacctagctgagaagttcactccaagaagcccatgtggcctataccgccagtaccgcctggcgggacactacacctcagccatgctatgggtggcattcctctgctggctgctggccaatgtgatgctctccatgcctgtgctggtatatggtggctacatgctattggccacgggcatcttccagctgttggctctgctcttcttctccatggccacatcactcacctcaccctgtcccctgcacctgggcgcttctgtgctgcatactcaccatgggcctgccttctggatcacattgaccacaggactgctgtgtgtgctgctgggcctggctatggcggtggcccacaggatgcagcctcacaggctgaaggctttcttcaaccagagtgtggatgaagaccccatgctggagtggagtcctgaggaaggtggactcctgagcccccgctaccggtccatggctgacagtcccaagtcccaggacattcccctgtcagaggcttcctccaccaaggcatactatcgccccaggagactttccctggtgcctgcggatgtccgaggcctcgcgccagcagcgctcagtgcccttcctggagctctcctggcccaggcctggcgggcactgcttcccggcctgcgatgtcccaaggcggggaaggagtccagattgggtccccctcacagtccttggcgctttggtccagaagggtgcgaagagcgctgggccgaacatactggagactcaccacggcccctccgaggaagaggcacaggacgcctgtggcggtggggatcgaaagaaaggagggcatgtggagtcagggctatgttgcccaggctggtctcgaactctggcctcaaacgaccttcctgcctcgacctcccaaagtgctgggattacaggcgtgatgcccgggccttcttccatcttttggagcctaccccttgtgttacctcccgccacacacctctaatctgaattacatgaaacacggcaagacaccaaaaaaaaaaaaaaaaaaaaaaaaaaaaaaaaaaaaaaaaaaaaaa

SEQ ID NO: 57216 - DNA, 2092 bp, Homo sapiens
gcggccgccggagcccgagctgacgccgccttggcacccctcctggagttagaaactaaggccggggcccgcggcgctcggcgcgcaggccgcccggcttcctgcgtccatttccgcgtgctttcaaagaagacagagagaggcactgggttgggcttcatttttttcctccccatccccagtttctttctctttttaaaaataataattatcccaataattaaagccaattcccccctcccctcccccagtccctccccccaactcccccctcccccgcccgccggggcaggggagcgccacgaattgaccaagtgaagctacaactttgcgacataaattttggggtctcgaaccatgtcgctgaccaacacaaagacggggttttcggtcaaggacatcttagacctgccggacaccaacgatgaggagggctctgtggccgaaggtccggaggaagagaacgaggggcccgagccagccaagagggccgggccgctggggcagggcgccctggacgcggtgcagagcctgcccctgaagaaccccttctacgacagcagcgacaacccgtacacgcgctggctggccagcaccgagggccttcagtactccctgcacggtctggctgccggggcgccccctcaggactcaagctccaagtccccggagccctcggccgacgagtcaccggacaatgacaaggagaccccgggcggcgggggggacgccggcaagaagcgaaagcggcgagtgcttttctccaaggcgcagacctacgagctggagcggcgctttcggcagcagcggtacctgtcggcgcccgagcgcgaacacctggccagcctcatccgcctcacgcccacgcaggtcaagatctggttccagaaccaccgctacaagatgaagcgcgcccgggccgagaaaggtatggaggtgacgcccctgccctcgccgcgccgggtggccgtgcccgtcttggtcagggacggcaaaccatgtcacgcgctcaaagcccaggacctggcagccgccaccttccaggcgggcattcccttttctgcctacagcgcgcagtcgctgcagcacatgcagtacaacgcccagtacagctcggccagcaccccccagtacccgacagcacaccccctggtccaggcccagcagtggacttggtgagcgccgccccaacgagactcgcggccccaggcccaggccccaccccggcggcggtggcggcgaggaggcctcggtccttatggtggttattattattattataattattattatggagtcgagttgactctcggctccactagggaggcgccgggaggttgcctgcgtctccttggagtggcagattccacccacccagctctgcccatgcctctccttctgaaccttgggagagggctgaactctacgccgtgtttacagaatgtttgcgcagcttcgcttctttgcctctccccggggggaccaaaccgtcccagcgttaatgtcgtcacttgaaaacgagaaaaagaccgaccccccacccctgctttcgtgcattttgtaaaatatgtttgtgtgagtagcgatattgtcagccgtcttctaaagcaagtggagaacactttaaaaatacagagaatttcttcctttttttaaaaaaaaataagaaaatgctaaatatttatggccatgtaaacgttctgacaactggtggcagatttcgcttttcgttgtaaatatcggtggtgattgttgccaaaatgaccttcaggaccggcctgtttcccgtctgggtccaactcctttctttgtggcttgtttgggtttgttttttgttttgtttttgtttttgcgttttcccctgctttcttcctttctctttttattttattgtgcaaacatttctcaaatatggaaaagaaaaccctgtaggcagggagccctctgccctgtcctccgggccttcagccccgaacttggagctcagctattcggcgcggttccccaacagcgccgggcgcagaaagctttcgattttttaaataagaattttaataaaaatcctgtgtttaaaaaagaaaaaaagaaaaaa

SEQ ID NO: 57217 - DNA, 3039 bp, Homo sapiens
gccgcacccactcctgcccctgcctgcaccccacccacttcccggggacttccgagcccacgcccacatcctttacctccaaggggcaaggaagctgttgacttaagatcccatgtggagcagtcagatgctgctggagaactccccgcactgcaggctccagacacacgacctggcccctcccccgtggacgcctatactgctctgttctctaattccagggttcccaacctcggggttgtgccttgcaaatacctgggaaacttttctagctaatgcctaggcccctaccaacccagaaattcccatctaataatctagggtacagcctaggcattgaaacgttaagcctaagagaaatccggcgcacgcatccagtttccaccaccgaatttccagcttcttaaatctgcaggtccagaaaaagaagatgggagtgctgcccacgtcgcgcgctggggctacggccggccccacccctggcgctgccgcggccgtcccgcccttggacttgggcggcgcctggataaacacctgaacctgactgagctccgagccagggactcgggtgcctggggcagacgaggccggcttctccgcggacagctagggagagtgtcctgggtgtcagccagaacatgtctttcaacctgcaatcatcaaagaaactgttcattttcttaggaaaatcactgtttagtcttctggaggctatgatttttgccttactcccaaagccacggaagaacgttgctggtgaaatagtcctcatcacaggtgctggaagtggactcggaaggctcttagccttgcagtttgcccggctgggatctgttcttgttctctgggatatcaataaggaggggaatgaggaaacatgtaagatggctcgggaagctggagccacaagagtgcacgcctatacctgcgattgcagccaaaaggaaggagtgtatagagtagccgaccaggttaaaaaagaagtcggcgatgtttccatcctaatcaacaatgccggaatcgtaacaggcaaaaagttccttgactgtccagatgagcttatggaaaagtcatttgatgtgaatttcaaagcacatttatggacttataaagcctttctacctgctatgattgctaatgaccatggacatttggtttgcatttcaagttcagctggattaagtggagtaaatgggctggcagattactgtgcaagtaaatttgcagcctttgggtttgctgaatctgtatttgtagaaacatttgtccaaaaacaaaaggggatcaaaaccacgattgtgtgccccttttttataaaaactggaatgtttgaaggttgtactacaggctgtccttctctgttgccaattctggaaccaaaatatgcagttgaaaaaatagtagaagctattctacaagaaaaaatgtacttgtatatgccaaagttgttatacttcatgatgtttcttaaaagctttttgcccctcaagacaggactgcttatagctgactatttgggcatccttcatgcaatggatggctttgttgaccaaaagaagaagctctaaagaccaactctatggctaaggtcatctgatacacagtgttacataatgcgtacttcaatgaagaaaagtatttttgtctgacagtggaatatatctggagaccacaagtaccactcctattctgttatctggactagaattttcaatcaatgtgtttgaaaataatgttgctatcacctatttggttgagttttggttttttctttttctttttttttccaaaaataaagacagcccatttttgtcatttccattaccacagatgtaagaaagtgataagccatggccatgagctgccctgagctttggtcgttggggaggtggctcaaatggagccagcggctgtggttgacctgccttggggagcagggctgaggggcgaagaggacatgtggatatccagccagaatgccctctctccagaggacacacagctctggatttctacccccttgctatcctctctggccattttgaacctgtaccacctaatgtagaaaaggcccgcctccagtgcccttctttccaaaacagctacacaaatgcttctgaatgccctggatacgcagaccgagtggcagtctggctaaaggcccatccagcactattgtgcccaagagccttaccgggcattccctgaagccccctcataggcagtgatcctagaccaaactcttaaatagaatcacttttgtttcctagaagagatcaaagagtggttgcttcttactttgaagatgaaattataccaagttaggttttttgctatctattgatccaaaaaatatattcgtgcaattaaagttaagtgttcaacttagtatttcaagttgggattcaggttgaggcattttcctgcagaatgggcaattttatgcatttatattcatcagtgctgccctcactttggatctattgtattcttacagtttaatcaactggcaaagtgctttcatgctttggagattaactataaaagcaagattaagaaaaatatgttaattaccatatccctggaactccttctcaggctggtgggggcagccttgcaagagaaacagcagcctttgtctcttccctcttgtggggagcaaggaggggatgagcggtaccttgggagacccggtaaaagtctaaagaattgagaatttgactatcttgggggtaaaatgctgtcataggggcagcagtctcagggggtgtaaactctggaatccactatggtttaccttgagtggcctgcacgaacatgacagccctgatctgtatttcctttccattcagaaaaccttaaaaaaaaaaaacttgttttatgataatattataacaatcataactaacatttactgtgcccggcagcaaattaagtatttgacaaacattatttcattaaacgagactgtcaatcattactcaaagaatgatgaaggtatttggtgtatgccaaagaataaaggcgttttatttcaaa

SEQ ID NO: 57218 - DNA, 895 bp, Homo sapiens
gcggccgcgtcgaccggcgcggctggagcgcagcgccgaagggactggcagggctgaagtgtgcgggacagcaagcccccgaatagccccggctgccacctcgcaggacccaaggccacgcgcgccgggcccagctgagccgcctcatgaagccgcccgcggaggacctgtcggacgcgctgtgcgagtttgacgcggtgctggccgacttcgcgtcgcccttccacgagcgccacttccactacgaggagcacctggagcgcatgaagcggcgcagcagcgccagtgtcagcgacagcagcggcttcagcgactcggagagtgcagattcactttataggaacagcttcagcttcagtgatgaaaaactgaattctccaacagactctaccccagctcttctctctgccactgtcactcctcagaaagctaaattaggagacacaaaagagctagaagccttcattgctgatcttgacaaaactttagcaagtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttgaactgaacctcgtgcc

SEQ ID NO: 57219 - DNA, 7368 bp, Homo sapiens
caagctttcaagcattcaaaggtctaaatgaaaaaggctaagtattatttcaaaaggcaagtatatcctaatatagcaaaacaaacaaagcaaaatccatcagctactcctccaattgaagtgatgaagcccaaataattcatatagcaaaatggagaaaattagaccggccatctaaaaatctgccattggtgaagtgatgaagaacatttactgtcttattccgaagcttgtcaattttgcaactcttggctgcctatggatttctgtggtgcagtgtacagttttaaatagctgcctaaagtcgtgtgtaactaatctgggccagcagcttgaccttggcacaccacataatctgagtgaaccgtgtatccaaggatgtcacttttggaactctgtagatcagaaaaactgtgctttaaagtgtcgggagtcgtgtgaggttggctgtagcagcgcggaaggtgcatatgaagaggaagtactggaaaatgcagacctaccaactgctccctttgcttcttccattggaagccacaatatgacattacgatggaaatctgcaaacttctctggagtaaaatacatcattcagtggaaatatgcacaacttctgggaagctggacttatactaagactgtgtccagaccgtcctatgtggtcaagcccctgcaccccttcactgagtacattttccgagtggtttggatcttcacagcgcagctgcagctctactcccctccaagtcccagttacaggactcatcctcatggagttcctgaaactgcacctttgattaggaatattgagagctcaagtcccgacactgtggaagtcagctgggatccacctcaattcccaggtggacctattttgggttataacttaaggctgatcagcaaaaatcaaaaattagatgcagggacacagagaaccagtttccagttttactccactttaccaaatactatctacaggttttctattgcagcagtaaatgaagttggtgagggtccagaagcagaatctagtattaccacttcatcttcagcagttcaacaagaggaacagtggctctttttatccagaaaaacttctctaagaaagagatctttaaaacatttagtagatgaagcacattgccttcggttggatgctatataccataatattacaggaatatctgttgatgtccaccagcaaattgtttatttctctgaaggaactctcatatgggcgaagaaggctgccaacatgtctgatgtatctgacctgagaattttttacagaggttcaggattaatttcttctatctccatagattggctttatcaaagaatgtatttcatcatggatgaactggtatgtgtctgtgatttagagaactgctcaaacatcgaggaaattactccaccctctattagtgcacctcaaaaaattgtggctgattcatacaatgggtatgtcttttacctcctgagagatggcatttatagagcagaccttcctgtaccatctggccggtgtgcagaagctgtgcgtattgtggagagttgcacgttaaaggactttgcaatcaagccacaagccaagcgaatcatttacttcaatgacactgcccaagtcttcatgtcaacatttctggatggctctgcttcccatctcatcctacctcgcatcccctttgctgatgtgaaaagttttgcttgtgaaaacaatgactttcttgtcacagatggcaaggtcattttccaacaggatgctttgtcttttaatgaattcatcgtgggatgtgacctgagtcacatagaagaatttgggtttggtaacttggtcatctttggctcatcctcccagctgcaccctctgccaggccgcccgcaggagctttcggtgctgtttggctctcaccaggctcttgttcaatggaagcctcctgcccttgccataggagccaatgtcatcctgatcagtgatattattgaactctttgaattaggcccttctgcctggcagaactggacctatgaggtgaaagtatccacccaagaccctcctgaagtcactcatattttcttgaacataagtggaaccatgctgaatgtacctgagctgcagagtgctatgaaatacaaggtttctgtgagagcaagttctccaaagaggccaggcccctggtcagagccctcagtgggtactaccctggtgccagctagtgaaccaccatttatcatggctgtgaaagaagatgggctttggagtaaaccattaaatagctttggcccaggagagttcttatcctctgatataggaaatgtgtcagacatggattggtataacaacagcctctactacagtgacacgaaaggcgacgtttttgtgtggctgctgaatgggacggatatctcagagaattatcacctacccagcattgcaggagcaggggctttagcttttgagtggctgggtcactttctctactgggctggaaagacatatgtgatacaaaggcagtctgtgttgacgggacacacagacattgttacccacgtgaagctattggtgaatgacatggtggtggattcagttggtggatatctctactggaccacactctattcagtggaaagcaccagactaaatggggaaagttcccttgtactacagacacagccttggttttctgggaaaaaggtaattgctctaactttagacctcagtgatgggctcctgtattggttggttcaagacagtcaatgtattcacctgtacacagctgttcttcggggacagagcactggggataccaccatcacagaatttgcagcctggagtacttctgaaatttcccagaatgcactgatgtactatagtggtcggctgttctggatcaatggctttaggattatcacaactcaagaaataggtcagaaaaccagtgtctctgttttggaaccagccagatttaatcagttcacaattattcagacatcccttaagcccctgccagggaacttttcctttacccctaaggttattccagattctgttcaagagtcttcatttaggattgaaggaaatgcttcaagttttcaaatcctgtggaatggtccccctgcggtagactggggtgtagttttctacagtgtagaatttagtgctcattctaagttcttggctagtgaacaacactctttacctgtatttactgtggaaggactggaaccttatgccttatttaatctttctgtcactccttatacctactggggaaagggccccaaaacatctctgtcacttcgagcacctgaaacagttccatcagcaccagagaaccccagaatatttatattaccaagtggaaaatgctgcaacaagaatgaagttgtggtggaatttaggtggaacaaacctaagcatgaaaatggggtgttaacaaaatttgaaattttctacaatatatccaatcaaagtattacaaacaaaacatgtgaagactggattgctgtcaatgtcactccctcagtgatgtcttttcaacttgaaggcatgagtcccagatgctttattgccttccaggttagggcctttacatctaaggggccaggaccatatgctgacgttgtaaagtctacaacatcagaaatcaacccatttcctcacctcataactcttcttggtaacaagatagtttttttagatatggatcaaaatcaagttgtgtggacgttttcagcagaaagagttatcagtgccgtttgctacacagctgataatgagatgggatattatgctgaaggggactcactctttcttctgcacttgcacaatcgctctagctctgagcttttccaagattcactggtttttgatatcacagttattacaattgactggatttcaaggcacctctactttgcactgaaagaatcacaaaatggaatgcaagtatttgatgttgatcttgaacacaaggtgaaatatcccagagaggtgaagattcacaataggaattcaacaataatttctttttctgtatatcctcttttaagtcgcttgtattggacagaagtttccaattttggctaccagatgttctactacagtattatcagtcacaccttgcaccgaattctgcaacccacagctacaaaccaacaaaacaaaaggaatcaatgttcttgtaatgtgactgaatttgagttaagtggagcaatggctattgatacctctaacctagagaaaccattgatatactttgccaaagcacaagagatctgggcaatggatctggaaggctgtcagtgttggagagttatcacagtacctgctatgctcgcaggaaaaacccttgttagcttaactgtggatggagatcttatatactggatcatcacagcaaaggacagcacacagatttatcaggcaaagaaaggaaatggggccatcgtttcccaggtgaaggccctaaggagtaggcatatcttggcttacagttcagttatgcagccttttccagataaagcgtttctgtctctagcttcagacactgtggaaccaactatacttaatgccactaacactagcctcacaatcagattacctctggccaagacaaacctcacatggtatggcatcaccagccctactccaacatacctggtttattatgcagaagttaatgacaggaaaaacagctctgacttgaaatatagaattctggaatttcaggacagtatagctcttattgaagatttacaaccattttcaacatacatgatacagatagctgtaaaaaattattattcagatcctttggaacatttaccaccaggaaaagagatttggggaaaaactaaaaatggagtaccagaggcagtgcagctcattaatacaactgtgcggtcagacaccagcctcattatatcttggagagaatctcacaagccaaatggacctaaagaatcagtccgttatcagttggcaatctcacacctggccctaattcctgaaactcctctaagacaaagtgaatttccaaatggaaggctcactctccttgttactagactgtctggtggaaatatttatgtgttaaaggttcttgcctgccactctgaggaaatgtggtgtacagagagtcatcctgtcactgtggaaatgtttaacacaccagagaaaccttattccttggttccagagaacactagtttgcaatttaattggaaggctccattgaatgttaacctcatcagattttgggttgagctacagaagtggaaatacaatgagttttaccatgttaaaacttcatgcagccaaggtcctgcttatgtctgtaatatcacaaatctacaaccttatacttcatataatgtcagagtagtggtggtttataagacgggagaaaatagcacctcacttccagaaagctttaagacaaaagctggagtcccaaataaaccaggcattcccaaattactagaagggagtaaaaattcaatacagtgggagaaagctgaagataatggatgtagaattacatactatatccttgagataagaaagagcacttcaaataatttacagaaccagaatttaaggtggaagatgacatttaatggatcctgcagtagtgtttgcacatggaagtccaaaaacctgaaaggaatatttcagttcagagtagtagctgcaaataatctagggtttggtgaatatagtggaatcagtgagaatattatattagttggagatgatttttggataccagaaacaagtttcatacttactattatagttggaatatttctggttgttacaatcccactgacctttgtctggcatagaagattaaagaatcaaaaaagtgccaaggaaggggtgacagtgcttataaacgaagacaaagagttggctgagctgcgaggtctggcagccggagtaggcctggctaatgcctgctatgcaatacatactcttccaacccaagaggagattgaaaatcttcctgccttccctcgggaaaaactgactctgcgtctcttgctgggaagtggagcctttggagaagtgtatgaaggaacagcagtggacatcttaggagttggaagtggagaaatcaaagtagcagtgaagactttgaagaagggttccacagaccaggagaagattgaattcctgaaggaggcacatctgatgagcaaatttaatcatcccaacattctgaagcagcttggagtttgtctgctgaatgaaccccaatacattatcctggaactgatggagggaggagaccttcttacttatttgcgtaaagcccggatggcaacgttttatggtcctttactcaccttggttgaccttgtagacctgtgtgtagatatttcaaaaggctgtgtctacttggaacggatgcatttcattcacagggatctggcagctagaaattgccttgtttccgtgaaagactataccagtccacggatagtgaagattggagactttggactcgccagagacatctataaaaatgattactatagaaagagaggggaaggcctgctcccagttcggtggatggctccagaaagtttgatggatggaatcttcactactcaatctgatgtatggtcttttggaattctgatttgggagattttaactcttggtcatcagccttatccagctcattccaaccttgatgtgttaaactatgtgcaaacaggagggagactggagccaccaagaaattgtcctgatgatctgtggaatttaatgacccagtgctgggctcaagaacccgaccaaagacctacttttcatagaattcaggaccaacttcagttattcagaaattttttcttaaatagcatttataagtccagagatgaagcaaacaacagtggagtcataaatgaaagctttgaaggtgaagatggcgatgtgatttgtttgaattcagatgacattatgccagttgctttaatggaaacgaagaaccgagaagggttaaactatatggtacttgctacagaatgtggccaaggtgaagaaaagtctgagggtcctctaggctcccaggaatctgaatcttgtggtctgaggaaagaagagaaggaaccacatgcagacaaagatttctgccaagaaaaacaagtggcttactgcccttctggcaagcctgaaggcctgaactatgcctgtctcactcacagtggatatggagatgggtctgattaatagcgttgtttgggaaatagagagttgagataaacactctcattcagtagttactgaaagaaaactctgctagaatgataaatgtcatggtggtctataactccaaataaacaatgcaacgttcc

SEQ ID NO: 57220 - DNA, 2829 bp, Homo sapiens
catggccaagctcacccttctcactggtctgctccttgtgctgacagctgaaataggctctgcctaccagctgacatgttacttcaccaactgggcccagaaccagccaggcctggggtgcttcaagcctgatgacatcgacccctgcctctgtacccacttgatctacgcctttgctggaatgcagaacaacgagatcaccaccatcgaatgggatgacatgactctctaccaagctttcaatggcctgaaaaacaagtaaatgacggaaaacctgagtttcaaatcttttaacctttaaggacagtttaaacaagatcttccacagcagacttcaggctgaaattccaaacaggccaacaagcaggtaaattcagctttcttattatttcaagtgcaagaatgactctaattttaaggggaatggctggctcacagaagctagctgctaactaaagcccagctcagttgccaagggaagcttataagtccaactactggtggactcagttgagaacaatcttccacttagaagcaatccaaagctggcattgataaagcattcagtctccttggtcaggagattcactcctagggaaataattggaactgtggagacattggggtacagcaaaccaacatggcacatgtatacctatgtaacaaacctgcacattgtgcacatgtaccctggaacttaaagtatatttaaaaaaaaaactgtggagacattgaaacataccaatcatagtcacctactccaacattcataagtaggaaataaggataagaacaaagataaaccaggatgagaggctgcatgacactttcctggcttcttgctcactattgcagctaaatgttgaaatggcttccctttcttttcatttgttctggtaaaacactttgtttcttttccctcagaaatagtcaactgaaaactctcttggctattggtggctggaactttggcactgctcctttcactgccatggtttccactcctgagaaccaccagactttcatcaactcagtcatcaaattcctgcgccagtatgagtttgacgggctggactttgactgggagtaccccggctctcgtgtgagccctcctcaggacaagcatctcttcactgtcctggtgcaggaaatgcgtgaagcttttgagcaggaggccaagcacattaataagcccaggctgatggtcactgctgcagtagctgctggcatctccaacatccagtctggctatgagatcccccaactgtcacagtacccggactacatccatgtcatgacctatgacctccatggctcctgggagggctacactggagagaacagccccctctacaaatacccgactgacaccggcagcaacgcctacctcaatgtggattatgtcatgaactactggaaggacaacagggccccagctgagaagctcatgttggattcccagcctatggacactccttccttctgagcaacccctccaaccatggaattgatgcccctaccactggtcctggccctgctggaccctataccaggcagtctgggttctgggcctactatgagatctgtaccttcctgaagaatggagctactgaagtatgggaggcttctgaggatgttccctatgcctacaaaggaaatgagtggcttggatacgataacaccaagagtttccaaatcaaggcagattggctaaagaagaacaactttggaggtgccatggtctgggccattgacctggatgatttcacaggcactttctgcaaccaaggaaaattccctctgatcaccaccctgaaggatgctctgggcctgcagagtacaagtgagttagggagtgagaagggacactaagcctcagacttaagagaaattccaaaggttccttggaagtcatggagctgttgcacaagtaattgtctgacattgtccattcctatctggtaacaattgattaatggtgggaagaacaaacagggctcttcaccatttcttccttccttcattcatttcacaagaaatttattgaacatctattacatatacagtgctctgtaggtaccacaggtgatctaaatgcataaatatccatatctactctatggaaatttacaatctagtgagagaaattggatttacaaaaactgcaaagctagacaacaatacagaagatattatgtgatactgtgccccctaaaagaataagtaaccttcttgtgagttcatgataatgaaaaatttcaatcagtaagatgtaaggaggaaaaaatgcactgtgacttgaaggatgaggaaggagttggtaagcaaaggggtgagtggagcaggaaggatatatcagatcagaagactgaaatatgtggagacatagaaggaggagccaagaacaaaatccaggtactagctctcacacatcaggtatcactggctaaaagcaaggaggttcaggatttgttttcttttttcttctcaggttgcaaagctccagcccaacccattgctcccattgccgaggcaaacatcacatgcggtgtcagccacagtcgtagctctgggggccgctctggcaggagctctgggggcagccccagaggtagtggattctgtgctgacagggccagtggcctgtaccctgaccccactgacaagaatgcctcctacagttgtgtgaatggaaagactttcactcagcactgccagcctggtggtgtctttgataccttctgctcctgctgcagctggtgataacatttttcagatatcacctcacccagcctcagaagttgttgtgcaataaaaggttgagcatta

SEQ ID NO: 57221 - DNA, 472 bp, Homo sapiens
cagagacggaaccagagacaggccagagcatccccctcctccaccatgaaactcgctgtcaccctcaccctggtcacactggctctctgctgcagctccgcttctgcagagatctgcccgagctttcagcgtgtcatcgaaaccctcctcatggacacaccctccagttatgaggctgccatggaacttttcagccctgatcaagacatgagggaggcaggggctcagctgaagaagctggtggacaccctcccccaaaagcccagagaaagcatcattaagctcatggaaaaaatagcccaaagctcactgtgtaattagcatttagaagctgaagatccccaactgctccagcctctgccgctgccatgctttgagtccacgcccaccagccttgctctcttcaataaaccacaagcatctcaaaaaaaaaaaaaaaaaaaaaaaaaaaaaaaaaaaaaaaaaaaaaaaa

SEQ ID NO: 57222 - DNA, 968 bp, Homo sapiens
ccaagcagctggaggctctgtgtgtgggtcgctgatttcttggagcctgaaaagaaagtaacacagcagggatgaggacagatggtgtgagtcagtgagagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtctcaaaggagaccctggccctccaggccccatgggtccacctggagaaatgccatgtcctcctggaaatgatgggctgcctggagcccctggtatccctggagagtgtggagagaagggggagcctggcgagaggggccctccagggcttccagctcatctagatgaggagctccaagccacactccacgactttagacatcaaatcctgcagacaaggggagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaaca

SEQ ID NO: 57223 - DNA, 2026 bp, Homo sapiens
gccatggctgagtcacacctgctgcagtggctgctgctgctgctgcccacgctctgtggcccaggcactgctgcctggaccacctcatccttggcctgtgcccagggccctgagttctggtgccaaagcctggagcaagcattgcagtgcagagccctagggcattgcctacaggaagtctggggacatgtgggagccgatgacctatgccaagagtgtgaggacatcgtccacatccttaacaagatggccaaggaggccattttccaggacacgatgaggaagttcctggagcaggagtgcaacgtcctccccttgaagctgctcatgccccagtgcaaccaagtgcttgacgactacttccccctggtcatcgactacttccagaaccagactgactcaaacggcatctgtatgcacctgggcctgtgcaaatcccggcagccagagccagagcaggagccagggatgtcagaccccctgcccaaacctctgcgggaccctctgccagaccctctgctggacaagctcgtcctccctgtgctgcccggggccctccaggcgaggcctgggcctcacacacaggatctctccgagcagcaattccccattcctctcccctattgctggctctgcagggctctgatcaagcggatccaagccatgattcccaagggtgcgctagctgtggcagtggcccaggtgtgccgcgtggtacctctggtggcgggcggcatctgccagtgcctggctgagcgctactccgtcatcctgctcgacacgctgctgggccgcatgctgccccagctggtctgccgcctcgtcctccggtgctccatggatgacagcgctggcccaaggtcgccgacaggagaatggctgccgcgagactctgagtgccacctctgcatgtccgtgaccacccaggccgggaacagcagcgagcaggccataccacaggcaatgctccaggcctgtgttggctcctggctggacagggaaaagtgcaagcaatttgtggagcagcacacgccccagctgctgaccctggtgcccaggggctgggatgcccacaccacctgccaggccctcggggtgtgtgggaccatgtccagccctctccagtgtatccacagccccgacctttgatgagaactcagctgtccagctgcaaaggaaaagccaagtgagacgggctctgggaccatggtgaccaggctcttcccctgctccctggccctcgccagctgccaggctgaaaagaagcctcagctcccacaccgccctcctcaccgcccttcctcggcagtcacttccactggtggaccacgggcccccagccctgtgtcggccttgtctgtctcagctcaaccacagtctgacaccagagcccacttccatcctctctggtgtgaggcacagcgagggcagcatctggaggagctctgcagcctccacacctaccacgacctcccagggctgggctcaggaaaaaccagccactgctttacaggacagggggttgaagctgagccccgcctcacacccacccccatgcactcaaagattggattttacagctacttgcaattcaaaattcagaagaataaaaaatgggaacatacagaactctaaaagatagacatcagaaattgttaagttaagctttttcaaaaaatcagcaattccccagcgtagtcaagggtggacactgcacgctctggcatgatgggatggcgaccgggcaagctttcttcctcgagatgctctgctgcttgagagctattgctttgttaagatataaaaaggggtttctttttgtctttctgtaaggtggacttccagcttttgattgaaagtcctagggtgattctatttctgctgtgatttatctgctgaaagctcagctggggttgtgcaagctagggacccattcctgtgtaatacaatgtctgcaccaatgctaataaagtcctattctcttttatgaaaaaaaaaaaaaaaaaaaaaaaaaaaaaaaaaaaaa

SEQ ID NO: 57224 - DNA, 3309 bp, Homo sapiens
ggcggagagaataaagcagaaagacaggaagaggaggtggagttctacagttagtgtggttttagtttttcctaagaagtggcgtggtttggggctttatatccgggaggagcatatgtacgcaaatcctggggcgtttgcaaacccggatccggggcgtctggccccatgcccggccgggcgtttgagggctactgccacgcagcgtttctggagcctgccggctggtgccctggtggcctttatctctgtccccctttgtcctctttatctcaggctctccaggaggccggggggcccactccgcctatcgctcccctcggctacgctgccacttcaatgccccgcaggtcgcgagctgctgttctttcgaaggcgtcggagaaccaggggcgtcccgcgccacctctgactcggagcagcgccgagcactgacgctcccgcccttgggcaaggacgccagtgcgcccgcgcgcgtccctctgcgcggcagcccgtcgcgggccctcaaggggaagcccaggccaggatggccccgggtcgcgcggtggccgggctcctgttgctggcggccgccggcctcggaggagtggcggaggggccagggctagccttcagcgaggatgtgctgagcgtgttcggcgcgaatctgagcctgtcggcggcgcagctccagcacttgctggagcagatgggagccgcctcccgcgtgggcgtcccggagcctggccagctgcacttcaaccagtgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaagtttggggatatggattcctgtcagtgacgattattaatctggcatctctcctcggattgattttgactccactgataaagaaatcttatttcccaaagattttgaccttttttgtggggctggctattgggactcttttttcaaatgcaattttccaacttattccagaggcatttggatttgatcccaaagtcgacagttatgttgagaaggcagttgctgtgtttggtggattttacctacttttcttttttgaaagaatgctaaagatgttattaaagacatatggtcagaatggtcatacccactttggaaatgataactttggtcctcaagaaaaaactcatcaacctaaagcattacctgccatcaatggtgtgacatgctatgcaaatcctgctgtcacagaagctaatggacatatccattttgataatgtcagtgtggtatctctacaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaaggtaactggaagaaaaaccgatttcaccttcttcatgattcagaatgctggaatgttaactggattcacagccattctactcattaccttgtatgcaggagaaatcgaattggagtaatagaaaatggaagatggtgttgttaataaaggcatttaatagataaaaacatctccaaaaaggattttgaagctgatcctatttagttaaaaagataattttgctttcaactgtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattagatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtataaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgatcgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaatagtaaacacccttttgaaaccatgaaaaaaaaaaaaaaaaa

SEQ ID NO: 57225 - DNA, 2470 bp, Homo sapiens
tgtggacctgggcgagtgactcgttgtgtgctgtgcccgcaggagatgctgcaggataagggcctgtccgagagcgaggaggccttccgggccccgggcccagcgctcggagaggccagcgcagccaacgcccccgagcccgcgctggcagcgccgggcctcagcggagccgcgctaggcagccccccgggacccggggccgacgtcgtcgccgccgccgccgcggagcagaccatcgagaacatcaaggtggggctgcatgagaaggagctctggaagaagttccacgaggcgggcaccgagatgatcatcactaaggctggcaggaggatgttccccagctacaaggtaaaagtcacaggcatgaaccccaagaccaagtatatcctgctgattgacattgtccctgccgatgaccatcgctacaagttctgtgacaacaaatggatggtggcagggaaggctgagccagccatgccaggaaggctgtatgtccacccggattctcctgccacaggagcccactggatgcggcagctggtctccttccagaagctgaagctgacaaacaaccacctggacccctttggccatatcatcctcaactctatgcacaagtaccagccgcggctccacatcgttaaggctgatgagaacaatgctttcggctccaaaaacactgctttctgcacccacgtgttcccagagacctccttcatctctgtgacctcctaccagaatcacaagatcacccagctgaaaattgagaacaacccttttgccaagggattccggggcagtgatgacagtgacctgcgtgtggcccgactgcagagcaaagaataccccgtgatttccaaaagcatcatgaggcagaggctcatctccccccagctctcagccacaccggacgtgggccccctgctcggcacccaccaggcactccagcactaccagcacgagaacggggcacactcacagctcgcggagccgcaggacctgcccctcagcacctttcccacccagagggactcaagcctcttctatcactgcctgaaaagacgagacggtacccgccacctggacttaccttgcaagcgatcctatctggaagccccctcttcggtgggggaggatcactatttccgttccccccctccctacgaccagcaaatgctgagcccctcctactgcagtgaggtgacccccagagaagcatgtatgtactcaggttcagggcccgagattgccggggtgtctggggtggacgacctgcccccacctccgctgagctgtaacatgtggacttcagtgtcgccgtacaccagctatagcgtgcagacgatggagactgtgccgtaccagcccttccccacgcacttcaccgccaccaccatgatgccgcggctgcccaccctctccgctcagagctcccagccaccaggaaatgcccactttagtgtctacaatcagctctcccagtctcaggtccgagagcgggggcccagcgcctcattcccaagagagcgcggcctcccccaagggtgtgagaggaagccaccctcgccacatctaaatgctgccaatgagtttctctactctcaaaccttctccttgtcccgagaatcttccttacagtaccattcaggaatggggactgtggagaactggactgacggatgactctcacgtctcctccatagccccgggaccgtgttgctccagtattaacctctgtgggtggcctgcactctaccaagaaacacaggaaggtattccagtgtgtgtgtgtgtgtgtgtgtgtgtgtgtgtgtgtgtgtatacacgagcatgtatgtatttggagagcatccatcttctgacatacaactgaggtcatgacaaggaaaaaaaacaccacatttatctaagaagtgattttggctgcaggacctgggtctattgttatctgacatctcttgacatgcccgtgggtgggatgggagtggagggttcatatgagttattgagagggttttataatggttgatttactcaggggccaggtggggagttctctcccatggggaaagattctcactgctggggtgggaagattctcgctgctggggtgtgaggactctgtgcacaccttagagttcctggccttctctttgcaaggggagctgagaatctggttttggtagcaggaggcccactcctttgacttctggagagtctgtgagactgcctgagaggtgggctcagctaagccacaatgtgtactttgatagtacagctggctgctcagtgagtggcctagacattgatgactggagctctgaggtctgagggatgacgttcggaaagggtcatgggctaaatgtcacctgaggggtatttttaaagggtttttttttcccttcaagaggagggaaaatgcaaccagtagcatctctgtcatcattcagattttgtaataaagtacaga

SEQ ID NO: 57226 - DNA, 2352 bp, Homo sapiens
gaaacttaaaggtgtttaccttgtcatcagcatgtaagctaattatctcgggcaagatgtaggcttctattgtcttgttgctttagcgcttacgccccgcctctggtggctgcctaaaacctggcgccgggctaaaacaaacgcgaggcagcccccgagcctccactcaagccaattaaggaggactcggtccactccgttacgtgtacatccaacaagatcggcgttaaggtaacaccagaatatttggcaaagggagaaaaaaaaagcagcgaggcttcgccttccccctctcccttttttttcctcctcttccttcctcctccagccgccgccgaatcatgtcgatgagtccaaagcacacgactccgttctcagtgtctgacatcttgagtcccctggaggaaagctacaagaaagtgggcatggagggcggcggcctcggggctccgctggcggcgtacaggcagggccaggcggcaccgccaacagcggccatgcagcagcacgccgtggggcaccacggcgccgtcaccgccgcctaccacatgacggcggcgggggtgccccagctctcgcactccgccgtggggggctactgcaacggcaacctgggcaacatgagcgagctgccgccgtaccaggacaccatgaggaacagcgcctctggccccggatggtacggcgccaacccagacccgcgcttccccgccatctcccgcttcatgggcccggcgagcggcatgaacatgagcggcatgggcggcctgggctcgctgggggacgtgagcaagaacatggccccgctgccaagcgcgccgcgcaggaagcgccgggtgctcttctcgcaggcgcaggtgtacgagctggagcgacgcttcaagcaacagaagtacctgtcggcgccggagcgcgagcacctggccagcatgatccacctgacgcccacgcaggtcaagatctggttccagaaccaccgctacaaaatgaagcgccaggccaaggacaaggcggcgcagcagcaactgcagcaggacagcggcggcggcgggggcggcgggggcaccgggtgcccgcagcagcaacaggctcagcagcagtcgccgcgacgcgtggcggtgccggtcctggtgaaagacggcaaaccgtgccaggcgggtgcccccgcgccgggcgccgccagcctacaaggccacgcgcagcagcaggcgcagcaccaggcgcaggccgcgcaggcggcggcagcggccatctccgtgggcagcggtggcgccggccttggcgcacacccgggccaccagccaggcagcgcaggccagtctccggacctggcgcaccacgccgccagccccgcggcgctgcagggccaggtatccagcctgtcccacctgaactcctcgggctcggactacggcaccatgtcctgctccaccttgctatacggtcggacctggtgagaggacgccgggccggccctagcccagcgctctgcctcaccgcttccctcctgcccgccacacagaccaccatccaccgctgctccacgcgcttcgacttttcttaacaacctggccgcgtttagaccaaggaacaaaaaaaccacaaaggccaaactgctggacgtctttctttttttccccccctaaaatttgtgggtttttttttttaaaaaaagaaaatgaaaaacaaccaagcgcatccaatctcaaggaatctttaagcagagaagggcataaaacagctttggggtgtctttttttggtgattcaaatgggttttccacgctagggcggggcacagattggagagggctctgtgctgacatggctctggactctaaagaccaaacttcactctgggcacactctgccagcaaagaggactcgcttgtaaataccaggatttttttttttttttgaagggaggacgggagctggggagaggaaagagtcttcaacataacccacttgtcactgacacaaaggaagtgccccctccccggcaccctctggccgcctaggctcagcggcgaccgccctccgcgaaaatagtttgtttaatgtgaacttgtagctgtaaaacgctgtcaaaagttggactaaatgcctagtttttagtaatctgtacattttgttgtaaaaagaaaaaccactcccagtccccagcccttcacattttttatgggcattgacaaatctgtgtatattatttggcagtttggtatttgcggcgtcagtctttttctgttgtaacttatgtagatatttggcttaaatatagttcctaagaagcttctaataaattatacaaattaaaaagattctttttctgattaaaaaaaaaaaaaaaaaa

SEQ ID NO: 57227 - protein, 1704 aa, Homo sapiens
MAVLRQLALLLWKNYTLQKRKVLVTVLELFLPLLFPGILIWLRLKIQSENVPNATIYPGQSIQELPLFFTFPPPGDTWELAYIPSHSDAAKTVTETVRRALVINMRVRGFPSEKDFEDYIRYDNCSSSVLAAVVFEHPFNHSKEPLPLAVKYHLRFSYTRRNYMWTQTGSFFLKETEGWHTTSLFPLFPNPGPRELTSPDGGEPGYIREGFLAVQHAVDRAIMEYHADAATRQLFQRLTVTIKRFPYPPFIADPFLVAIQYQLPLLLLLSFTYTALTIARAVVQEKERRLKEYMRMMGLSSWLHWSAWFLLFFLFLLIAASFMTLLFCVKVKPNVAVLSRSDPSLVLAFLLCFAISTISFSFMVSTFFSKANMAAAFGGFLYFFTYIPYFFVAPRYNWMTLSQKLCSCLLSNVAMAMGAQLIGKFEAKGMGIQWRDLLSPVNVDDDFCFGQVLGMLLLDSVLYGLVTWYMEAVFPGQFGVPQPWYFFIMPSYWCGKPRAVAGKEEEDSDPEKALRNEYFEAEPEDLVAGIKIKHLSKVFRVGNKDRAAVRDLNLNLYEGQITVLLGHNGAGKTTTLSMLTGLFPPTSGRAYISGYEISQDMVQIRKSLGLCPQHDILFDNLTVAEHLYFYAQLKGLSRQKCPEEVKQMLHIIGLEDKWNSRSRFLSGGMRRKLSIGIALIAGSKVLILDEPTSGMDAISRRAIWDLLQRQKSDRTIVLTTHFMDEADLLGDRIAIMAKGELQCCGSSLFLKQKYGAGYHMTLVKEPHCNPEDISQLVHHHVPNATLESSAGAELSFILPRESTHRFEGLFAKLEKKQKELGIASFGASITTMEEVFLRVGKLVDSSMDIQAIQLPALQYQHERRASDWAVDSNLCGAMDPSDGIGALIEEERTAVKLNTGLALHCQQFWAMFLKKAAYSWREWKMVAAQVLVPLTCVTLALLAINYSSELFDDPMLRLTLGEYGRTVVPFSVPGTSQLGQQLSEHLKDALQAEGQEPREVLGDLEEFLIFRASVEGGGFNERCLVAASFRDVGERTVVNALFNNQAYHSPATALAVVDNLLFKLLCGPHASIVVSNFPQPRSALQAAKDQFNEGRKGFDIALNLLFAMAFLASTFSILAVSERAVQAKHVQFVSGVHVASFWLSALLWDLISFLIPSLLLLVVFKAFDVRAFTRDGHMADTLLLLLLYGWAIIPLMYLMNFFFLGAATAYTRLTIFNILSGIATFLMVTIMRIPAVKLEELSKTLDHVFLVLPNHCLGMAVSSFYENYETRRYCTSSEVAAHYCKKYNIQYQENFYAWSAPGVGRFVASMAASGCAYLILLFLIETNLLQRLRGILCALRRRRTLTELYTRMPVLPEDQDVADERTRILAPSPDSLLHTPLIIKELSKVYEQRVPLLAVDRLSLAVQKGECFGLLGFNGAGKTTTFKMLTGEESLTSGDAFVGGHRISSDVGKVRQRIGYCPQFDALLDHMTGREMLVMYARLRGIPERHIGACVENTLRGLLLEPHANKLVRTYSGGNKRKLSTGIALIGEPAVIFLDEPSTGMDPVARRLLWDTVARARESGKAIIITSHSMEECEALCTRLAIMVQGQFKCLGSPQHLKSKFGSGYSLRAKVQSEGQQEALEEFKAFVDLTFPGSVLEDEHQGMVHYHLPGRDLSWAKVFGILEKAKEKYGVDDYSVSQISLEQVFLSFAHLQPPTAEEGR

SEQ ID NO: 57228 - protein, 889 aa, Homo sapiens
MLPAPAAPRWPPLLLLLLLLLPLARGAPARPAAGGQASELVVPTRLPGSAGELALHLSAFGKGFVLRLAPDDSFLAPEFKIERLGGSGRATGGERGLRGCFFSGTVNGEPESLAAVSLCRGLSGSFLLDGEEFTIQPQGAGGSLAQPHRLQRWGPAGARPLPRGPEWEVETGEGQRQERGDHQEDSEEESQEEEAEGASEPPPPLGATSRTKRFVSEARFVETLLVADASMAAFYGADLQNHILTLMSVAARIYKHPSIKNSINLMVVKVLIVEDEKWGPEVSDNGGLTLRNFCNWQRRFNQPSDRHPEHYDTAILLTRQNFCGQEGLCDTLGVADIGTICDPNKSCSVIEDEGLQAAHTLAHELGHVLSMPHDDSKPCTRLFGPMGKHHVMAPLFVHLNQTLPWSPCSAMYLTELLDGGHGDCLLDAPGAALPLPTGLPGRMALYQLDQQCRQIFGPDFRHCPNTSAQDVCAQLWCHTDGAEPLCHTKNGSLPWADGTPCGPGHLCSEGSCLPEEEVERPKPVVDGGWAPWGPWGECSRTCGGGVQFSHRECKDPEPQNGGRYCLGRRAKYQSCHTEECPPDGKSFREQQCEKYNAYNYTDMDGNLLQWVPKYAGVSPRDRCKLFCRARGRSEFKVFEAKVIDGTLCGPETLAICVRGQCVKAGCDHVVDSPRKLDKCGVCGGKGNSCRKVSGSLTPTNYGYNDIVTIPAGATNIDVKQRSHPGVQNDGNYLALKTADGQYLLNGNLAISAIEQDILVKGTILKYSGSIATLERLQSFRPLPEPLTVQLLTVPGEVFPPKVKYTFFVPNDVDFSMQSSKERATTNIIQPLLHAQWVLGDWSECSSTCGAGWQRRTVECRDPSGQASATCNKALKPEDAKPCESQLCPL

SEQ ID NO: 57229 - protein, 524 aa, Homo sapiens
MISPFLVLAIGTCLTNSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSPVPLRHETHGGEDVAVFSKGPMAHLLHGVHEQNYVPHVMAYAACIGANLGHCAPASSAGSLAAGPLLLALALYPLSVLF

SEQ ID NO: 57230 - protein, 175 aa, Homo sapiens
MTDCEFGYIYRLAQDYLQCVLQIPQPGSGPSKTSRVLQNVAFSVQKEVEKNLKSCLDNVNVVSVDTARTLFNQVMEKEFEDGIINWGRIVTIFAFEGILIKKLLRQQIAPDVDTYKEISYFVAEFIMNNTGEWIRQNGGWENGFVKKFEPKSGWMTFLEVTGKICEMLSLLKQYC

SEQ ID NO: 57231 - protein, 566 aa, Homo sapiens
MKMQKGNVLLMFGLLLHLEAATNSNETSTSANTGSSVISSGASTATNSGSSVTSSGVSTATISGSSVTSNGVSIVTNSEFHTTSSGISTATNSEFSTASSGISIATNSESSTTSSGASTATNSESSTPSSGASTATNSDSSTTSSGASTATNSDSSTTSSEASTATNSESSTTSSGASTATNSESSTVSSRASTATNSESSTTSSGASTATNSESRTTSNGAGTATNSESSTTSSGASTATNSESSTPSSGAGTATNSESSTTSSGAGTATNSESSTVSSGISTVTNSESSTPSSGANTATNSESSTTSSGANTATNSDSSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 57232 - protein, 1145 aa, Homo sapiens
MAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHCPADGPEQCELVQRPRYRRGPHICFDYNATEDTSDCGRGASFPPSLGVLVSLQLLLLLGLPPRPQPQVLVHASRRL

SEQ ID NO: 57233 - protein, 1143 aa, Homo sapiens
MAVPARTCGASRPGPARTARPWPGCGPHPGPGTRRPTSGPPRPLWLLLPLLPLLAAPGASAYSFPQQHTMQHWARRLEQEVDGVMRIFGGVQQLREIYKDNRNLFEVQENEPQKLVEKVAGDIESLLDRKVQALKRLADAAENFQKAHRWQDNIKEEDIVYYDAKADAELDDPESEDVERGSKASTLRLDFIEDPNFKNKVNYSYAAVQIPTDIYKGSTVILNELNWTEALENVFMENRRQDPTLLWQVFGSATGVTRYYPATPWRAPKKIDLYDVRRRPWYIQGASSPKDMVIIVDVSGSVSGLTLKLMKTSVCEMLDTLSDDDYVNVASFNEKAQPVSCFTHLVQANVRNKKVFKEAVQGMVAKGTTGYKAGFEYAFDQLQNSNITRANCNKMIMMFTDGGEDRVQDVFEKYNWPNRTVRVFTFSVGQHNYDVTPLQWMACANKGYYFEIPSIGAIRINTQEYLDVLGRPMVLAGKEAKQVQWTNVYEDALGLGLVVTGTLPVFNLTQDGPGEKKNQLILGVMGIDVALNDIKRLTPNYTLGANGYVFAIDLNGYVLLHPNLKPQTTNFREPVTLDFLDAELEDENKEEIRRSMIDGNKGHKQIRTLVKSLDERYIDEVTRNYTWVPIRSTNYSLGLVLPPYSTFYLQANLSDQILQVKYFEFLLPSSFESEGHVFIAPREYCKDLNASDNNTEFLKNFIELMEKVTPDSKQCNNFLLHNLILDTGITQQLVERVWRDQDLNTYSLLAVFAATDGGITRVFPNKAAEDWTENPEPFNASFYRRSLDNHGYVFKPPHQDALLRPLELENDTVGILVSTAVELSLGRRTLRPAVVGVKLDLEAWAEKFKVLASNRTHQDQPQKCGPNSHCEMDCEVNNEDLLCVLIDDGGFLVLSNQNHQWDQVGRFFSEVDANLMLALYNNSFYTRKESYDYQAACAPQPPGNLGAAPRGVFVPTVADFLNLAWWTSAAAWSLFQQLLYGLIYHSWFQADPAEAEGSPETRESSCVMKQTQYYFGSVNASYNAIIDCGNCSRLFHAQRLTNTNLLFVVAEKPLCSQCEAGRLLQKETHSDGPEQCELVQRPRYRRGPHICFDYNATEDTSDCGRGASFPPSLGVLVSLQLLLLLGLPPRPQPQVLVHASRRL

SEQ ID NO: 57234 - protein, 128 aa, Homo sapiens
MGFQKFSPFLALSILVLLQAGSLHAAPFRSALESSPADPATLSEDEARLLLAALVQDYVQMKASELEQEQEREGSRIIAQKRACDTATCVTHRLAGLLSRSGGVVKNNFVPTNVGSKAFGRRRRDLQA

SEQ ID NO: 57235 - protein, 89 aa, Homo sapiens
MKGLAAALLVLVCTMALCSCAQVGTNKELCCLVYTSWQIPQKFIVDYSETSPQCPKPGVILLTKRGRQICADPNKKWVQKYISDLKLNA

SEQ ID NO: 57236 - protein, 184 aa, Homo sapiens
MKSVLLLTTLLVPAHLVAAWSNNYAVDCPQHCDSSECKSSPRCKRTVLDDCGCCRVCAAGRGETCYRTVSGMDGMKCGPGLRCQPSNGEDPFGEEFGICKDCPYGTFGMDCRETCNCQSGICDRGTGKCLKFPFFQYSVTKSSNRFVSLTEHDMASGDGNIVREEVVKENAAGSPVMRKWLNPR

SEQ ID NO: 57237 - protein, 354 aa, Homo sapiens
MYREWVVVNVFMMLYVQLVQGSSNEHGPVKRSSQSTLERSEQQIRAASSLEELLRITHSEDWKLWRCRLRLKSFTSMDSRSASHRSTRFAATFYDIETLKVIDEEWQRTQCSPRETCVEVASELGKSTNTFFKPPCVNVFRCGGCCNEESLICMNTSTSYISKQLFEISVPLTSVPELVPVKVANHTGCKCLPTAPRHPYSIIRRSIQIPEEDRCSHSKKLCPIDMLWDSNKCKCVLQEENPLAGTEDHSHLQEPALCGPHMMFDEDRCECVCKTPCPKDLIQHPKNCSCFECKESLETCCQKHKLFHPDTCSCEDRCPFHTRPCASGKTACAKHCRFPKEKRAAQGPHSRKNP

SEQ ID NO: 57238 - protein, 331 aa, Homo sapiens
MMAPKPGLDFSPFDFAHFGFPSDNSGKERSFQAKPSPKLGRHVYSRPKVDIQKICIGNKNIFTVSDLKPDTQYYFDVFVVNINSNMSTAYVGTFARTKEEAKQKTVELKDGKITDVFVKRKGAKFLRFAPVSSHQKVTFFIHSCLDAVQIQVRRDGKLLLSQNVEGIQQFQLRGKPKAKYLVRLKGNKKGASMLKILATTRPTKQSFPSLPEDTRIKAFDKLRTCSSATVAWLGTQERNKFCIYKKEVDDNYNEDQKKREQNQCLGPDIRKKSEKVLCKYFHSQNLQKAVTTETIKGLQPGKSYLLDVYVIGHGGHSVKYQSKVVKTRKFC

SEQ ID NO: 57239 - protein, 147 aa, Homo sapiens
MAGWWPALSRAARRHPWPTNVLLYGSLVSAGDALQQRLQGREANWRQTRRVATLVVTFHANFNYVWLRLLERALPGRAPHALLAKLLCDQVVGAPIAVSAFYVEWIDVLALCTADQLQPCSCSMENSLRWSLWFSLGHLHLFFPAEW

SEQ ID NO: 57240 - protein, 169 aa, Homo sapiens
MRSHGNSGLKKVLLLLFTSLCLKKDKQHRNLQEATEFSLNFFLCSCAWNCSLLHFTTSVYKSNSPSPENWTEFQQVGNLHEDKMYCSAMLGILKNKALSSADTQAADFKDWKKSFASSLFSIQTQSVAANVLQMDRSWGTWMKLETIILSKLTEEQKSKHRMFSLMIGS

SEQ ID NO: 57241 - protein, 170 aa, Homo sapiens [sequence omitted]

SEQ ID NO: 57242 - protein, 649 aa, Homo sapiens
MISAAWSIFLIGTKIGLFLQVAPLSVMAKSCPSVCRCDAGFIYCNDRFLTSIPTGIPEDATTLYLQNNQINNAGIPSDLKNLLKVERIYLYHNSLDEFPTNLPKYVKELHLQENNIRTITYDSLSKIPYLEELHLDDNSVSAVSIEEGAFRDSNYLRLLFLSRNHLSTIPWGLPRTIEELRLDDNRISTISSPSLQGLTSLKRLVLDGNLLNNHGLGDKVFFNLVNLTELSLVRNSLTAAPVNLPGTNLRKLYLQDNHINRVPPNAFSYLRQLYRLDMSNNNLSNLPQGIFDDLDNITQLILRNNPWYCGCKMKWVRDWLQSLPVKVNVRGLMCQAPEKVRGMAIKDLNAELFDCKDSGIVSTIQITTAIPNTVYPAQGQWPAPVTKQPDIKNPKLTKDHQTTGSPSRKTITITVKSVTSDTIHISWKLALPMTALRLSWLKLGHSPAFGSITETIVTGERSEYLVTALEPDSPYKVCMVPMETSNLYLFDETPVCIETETAPLRMYNPTTTLNREQEKEPYKNPNLPLAAIIGGAVALVTIALLALVCWYVHRNGSLFSRNCAYSKGRRRKDDYAEAGTKKDNSILEIRETSFQMLPISNEPISKEEFVIHTIFPPNGMNLYKNNHSESSSNRSYRDSGIPDSDHSHS

SEQ ID NO: 57243 - protein, 649 aa, Homo sapiens; identical to SEQ ID NO: 57242

SEQ ID NO: 57244 - protein, 257 aa, Homo sapiens
MAQRMTTQLLLLLVWVAVVGEAQTRIAWARTELLNVCMNAKHHKEKPGPEDKLHEQCRPWRKNACCSTNTSQEAHKDVSYLYRFNWNHCGEMAPACKRHFIQDTCLYECSPNLGPWIQQVDQSWRKERVLNVPLCKEDCEQWWEDCRTSYTCKSNWHKGWNWTSGFNKCAVGAACQPFHFYFPTPTVLCNEIWTHSYKVSNYSRGSGRCIQMWFDPAQGNPNEEVARFYAAAMSGAGPWAAWPFLLSLALMLLWLLS

SEQ ID NO: 57245 - protein, 257 aa, Homo sapiens; identical to SEQ ID NO: 57244

SEQ ID NO: 57246 - protein, 257 aa, Homo sapiens; identical to SEQ ID NO: 57244

SEQ ID NO: 57247 - protein, 257 aa, Homo sapiens; identical to SEQ ID NO: 57244

SEQ ID NO: 57248 - protein, 257 aa, Homo sapiens; identical to SEQ ID NO: 57244

SEQ ID NO: 57249 - protein, 257 aa, Homo sapiens; identical to SEQ ID NO: 57244

SEQ ID NO: 57250 - protein, 225 aa, Homo sapiens
MTSEFFSAQLRAQISDDTTHPISYYKPEFYMPDDGGTAHLSVVAEDGSAVSATSTINLYFGSKVRSPVSGILLNNEMDDFSSTSITNEFGVPPSPANFIQPGKQPLSSMCPTIMVGQDGQVRMVVGAAGGTQITMATALAIIYNLWFGYDVKWAVEEPRLHNQLLPNVTTVERNIDQEVTAALETRHHHTQITSTFIAVVQAIVRMAGGWAAASDSRKGGEPAGY

SEQ ID NO: 57251 - protein, 225 aa, Homo sapiens; identical to SEQ ID NO: 57250

SEQ ID NO: 57252 - protein, 225 aa, Homo sapiens; identical to SEQ ID NO: 57250

SEQ ID NO: 57253 - protein, 541 aa, Homo sapiens
MNCRELPLTLWVLISVSTAESCTSRPHITVVEGEPFYLKHCSCSLAHEIETTTKSWYKSSGSQEHVELNPRSSSRIALHDCVLEFWPVELNDTGSYFFQMKNYTQKWKLNVIRRNKHSCFTERQVTSKIVEVKKFFQITCENSYYQTLVNSTSLYKNCKKLLLENNKNPTIKKNAEFEDQGYYSCVHFLHHNGKLFNITKTFNITIVEDRSNIVPVLLGPKLNHVAVELGKNVRLNCSALLNEEDVIYWMFGEENGSDPNIHEEKEMRIMTPEGKWHASKVLRIENIGESNLNVLYNCTVASTGGTDTKSFILVRKADMADIPGHVFTRGMIIAVLILVAVVCLVTVCVIYRVDLVLFYRHLTRRDETLTDGKTYDAFVSYLKECRPENGEEHTFAVEILPRVLEKHFGYKLCIFERDVVPGGAVVDEIHSLIEKSRRLIIVLSKSYMSNEVRYELESGLHEALVERKIKIILIEFTPVTDFTFLPQSLKLLKSHRVLKWKADKSLSYNSRFWKNLLYLMPAKTVKPGRDEPEVLPVLSES

SEQ ID NO: 57254 - protein, 263 aa, Homo sapiens
MKGGFTGGDEYQKHFLPRDYLATYYSFDGSPSPEAEMLKFNLECLHKTFGPGGLQGDTLIDIGSGPTIYQVLAACDSFQDITLSDFTDRNREELEKWLKKEPGAYDWTPAVKFACELEGNSGRWEEKEEKLRAAVKRVLKCDVHLGNPLAPAVLPLADCVLTLLAMECACCSLDAYRAALCNLASLLKPGGHLVTTVTLRLPSYMVGKREFSCVALEKEEVEQAVLDAGFDIEQLLHSPQSYSVTNAANNGVCFIVARKKPGP

SEQ ID NO: 57255 - protein, 149 aa, Homo sapiens [sequence omitted]

SEQ ID NO: 57256 - protein, 149 aa, Homo sapiens [sequence omitted]

SEQ ID NO: 57257 - protein, 338 aa, Homo sapiens
MGAGLFSVVGTLLLPGLAALVQDWRLLQGLGALMSGLLLLFWGFPALFPESPCWLLATGQVARARKILWRFAEASGVGPGDSSLEENSLATELTMLSARSPQPRYHSPLGLLRTRVTWRNGLILGFSSLVGGGIRASFRRSLAPQVPTFYLPYFLEAGLEAAALVFLLLTADCCGRRPVLLLGTMVTGLASLLLLAGAQYLPGWTVLFLSVLGLLASRAVSALSSLFAAEVFPTVIRGAGLGLVLGAGFLGQAAGPLDTLHGRQGFFLQQVVFASLAVLALLCVLLLPESRSRGLPQSLQDADRLRRSPLLRGRPRQDHLPLLPPSNSYWAGHTPEQH

SEQ ID NO: 57258 - protein, 338 aa, Homo sapiens; identical to SEQ ID NO: 57257

SEQ ID NO: 57259 - protein, 338 aa, Homo sapiens
MGAGLFSVVGTLLLPGLAALVQDWRLLQGLGALMSGLLLLFWGFPALFPESPCWLLATGQVARARKILWRFAEASGVGPGDSSLEENSLATELTMLSARSPQPRYHSPLGLLRTRVTWRNGLILGFSSLVGGGIRASFRRSLAPQVPTFYLPYFLEAGLEAAALVFLLLTADCCGRRPVLLLGTMVTGLASLLLLAGAQYLPGWTVLFLSVLGLLASRAVSALSSLFAAEVFPTVIRGAGLGLVLGAGFLGQAAGLLDTLHGRQGFFLQQVVFASLAVLALLCVLLLPESRSRGLPQSLQDADRLRRSPLLRGRPRQDHLPLLPPSNSYWAGHTPEQH

SEQ ID NO: 57260 - protein, 338 aa, Homo sapiens; identical to SEQ ID NO: 57259

SEQ ID NO: 57261 - protein, 190 aa, Homo sapiens [sequence omitted]

SEQ ID NO: 57262 - protein, 190 aa, Homo sapiens [sequence omitted]

SEQ ID NO: 57263 - protein, 570 aa, Homo sapiens
MAYCLGVNFVPSRFCYQLHRLLLRCTFRFPSTAIKIQFTSLYHKEEAPASPLRPLYPQISPLKIHIPEPDLRSMVSPVPSPTGTISVPNSCPASPRGAGSSSYRFVQNVTSDLQLAAEFAAKAASEQQADTSGGDSPKDESKPPFSYAQLIVQAISSAQDRQLTLSGIYAHITKHYPYYRTADKGWQNSIRHNLSLNRYFIKVPRSQEEPGKGSFWRIDPASEAKLVEQAFRKRRQRGVSCFRTPFGPLSSRSAPASPTHPGLMSPRSGGLQTPECLSREGSPIPHDPEFGSKLASVPEYRYSQSAPGSPVSAQPVIMAVPPRPSSLVAKPVAYMPASIVTSQQPAGHAIHVVQQAPTVTMVRVVTTSANSANGYILTSQGAAGGSHDAAGAAVLDLGSEARGLEEKPTIAFATIPAAGGVIQTVASQMAPGVPGHTVTILQPATPVTLGQHHLPVRAVTQNGKHAVPTNSLAGNAYALTSPLQLLATQASSSAPVVVTRVCEVGPKEPAAAVAATATTTPATATTASASASSTGEPEVKRSRVEEPSGAVTTPAGVIAAAGPQGPGTGE

SEQ ID NO: 57264 - protein, 57 aa, Homo sapiens
MAAQIIKRKWEAEEFAEQIRAYLEGTCVERLADTWRTGRRRCSSLVPGNTRRLPDRL

SEQ ID NO: 57265 - protein, 570 aa, Homo sapiens; identical to SEQ ID NO: 57263

SEQ ID NO: 57266 - protein, 120 aa, Homo sapiens
MRTFVIAEGGSSAGKSCVQDLLLPVSTDPCDIHRSSECLRCSAGYLISVCSYTSSDHNQCYAGTASLALLWIGGILKGCLLWKQFRWTERSHWNFGYWALGSPGNGNGCCVALFARGGHW

SEQ ID NO: 57267 - protein, 57 aa, Homo sapiens
MGHQQLYWSHPRKFGQGSRSCCVCSNNRHGLIRKYGLNMCRQCFRQYAKDIGFIKLD

SEQ ID NO: 57268 - protein, 452 aa, Homo sapiens
MAPCVPATVAPAVAKRDHSTARAMPSEGAQPKPWWLPSGVGPAAEQKTRAEIPQPGGLAEPPTPRHRLSCRGRGGGDERPPRPAGARPRPPYLAARRAMSLSPKHTTPFSVSDILSPIEETYKKFSGAMDGAPPGLGAPLGAAAAYRAPPPGPSSQAATVAGMQPSHAMAGHNAAAAAAAAAAAAAAAATYHMPPGVSQFPHGAMGSYCNGGLGNMGELPAYTDGMRGGAATGWYGANPDPRYSSISRFMGPSAGVNVAGMGSLTGIADAAKSLGPLHAAAAAAAPRRKRRVLFSQAQVYELERRFKQQKYLSAPEREHLASMIHLTPTQVKIWFQNHRYKMKRQAKDKAAQQLQQEGGLGPPPPPPPSPRRVAVPVLVKDGKPCQNGASTPTPGQAGPQPPAPTPAPELEELSPSPPALHGPGGGLAALDAAAGEYSGGVLGANLLYGRTW

SEQ ID NO: 57269 - protein, 178 aa, Homo sapiens
MAPGALPELGEEEGHGASGLSAELGRLSAGSVGPRGAELGIGAGAGSSAGGSWHSGALFWPLSRTSATPGPGLRSCHMSWPRRSLSLAHGQARSGNALHLLPAPARLHPDGLPAQGGEKRRDATRGWTSAKATLSLLLPCVFHDLEVVGNPRLLKTRGEFLLQDDMNAPSHCLPTDLF

SEQ ID NO: 57270 - protein, 284 aa, Homo sapiens
MKAALPTSTRGRPRSLPTSLRRVPGTPAPASLTPLPSPPVWVPVSFVPGSGGSSLSSQSSGCALPPSSYSPSLFSSGGTSSSSSLLGRPSLPRGLPVASELLEGLAMAPGALPELGEEEGHGASGLSAELGRLSTGSVGPRGAELGIGAGAGSSAGGSWHSGALFWPLSRTSATPGPGLRSSHMSWPRRSLSLAHGQARSGNALHLLPAPARLHPDGLPAQGGEKRRDATRGWTSAKATLSLLLPCVFHDLEVVGNPRLLKTRGEFLLQDDMNAPSHCLPTDLF

SEQ ID NO: 57271 - protein, 358 aa, Homo sapiens [sequence omitted]

SEQ ID NO: 57272 - protein, 120 aa, Homo sapiens; identical to SEQ ID NO: 57266

SEQ ID NO: 57273 - protein, 570 aa, Homo sapiens; identical to SEQ ID NO: 57263

SEQ ID NO: 57274 - protein, 452 aa, Homo sapiens
MAPCVPATVAPAVAKRDHSTARAMPSEGAHPKPWWLPSGVGPAAEQKTRAEIPQPGGLAEPPTPRHRLSCRGRGGGDERPPRPAGARPRPPYLAARRAMSLSPKHTTPFSVSDILSPIEETYKKFSGAMDGAPPGLGAPLGAAAAYRAPPPGPSSQAATVAGMQPSHAMAGHNAAAAAAAAAAAAAAAATYHMPPGVSQFPHGAMGSYCNGGLGNMGELPAYTDGMRGGAATGWYGANPDPRYSSISRFMGPSAGVNVAGMGSLTGIADAAKSLGPLHAAAAAAAPRRKRRVLFSQAQVYELERRFKQQKYLSAPEREHLASMIHLTPTQVKIWFQNHRYKMKRQAKDKAAQQLQQEGGLGPPPPPPPSPRRVAVPVLVKDGKPCQNGASTPTPGQAGPQPPAPTPAPELEELSPSPPALHGPGGGLAALDAAAGEYSGGVLGANLLYGRTW

SEQ ID NO: 57275 - protein, 366 aa, Homo sapiens
MERDKSPLRPPGPITSDPGPDPAPRGGRARSHPSPPPGSHSLRYFYTAVSRPGLGEPRFISVGYVDDTQFVRFDSDSANPREEPRAPWMEQEGPEYWDEQTRIVKDTAQSFRVGLNTLRGYYNQSEAGSHTLQLMYGCDVGPDGRFLRGFMQDAYDGRDYIALNEDLRSWTAADTAAQITKRKREAAGAAERQRNYLEGRCVEGLRRYLETGKDALLRADPPKAHVTHHPISEREVTLRCWALGFYPEEISLTWQREGEDQTQDMELVETRPSGDGTFQKWAALVVPSGEEQRYTCRVQHEGLQEPLTLRWEPPQTSFLIMGIIVGLVLLVVALVAGAVIWRKKRSGREGREGSEFSCHNGVSVRA

SEQ ID NO: 57276 - protein, 111 aa, Homo sapiens; identical to SEQ ID NO: 21102

SEQ ID NO: 57277 - protein, 248 aa, Homo sapiens; identical to SEQ ID NO: 16489

SEQ ID NO: 57278 - protein, 2527 aa, Homo sapiens
MASGSCQGCEEDEETLKKLIVRLNNVQEGKQIETLVQILEDLLVFTYSEHASKLFQGKNIHVPLLIVLDSYMRVASVQQVGWSLLCKLIEVCPGTMQSLMGPQDVGNDWEVLGVHQLILKMLTVHNASVNLSVIGLKTLDLLLTSGKITLLILDEESDIFMLIFDAMHSFPANDEVQKLGCKALHVLFERVSEEQLTEFVENKDYMILLSASTNFKDEEEIVLHVLHCLHSLAIPCNNVEVLMSGNVRCYNIVVEAMKAFPMSERIQEVSCCLLHRLTLGNFFNILVLNEVHEFVVKAVQQYPENAALQISALSCLALLTETIFLNQDLEEKNENQENDDEGEEDKLFWLEACYKALTWHRKNKHVQEAACWALNNLLMYQNSLHEKIGDEDGHFPAHREVMLSMLMHSSSKEVFQASANALSTLLEQNVNFRKILLSKGIHLNVLELMQKHIHSPEVAESGCKMLNHLFEGSNTSLDIMAAVVPKILTVMKRHETSLPVQLEALRAILHFIVPGMPEESREDTEFHHKLNMVKKQCFKNDIHKLVLAALNRFIGNPGIQKCGLKVISSIVHFPDALEMLSLEGAMDSVLHTLQMYPDDQEIQCLGLSLIGYLITKKNVFIGTGHLLAKILVSSLYRFKDVAEIQTKGFQTILAILKLSASFSKLLVHHSFDLVIFHQMSSNIMEQKDQQFLNLCCKCFAKVAMDDYLKNVMLERACDQNNSIMVECLLLLGADANQAKEGSSLICQVCEKESSPKLVELLLNSGSREQDVRKALTISIGKGDSQIISLLLRRLALDVANNSICLGGFCIGKVEPSWLGPLFPDKTSNLRKQTNIASTLARMVIRYQMKSAVEEGTASGSDGNFSEDVLSKFDEWTFIPDSSMDSVFAQSDDLDSEGSEGSFLVKKKSNSISVGEFYRDAVLQRCSPNLQRHSNSLGPIFDHEDLLKRKRKILSSDDSLRSSKLQSHMRHSDSISSLASEREYITSLDLSANELRDIDALSQKCCISVHLEHLEKLELHQNALTSFPQQLCETLKSLTHLDLHSNKFTSFPSYLLKMSCIANLDVSRNDIGPSVVLDPTVKCPTLKQFNLSYNQLSFVPENLTDVVEKLEQLILEGNKISGICSPLRLKELKILNLSKNHISSLSENFLEACPKVESFSARMNFLAAMPFLPPSMTILKLSQNKFSCIPEAILNLPHLRSLDMSSNDIQYLPGPAHWKSLNLRELLFSHNQISILDLSEKAYLWSRVEKLHLSHNKLKEIPPEIGCLENLTSLDVSYNLELRSFPNEMGKLSKIWDLPLDELHLNFDFKHIGCKAKDIIRFLQQRLKKAVPYNRMKLMIVGNTGSGKTTLLQQLMKTKKSDLGMQSATVGIDVKDWPIQIRDKRKRDLVLNVWDFAGREEFYSTHPHFMTQRALYLAVYDLSKGQAEVDAMKPWLFNIKARASSSPVILVGTHLDVSDEKQRKACMSKITKELLNKRGFPAIRDYHFVNATEESDALAKLRKTIINESLNFKIRDQLVVGQLIPDCYVELEKIILSERKNVPIEFPVIDRKRLLQLVRENQLQLDENELPHAVHFLNESGVLLHFQDPALQLSDLYFVEPKWLCKIMAQILTVKVEGCPKHPKGIISRRDVEKFLSKKRKFPKNYMSQYFKLLEKFQIALPIGEEYLLVPSSLSDHRPVIELPHCENSEIIIRLYEMPYFPMGFWSRLINRLLEISPYMLSGRERALRPNRMYWRQGIYLNWSPEAYCLVGSEVLDNHPESFLKITVPSCRKGCILLGQVVDHIDSLMEEWFPGLLEIDICGEGETLLKKWALYSFNDGEEHQKILLDDLMKKAEEGDLLVNPDQPRLTIPISQIAPDLILADLPRNIMLNNDELEFEQAPEFLLGDGSFGSVYRAAYEGEEVAVKIFNKHTSLRLLRQELVVLCHLHHPSLISLLAAGIRPRMLVMELASKGSLDRLLQQDKASLTRTLQHRIALHVADGLRYLHSAMIIYRDLKPHNVLLFTLYPNAAIIAKIADYGIAQYCCRMGIKTSEGTPGFRAPEVARGNVIYNQQADVYSFGLLLYDILTTGGRIVEGLKFPNEFDELEIQGKLPDPVKEYGCAPWPMVEKLIKQCLKENPQERPTSAQVFDILNSAELVCLTRRILLPKNVIVECMVATHHNSRNASIWLGCGHTDRGQLSFLDLNTEGYTSEEVADSRILCLALVHLPVEKESWIVSGTQSGTLLVINTEDGKKRHTLEKMTDSVTCLYCNSFSKQSKQKNFLLVGTADGKLAIFEDKTVKLKGAAPLKILNIGNVSTPLMCLSESTNSTERNVMWGGCGTKIFSFSNDFTIQKLIETRTSQLFSYAAFSDSNIITVVVDTALYIAKQNSPVVEVWDKKTEKLCGLIDCVHFLREVMVKENKESKHKMSYSGRVKTLCLQKNTALWIGTGGGHILLLDLSTRRLIRVIYNFCNSVRVMMTAQLGSLKNVMLVLGYNRKNTEGTQKQKEIQSCLTVWDINLPHEVQNLEKHIEVRKELAEKMRRTSVE

SEQ ID NO: 57279 - protein, 147 aa, Homo sapiens
MVRRGHVGIFFIEGGVPFWGGACFIISGSLSVAAEKNHTSCLVRSSLGTNILSVMAAFAGTAILLMDFGVTNRDVDRGYLAVLTIFTVLEFFTAVIAMHFGCQAIHAQASAPVIFLPNAFSADFNIPSPAASAPPAYDNVAYAQGVV

SEQ ID NO: 57280 - protein, 483 aa, Homo sapiens
MATLGHTFPFYAGPKPTFPMDTTLASIIMIFLTALATFIVILPGIRGKTRLFWLLRVVTSLFIGAAILAVNFSSEWSVGQVSTNTSYKAFSSEWISADIGLQVGLGGVNITLTGTPVQQLNETINYNEEFTWRLGENYAEEYAKALEKGLPDPVLYLAEKFTPRSPCGLYRQYRLAGHYTSAMLWVAFLCWLLANVMLSMPVLVYGGYMLLATGIFQLLALLFFSMATSLTSPCPLHLGASVLHTHHGPAFWITLTTGLLCVLLGLAMAVAHRMQPHRLKAFFNQSVDEDPMLEWSPEEGGLLSPRYRSMADSPKSQDIPLSEASSTKAYYRPRRLSLVPADVRGLAPAALSALPGALLAQAWRALLPGLRCPKAGKESRLGPPHSPWRFGPEGCEERWAEHTGDSPRPLRGRGTGRLWRWGSKERRACGVRAMLPRLVSNSGLKRPSCLDLPKCWDYRRDARAFFHLLEPTPCVTSRHTPLI

SEQ ID NO: 57281 - protein, 273 aa, Homo sapiens
MSLTNTKTGFSVKDILDLPDTNDEEGSVAEGPEEENEGPEPAKRAGPLGQGALDAVQSLPLKNPFYDSSDNPYTRWLASTEGLQYSLHGLAAGAPPQDSSSKSPEPSADESPDNDKETPGGGGDAGKKRKRRVLFSKAQTYELERRFRQQRYLSAPEREHLASLIRLTPTQVKIWFQNHRYKMKRARAEKGMEVTPLPSPRRVAVPVLVRDGKPCHALKAQDLAAATFQAGIPFSAYSAQSLQHMQYNAQYSSASTPQYPTAHPLVQAQQWTW

SEQ ID NO: 57282 - protein, 309 aa, Homo sapiens
MSFNLQSSKKLFIFLGKSLFSLLEAMIFALLPKPRKNVAGEIVLITGAGSGLGRLLALQFARLGSVLVLWDINKEGNEETCKMAREAGATRVHAYTCDCSQKEGVYRVADQVKKEVGDVSILINNAGIVTGKKFLDCPDELMEKSFDVNFKAHLWTYKAFLPAMIANDHGHLVCISSSAGLSGVNGLADYCASKFAAFGFAESVFVETFVQKQKGIKTTIVCPFFIKTGMFEGCTTGCPSLLPILEPKYAVEKIVEAILQEKMYLYMPKLLYFMMFLKSFLPLKTGLLIADYLGILHAMDGFVDQKKKL

SEQ ID NO: 57283 - protein, 117 aa, Homo sapiens
MKPPAEDLSDALCEFDAVLADFASPFHERHFHYEEHLERMKRRSSASVSDSSGFSDSESADSLYRNSFSFSDEKLNSPTDSTPALLSATVTPQKAKLGDTKELEAFIADLDKTLASM

SEQ ID NO: 57284 - protein, 2347 aa, Homo sapiens
MKNIYCLIPKLVNFATLGCLWISVVQCTVLNSCLKSCVTNLGQQLDLGTPHNLSEPCIQGCHFWNSVDQKNCALKCRESCEVGCSSAEGAYEEEVLENADLPTAPFASSIGSHNMTLRWKSANFSGVKYIIQWKYAQLLGSWTYTKTVSRPSYVVKPLHPFTEYIFRVVWIFTAQLQLYSPPSPSYRTHPHGVPETAPLIRNIESSSPDTVEVSWDPPQFPGGPILGYNLRLISKNQKLDAGTQRTSFQFYSTLPNTIYRFSIAAVNEVGEGPEAESSITTSSSAVQQEEQWLFLSRKTSLRKRSLKHLVDEAHCLRLDAIYHNITGISVDVHQQIVYFSEGTLIWAKKAANMSDVSDLRIFYRGSGLISSISIDWLYQRMYFIMDELVCVCDLENCSNIEEITPPSISAPQKIVADSYNGYVFYLLRDGIYRADLPVPSGRCAEAVRIVESCTLKDFAIKPQAKRIIYFNDTAQVFMSTFLDGSASHLILPRIPFADVKSFACENNDFLVTDGKVIFQQDALSFNEFIVGCDLSHIEEFGFGNLVIFGSSSQLHPLPGRPQELSVLFGSHQALVQWKPPALAIGANVILISDIIELFELGPSAWQNWTYEVKVSTQDPPEVTHIFLNISGTMLNVPELQSAMKYKVSVRASSPKRPGPWSEPSVGTTLVPASEPPFIMAVKEDGLWSKPLNSFGPGEFLSSDIGNVSDMDWYNNSLYYSDTKGDVFVWLLNGTDISENYHLPSIAGAGALAFEWLGHFLYWAGKTYVIQRQSVLTGHTDIVTHVKLLVNDMVVDSVGGYLYWTTLYSVESTRLNGESSLVLQTQPWFSGKKVIALTLDLSDGLLYWLVQDSQCIHLYTAVLRGQSTGDTTITEFAAWSTSEISQNALMYYSGRLFWINGFRIITTQEIGQKTSVSVLEPARFNQFTIIQTSLKPLPGNFSFTPKVIPDSVQESSFRIEGNASSFQILWNGPPAVDWGVVFYSVEFSAHSKFLASEQHSLPVFTVEGLEPYALFNLSVTPYTYWGKGPKTSLSLRAPETVPSAPENPRIFILPSGKCCNKNEVVVEFRWNKPKHENGVLTKFEIFYNISNQSITNKTCEDWIAVNVTPSVMSFQLEGMSPRCFIAFQVRAFTSKGPGPYADVVKSTTSEINPFPHLITLLGNKIVFLDMDQNQVVWTFSAERVISAVCYTADNEMGYYAEGDSLFLLHLHNRSSSELFQDSLVFDITVITIDWISRHLYFALKESQNGMQVFDVDLEHKVKYPREVKIHNRNSTIISFSVYPLLSRLYWTEVSNFGYQMFYYSIISHTLHRILQPTATNQQNKRNQCSCNVTEFELSGAMAIDTSNLEKPLIYFAKAQEIWAMDLEGCQCWRVITVPAMLAGKTLVSLTVDGDLIYWIITAKDSTQIYQAKKGNGAIVSQVKALRSRHILAYSSVMQPFPDKAFLSLASDTVEPTILNATNTSLTIRLPLAKTNLTWYGITSPTPTYLVYYAEVNDRKNSSDLKYRILEFQDSIALIEDLQPFSTYMIQIAVKNYYSDPLEHLPPGKEIWGKTKNGVPEAVQLINTTVRSDTSLIISWRESHKPNGPKESVRYQLAISHLALIPETPLRQSEFPNGRLTLLVTRLSGGNIYVLKVLACHSEEMWCTESHPVTVEMFNTPEKPYSLVPENTSLQFNWKAPLNVNLIRFWVELQKWKYNEFYHVKTSCSQGPAYVCNITNLQPYTSYNVRVVVVYKTGENSTSLPESFKTKAGVPNKPGIPKLLEGSKNSIQWEKAEDNGCRITYYILEIRKSTSNNLQNQNLRWKMTFNGSCSSVCTWKSKNLKGIFQFRVVAANNLGFGEYSGISENIILVGDDFWIPETSFILTIIVGIFLVVTIPLTFVWHRRLKNQKSAKEGVTVLINEDKELAELRGLAAGVGLANACYAIHTLPTQEEIENLPAFPREKLTLRLLLGSGAFGEVYEGTAVDILGVGSGEIKVAVKTLKKGSTDQEKIEFLKEAHLMSKFNHPNILKQLGVCLLNEPQYIILELMEGGDLLTYLRKARMATFYGPLLTLVDLVDLCVDISKGCVYLERMHFIHRDLAARNCLVSVKDYTSPRIVKIGDFGLARDIYKNDYYRKRGEGLLPVRWMAPESLMDGIFTTQSDVWSFGILIWEILTLGHQPYPAHSNLDVLNYVQTGGRLEPPRNCPDDLWNLMTQCWAQEPDQRPTFHRIQDQLQLFRNFFLNSIYKSRDEANNSGVINESFEGEDGDVICLNSDDIMPVALMETKNREGLNYMVLATECGQGEEKSEGPLGSQESESCGLRKEEKEPHADKDFCQEKQVAYCPSGKPEGLNYACLTHSGYGDGSD

SEQ ID NO: 57285 - protein, 208 aa, Homo sapiens
MLKWLPFLFICSGKTLCFFSLRNSQLKTLLAIGGWNFGTAPFTAMVSTPENHQTFINSVIKFLRQYEFDGLDFDWEYPGSRVSPPQDKHLFTVLVQEMREAFEQEAKHINKPRLMVTAAVAAGISNIQSGYEIPQLSQYPDYIHVMTYDLHGSWEGYTGENSPLYKYPTDTGSNAYLNVDYVMNYWKDNRAPAEKLMLDSQPMDTPSF

SEQ ID NO: 57286 - protein, 91 aa, Homo sapiens
MKLAVTLTLVTLALCCSSASAEICPSFQRVIETLLMDTPSSYEAAMELFSPDQDMREAGAQLKKLVDTLPQKPRESIIKLMEKIAQSSLCN

SEQ ID NO: 57287 - protein, 381 aa, Homo sapiens; identical to SEQ ID NO: 16589

SEQ ID NO: 57288 - protein, 460 aa, Homo sapiens
MAPGRAVAGLLLLAAAGLGGVAEGPGLAFSEDVLSVFGANLSLSAAQLQHLLEQMGAASRVGVPEPGQLHFNQCLTAEEIFSLHGFSNATQITSSKFSVICPAVLQQLNFHPCEDRPKHKTRPSHSEVWGYGFLSVTIINLASLLGLILTPLIKKSYFPKILTFFVGLAIGTLFSNAIFQLIPEAFGFDPKVDSYVEKAVAVFGGFYLLFFFERMLKMLLKTYGQNGHTHFGNDNFGPQEKTHQPKALPAINGVTCYANPAVTEANGHIHFDNVSVVSLQDGKKEPSSCTCLKGPKLSEIGTIAWMITLCDALHNFIDGLAIGASCTLSLLQGLSTSIAILCEEFPHELGDFVILLNAGMSTRQALLFNFLSACSCYVGLAFGILVGNNFAPNIIFALAGGMFLYISLADMFPEMNDMLREKVTGRKTDFTFFMIQNAGMLTGFTAILLITLYAGEIELE

SEQ ID NO: 57289 - protein, 545 aa, Homo sapiens
MLQDKGLSESEEAFRAPGPALGEASAANAPEPALAAPGLSGAALGSPPGPGADVVAAAAAEQTIENIKVGLHEKELWKKFHEAGTEMIITKAGRRMFPSYKVKVTGMNPKTKYILLIDIVPADDHRYKFCDNKWMVAGKAEPAMPGRLYVHPDSPATGAHWMRQLVSFQKLKLTNNHLDPFGHIILNSMHKYQPRLHIVKADENNAFGSKNTAFCTHVFPETSFISVTSYQNHKITQLKIENNPFAKGFRGSDDSDLRVARLQSKEYPVISKSIMRQRLISPQLSATPDVGPLLGTHQALQHYQHENGAHSQLAEPQDLPLSTFPTQRDSSLFYHCLKRRDGTRHLDLPCKRSYLEAPSSVGEDHYFRSPPPYDQQMLSPSYCSEVTPREACMYSGSGPEIAGVSGVDDLPPPPLSCNMWTSVSPYTSYSVQTMETVPYQPFPTHFTATTMMPRLPTLSAQSSQPPGNAHFSVYNQLSQSQVRERGPSASFPRERGLPQGCERKPPSPHLNAANEFLYSQTFSLSRESSLQYHSGMGTVENWTDG

SEQ ID NO: 57290 - protein, 371 aa, Homo sapiens
MSMSPKHTTPFSVSDILSPLEESYKKVGMEGGGLGAPLAAYRQGQAAPPTAAMQQHAVGHHGAVTAAYHMTAAGVPQLSHSAVGGYCNGNLGNMSELPPYQDTMRNSASGPGWYGANPDPRFPAISRFMGPASGMNMSGMGGLGSLGDVSKNMAPLPSAPRRKRRVLFSQAQVYELERRFKQQKYLSAPEREHLASMIHLTPTQVKIWFQNHRYKMKRQAKDKAAQQQLQQDSGGGGGGGGTGCPQQQQAQQQSPRRVAVPVLVKDGKPCQAGAPAPGAASLQGHAQQQAQHQAQAAQAAAAAISVGSGGAGLGAHPGHQPGSAGQSPDLAHHAASPAALQGQVSSLSHLNSSGSDYGTMSCSTLLYGRTW

SEQ ID NO: 57291 - DNA, 20 bp, Homo sapiens
gatcactgtcagtggaggga

SEQ ID NO: 57292 - DNA, 20 bp, Homo sapiens
gatcagcatgcgcatctcca

SEQ ID NO: 57293 - DNA, 20 bp, Homo sapiens
gatcggagagcctgctgtca

SEQ ID NO: 57294 - DNA, 20 bp, Homo sapiens
gatctcgctggaacaggtct

SEQ ID NO: 57295 - DNA, 20 bp, Homo sapiens
gatctgcatggtccattcct

SEQ ID NO: 57296 - DNA, 20 bp, Homo sapiens
gatcaaaaataaacctctta

SEQ ID NO: 57297 - DNA, 20 bp, Homo sapiens
gatctttgggccggatttcc

SEQ ID NO: 57298 - DNA, 20 bp, Homo sapiens
gatcagcacagggctggggg

SEQ ID NO: 57299 - DNA, 20 bp, Homo sapiens
gatcccatccatcagctccc

SEQ ID NO: 57300 - DNA, 20 bp, Homo sapiens
gatccccgtcccaccttctc

SEQ ID NO: 57301 - DNA, 20 bp, Homo sapiens
gatcccgacagccggaagga

SEQ ID NO: 57302 - DNA, 20 bp, Homo sapiens
gatcctcccacagagcctgc

SEQ ID NO: 57303 - DNA, 20 bp, Homo sapiens
gatcctccctgagatagggc

SEQ ID NO: 57304 - DNA, 20 bp, Homo sapiens
gatcctgggaggcctgggga

SEQ ID NO: 57305 - DNA, 20 bp, Homo sapiens
gatctcctccccgggctggg

SEQ ID NO: 57306 - DNA, 20 bp, Homo sapiens
gatctgtctgtgggcccctc

SEQ ID NO: 57307 - DNA, 20 bp, Homo sapiens
gatctgaccctcccagtctc

SEQ ID NO: 57308 - DNA, 20 bp, Homo sapiens
gatcgcactgaaagcagaca

SEQ ID NO: 57309 - DNA, 20 bp, Homo sapiens
gatcttctagtcatactgaa

SEQ ID NO: 57310 - DNA, 20 bp, Homo sapiens
gatctttcctcttaggacag

SEQ ID NO: 57311 - DNA, 20 bp, Homo sapiens
gatcaggtccaagcaaaacg

SEQ ID NO: 57312 - DNA, 20 bp, Homo sapiens
gatcctgaaaatcttgaaga

SEQ ID NO: 57313 - DNA, 20 bp, Homo sapiens
gatcagttattaaataatgt

SEQ ID NO: 57314 - DNA, 20 bp, Homo sapiens
gatcagggggtgtggtgaag

SEQ ID NO: 57315 - DNA, 20 bp, Homo sapiens
gatcccatccccttgtctga

SEQ ID NO: 57316 - DNA, 20 bp, Homo sapiens
gatcaatcagtgtgattagc

SEQ ID NO: 57317 - DNA, 20 bp, Homo sapiens
gatccatgcattgaatgtac

SEQ ID NO: 57318 - DNA, 20 bp, Homo sapiens
gatctgccggcctctcttgg

SEQ ID NO: 57319 - DNA, 20 bp, Homo sapiens
gatctgtgctgaccccaata

SEQ ID NO: 57320 - DNA, 20 bp, Homo sapiens
gatccaattaaaaaaaatta

SEQ ID NO: 57321 - DNA, 20 bp, Homo sapiens
gatctatcttcttccttaac

SEQ ID NO: 57322 - DNA, 20 bp, Homo sapiens
gatcagtgagcttttcatgg

SEQ ID NO: 57323 - DNA, 20 bp, Homo sapiens
gatccagaaaacaaaaagta

SEQ ID NO: 57324 - DNA, 20 bp, Homo sapiens
gatcaaatctcaatggtcgc

SEQ ID NO: 57325 - DNA, 20 bp, Homo sapiens
gatcggtaacaggatgcata

SEQ ID NO: 57326 - DNA, 20 bp, Homo sapiens
gatcgtcagccaccttgcct

SEQ ID NO: 57327 - DNA, 20 bp, Homo sapiens
gatcaaaatccaatgaaatt

SEQ ID NO: 57328 - DNA, 20 bp, Homo sapiens
gatctgtactttaataggaa

SEQ ID NO: 57329 - DNA, 20 bp, Homo sapiens
gatcagttagggtggggcag

SEQ ID NO: 57330 - DNA, 20 bp, Homo sapiens
gatcaagaaaaggaagtgac

SEQ ID NO: 57331 - DNA, 20 bp, Homo sapiens
gatctcatatgaatgcagtc

SEQ ID NO: 57332 - DNA, 20 bp, Homo sapiens
gatcagagctggcgcaaaga

SEQ ID NO: 57333 - DNA, 20 bp, Homo sapiens
gatcacgtccaccttcattg

SEQ ID NO: 57334 - DNA, 20 bp, Homo sapiens
gatctgaaggtacaggaagc

SEQ ID NO: 57335 - DNA, 20 bp, Homo sapiens
gatctttagcctctcctacc

SEQ ID NO: 57336 - DNA, 20 bp, Homo sapiens
gatctaacaagttacattgt

SEQ ID NO: 57337 - DNA, 20 bp, Homo sapiens
gatctaattaaaaaaaaggc

SEQ ID NO: 57338 - DNA, 20 bp, Homo sapiens
gatcaggggtattactcctg

SEQ ID NO: 57339 - DNA, 20 bp, Homo sapiens
gatcacaggaatggtctctt

SEQ ID NO: 57340 - DNA, 20 bp, Homo sapiens
gatcaaagtctcagaaacac

SEQ ID NO: 57341 - DNA, 20 bp, Homo sapiens
gatctttgtagactgttcct

SEQ ID NO: 57342 - DNA, 20 bp, Homo sapiens
gatctctgccttggcctatt

SEQ ID NO: 57343 - DNA, 20 bp, Homo sapiens
gatcatgagacattagggta

SEQ ID NO: 57344 - DNA, 20 bp, Homo sapiens
gatcctggataaacccattt

SEQ ID NO: 57345 - DNA, 20 bp, Homo sapiens
gatcttaacaaagcctttgc

SEQ ID NO: 57346 - DNA, 20 bp, Homo sapiens
gatcgatgccctcattaaag

SEQ ID NO: 57347 - DNA, 20 bp, Homo sapiens
gatcaggggggccgggctgg

SEQ ID NO: 57348 - DNA, 20 bp, Homo sapiens
gatcgtgaagacctgcttta

SEQ ID NO: 57349 - DNA, 20 bp, Homo sapiens
gatctcggcacaccgcaacc

SEQ ID NO: 57350 - DNA, 20 bp, Homo sapiens
gatcagggcctacctggagg

SEQ ID NO: 57351 - DNA, 20 bp, Homo sapiens
gatcataatgtacttgaaca

SEQ ID NO: 57352 - DNA, 20 bp, Homo sapiens
gatcttccttcaaaggatta

SEQ ID NO: 57353 - DNA, 20 bp, Homo sapiens
gatctggttccagaaccacc

SEQ ID NO: 57354 - DNA, 20 bp, Homo sapiens
gatccaaacccatcttcctg

SEQ ID NO: 57355 - DNA, 20 bp, Homo sapiens
gatccacttggtctgtgaga

SEQ ID NO: 57356 - DNA, 20 bp, Homo sapiens
gatccaggagtgccggggat

SEQ ID NO: 57357 - DNA, 20 bp, Homo sapiens
gatccagtctttgccatttg

SEQ ID NO: 57358 - DNA, 20 bp, Homo sapiens
gatcctccaaagtcacacag

SEQ ID NO: 57359 - DNA, 20 bp, Homo sapiens
gatcctccctgtcccatggc

SEQ ID NO: 57360 - DNA, 20 bp, Homo sapiens
gatcctgtctggccttcagt

SEQ ID NO: 57361 - DNA, 20 bp, Homo sapiens
gatccttctaccccaaggcc

SEQ ID NO: 57362 - DNA, 20 bp, Homo sapiens
gatctgttggtaggcaatgg

SEQ ID NO: 57363 - DNA, 20 bp, Homo sapiens
gatctcactgacctggcagc

SEQ ID NO: 57364 - DNA, 20 bp, Homo sapiens
gatctccaggagctatgtca

SEQ ID NO: 57365 - DNA, 20 bp, Homo sapiens
gatccagcctctgccacttg

SEQ ID NO: 57366 - DNA, 20 bp, Homo sapiens
gatcagcatcttggacttga

SEQ ID NO: 57367 - DNA, 20 bp, Homo sapiens
gatctgcagcatcacaaatt

SEQ ID NO: 57368 - DNA, 20 bp, Homo sapiens
gatcttatcaagagatgtgg

SEQ ID NO: 57369 - DNA, 20 bp, Homo sapiens
gatcagctctgtcctttgtc

SEQ ID NO: 57370 - DNA, 20 bp, Homo sapiens
gatccacatggagcgtgtga

SEQ ID NO: 57371 - DNA, 20 bp, Homo sapiens
gatccagaagggccctgcag

SEQ ID NO: 57372 - DNA, 20 bp, Homo sapiens
gatcctcggtgacgtcttct

SEQ ID NO: 57373 - DNA, 20 bp, Homo sapiens
gatctcctcagtgggtcctg

SEQ ID NO: 57374 - DNA, 20 bp, Homo sapiens
gatctgccagtaggcaggga

SEQ ID NO: 57375 - DNA, 20 bp, Homo sapiens
gatcgaaagaaaggagggca

SEQ ID NO: 57376 - DNA, 20 bp, Homo sapiens
gatctaagacatttaatagt

SEQ ID NO: 57377 - DNA, 20 bp, Homo sapiens
gatcatcagaattatcatat

SEQ ID NO: 57378 - DNA, 20 bp, Homo sapiens
gatcactgcctatgaggggg

SEQ ID NO: 57379 - DNA, 20 bp, Homo sapiens
gatccccttttgtttttgga

SEQ ID NO: 57380 - DNA, 20 bp, Homo sapiens
gatccatgctaatattgtat

SEQ ID NO: 57381 - DNA, 20 bp, Homo sapiens
gatcctttggaacatttacc

SEQ ID NO: 57382 - DNA, 20 bp, Homo sapiens
gatctgtggaatttaatgac

SEQ ID NO: 57383 - DNA, 20 bp, Homo sapiens
gatcaccaccctgaaggatg

SEQ ID NO: 57384 - DNA, 20 bp, Homo sapiens
gatctggagtctgaaaatct

SEQ ID NO: 57385 - DNA, 20 bp, Homo sapiens
gatcaagacatgagggaggc

SEQ ID NO: 57386 - DNA, 20 bp, Homo sapiens
gatcagggctgaaaagttcc

SEQ ID NO: 57387 - DNA, 20 bp, Homo sapiens
gatccccaactgctccagcc

SEQ ID NO: 57388 - DNA, 20 bp, Homo sapiens
gatctctgcagaagcggagc

SEQ ID NO: 57389 - DNA, 20 bp, Homo sapiens
gatctgcccgagctttcagc

SEQ ID NO: 57390 - DNA, 20 bp, Homo sapiens
gatcttcagcttctaaatgc

SEQ ID NO: 57391 - DNA, 20 bp, Homo sapiens
gatcaaatgccctaaaatgt

SEQ ID NO: 57392 - DNA, 20 bp, Homo sapiens
gatccataaagggaagaatg

SEQ ID NO: 57393 - DNA, 20 bp, Homo sapiens
gatccattaaagcttcttct

SEQ ID NO: 57394 - DNA, 20 bp, Homo sapiens
gatctataattggtagaaca

SEQ ID NO: 57395 - DNA, 20 bp, Homo sapiens
gatcccacggcctgccaggc

SEQ ID NO: 57396 - DNA, 20 bp, Homo sapiens
gatcagagccctgcagagcc

SEQ ID NO: 57397 - DNA, 20 bp, Homo sapiens
gatccaagccatgattccca

SEQ ID NO: 57398 - DNA, 20 bp, Homo sapiens
gatcctgtgtgtgaggccca

SEQ ID NO: 57399 - DNA, 20 bp, Homo sapiens
gatctctccgagcagcaatt

SEQ ID NO: 57400 - DNA, 20 bp, Homo sapiens
gatcaattgaccttgtgaca

SEQ ID NO: 57401 - DNA, 20 bp, Homo sapiens
gatccaccccctgcccacaa

SEQ ID NO: 57402 - DNA, 20 bp, Homo sapiens
gatccttgaggtcaggagtt

SEQ ID NO: 57403 - DNA, 20 bp, Homo sapiens
gatcttacaaagcacattct

SEQ ID NO: 57404 - DNA, 20 bp, Homo sapiens
gatcagcagctgctggtagt

SEQ ID NO: 57405 - DNA, 20 bp, Homo sapiens
gatcgcctacaagccagccc

SEQ ID NO: 57406 - DNA, 20 bp, Homo sapiens
gatctccacacagtcctctg

SEQ ID NO: 57407 - DNA, 20 bp, Homo sapiens
gatcttcaccaatggcaagt

SEQ ID NO: 57408 - DNA, 20 bp, Homo sapiens
gatctcaacaccatgttgtc

SEQ ID NO: 57409 - DNA, 20 bp, Homo sapiens
gatcttgcatggtggagggt

SEQ ID NO: 57410 - DNA, 20 bp, Homo sapiens
gatcaaagattcaaatggtt

SEQ ID NO: 57411 - DNA, 20 bp, Homo sapiens
gatcacacataaggaacata

SEQ ID NO: 57412 - DNA, 20 bp, Homo sapiens
gatctcaggaattacatttt

SEQ ID NO: 57413 - DNA, 20 bp, Homo sapiens
gatctgaagttggtccatgg

SEQ ID NO: 57414 - DNA, 20 bp, Homo sapiens
gatcccagagagaaatttgg

SEQ ID NO: 57415 - DNA, 20 bp, Homo sapiens
gatcactatttccgttcccc

SEQ ID NO: 57416 - DNA, 20 bp, Homo sapiens
gatcggcgttaaggtaacac

SEQ ID NO: 57417 - DNA, 2252 bp, Homo sapiens
agacgggcgggcgcacagccggcgcggaggccccacagccccgccgggacccgaggccaagcgaggggctgccagtgtcccgggacccaccgcgtccgccccagccccgggtccccgcgcccaccccatggcgacggacgcggcgctacgccggcttctgaggctgcaccgcacggagatcgcggtggccgtggacagcgccttcccactgctgcacgcgctggctgaccacgacgtggtccccgaggacaagtttcaggagacgcttcatctgaaggaaaaggagggctgcccccaggccttccacgccctcctgtcctggctgctgacccaggactccacagccatcctggacttctggagggtgctgttcaaggactacaacctggagcgctatggccggctgcagcccatcctggacagcttccccaaagatgtggacctcagccagccccggaaggggaggaagcccccggccgtccccaaggctttggtaccgccacccagactccccaccaagaggaaggcctcagaagaggctcgagctgccgcgccagcagccctgactccaaggggcaccgccagcccaggctctcaactgaaggccaagccccccaagaagccggagagcagcgcagagcagcagcgccttccactcgggaacgggattcagaccatgtcagcttcagtccagagagctgtggccatgtcctccggggacgtcccgggagcccgaggggccgtggaggggatcctcatccagcaggtgtttgagtcaggcggctccaagaagtgcatccaggttggtggggagttctacactcccagcaagttcgaagactccggcagtgggaagaacaaggcccgcagcagcagtggcccgaagcctctggttcgagccaagggagcccagggcgctgcccccggtggaggtgaggctaggctgggccagcagggcagcgttcccgcccctctggccctccccagtgacccccagctccaccagaagaatgaggacgagtgtgccgtgtgtcgggacggcggggagctcatctgctgtgacggctgccctcgggccttccacctggcctgcctgtcccctccgctccgggagatccccagtgggacctggaggtgctccagctgcctgcaggcaacagtccaggaggtgcagccccgggcagaggagccccggccccaggagccacccgtggagaccccgctccccccggggcttaggtcggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcagaacctggctcctggtgcgcgttgcggggtgtgcggagatggtacggacgtgctgcggtgtactcactgcgccgctgccttccactggcgctgccacttcccagccggcacctcccggcccgggacgggcctgcgctgcagatcctgctcaggagacgtgaccccagcccctgtggagggggtgctggcccccagccccgcccgcctggcccctgggcctgccaaggatgacactgccagtcacgagcccgctctgcacagggatgacctggagtcccttctgagcgagcacaccttcgatggcatcctgcagtgggccatccagagcatggcccgtccggcggcccccttcccctcctgaccccagatggccgggacatgcagctctgatgagagagtgctgagaaggacacctccttcctcagtcctggaagccggccggctgggatcaagaaggggacagcgccacctcttgtcagtgctcggctgtaaacagctctgtgtttctggggacaccagccatcatgtgcctggaaattaaaccctgccccacttctctactctggaagtccccgggagcctctccttgcctggtgacctactaaaaatataaaaattagctgggtgtggtggtgggtgcctgtaatcccagctacatgggagcctgaggcatgagaatcacttgaactcgggaggtggaggttgcagtgagctgagattgcgccactgcactccagtctggtcggcaagagtgagactccgtctcaaaaacaaaacaaaaaaaccacataacataaatttatcatctcgaccacttttcagttcagtggcattcacatctcatgtaa

SEQ ID NO: 57418 - DNA, 1545 bp, Homo sapiens
agagaaagtgaggtcttctcaggctcttaagagcatggcgtttggtccaggctgtacccgctgctctcagctgggcccgtgggtgggccgggcgcccctgctatagccaggaggtcaaggatccactgggaatgccatgctcatctttcgtccccagcatggtttcttaatggggtagaagcaggtcgggagagacctccctgggcctggccccactgccctgtgaggaagggttcatgtggttggtgtacagttccggggcccctggaacgcagcagcctgcaagaaaccgggttttcttcccaatagggatggccccggggggtgtctgttggagaccagatggatggggaacaggtggtcagggcagaatttcaggccctggcagcatgggagcagggcagagactggggagttcaggtacccagagatgctgctgggggagctgttttgggaaggaggtggctctcaggagggtgctgcaccccagcccagtctgcatgggcgtctcttgcctgtgccagaagaatgaggacgagtgtgccgtgtgtcgggacggcggggagctcatctgctgtgacggctgccctcgggccttccacctggcctgcctgtcccctccgctccgggagatccccagtgggacctggaggtgctccagctgcctgcaggcaacagtccaggaggtgcagccccgggcagaggagccccggccccaggagccacccgtggagaccccgctccccccggggcttaggtcggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcagaacctggctcctggtgcgcgttgcggggtgtgcggagatggtacggacgtgctgcggtgtactcactgcgccgctgccttccactggcgctgccacttcccagccggcacctcccggcccgggacgggcctgcgctgcagatcctgctcaggagacgtgaccccagcccctgtggagggggtgctggcccccagccccgcccgcctggcccctgggcctgccaaggatgacactgccagtcacgagcccgctctgcacagggatgacctggagtcccttctgagcgagcacaccttcgatggcatcctgcagtgggccatccagagcatggcccgtccggcggcccccttcccctcctgaccccagatggccgggacatgcagctctgatgagagagtgctgagaaggacacctccttcctcagtcctggaagccggccggctgggatcaagaaggggacagcgccacctcttgtcagtgctcggctgtaaacagctctgtgtttctggggacaccagccatcatgtgcctggaaattaaaccctgccccacttctctactctggaagtccccgggagcctctccttgcctggtgacctactaaaaatataaaaattagctg

SEQ ID NO: 57419 - DNA, 684 bp, Homo sapiens
cattcccagcctcacatcactcacaccttgcatttcacccctgcatcccagtcgccctgcagcctcacacagatcctgcacacacccagacagctggcgctcacacattcaccgttggcctgcctctgttcaccctccatggccctgctactggccctcagcctgctggttctctggacttccccagccccaactctgagtggcaccaatgatgctgaagactgctgcctgtctgtgacccagaaacccatccctgggtacatcgtgaggaacttccactaccttctcatcaaggatggctgcagggtgcctgctgtagtgttcaccacactgaggggccgccagctctgtgcacccccagaccagccctgggtagaacgcatcatccagagactgcagaggacctcagccaagatgaagcgccgcagcagttaacctatgaccgtgcagagggagcccggagtccgagtcaagcattgtgaattattacctaacctggggaaccgaggaccagaaggaaggaccaggcttccagctcctctgcaccagacctgaccagccaggacagggcctggggtgtgtgtgagtgtgagtgtgagcgagagggtgagtgtggtcagagtaaagctgctccacccccagattgcaatgctaccaataaagccgcctggtgtttacaactaa

SEQ ID NO: 57420 - DNA, 1377 bp, Homo sapiens
ctcctcccctcccagcctcaggtgcctgcttcagaaaatgaagtagtaagtctgctggcctccgccatcttagtaaagtaacagtcccatgaaacaaagatgcagtcgggcactcactggagagttctgggcctctgcctcttatcagttggcgtttgggggcaagatggtaatgaagaaatgggtggtattacacagacaccatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggacaaaacaaggagaggccaccacctgttcccaacccagactatgagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgcaagaaaaaaaaaaaaaaaaaaaaaa

SEQ ID NO: 57421 - DNA, 1930 bp, Homo sapiens
tgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttgaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgcaaaaaaaaaaaaaaaaaaaaaaaaaaaaaaaaaaaaaaaaaa

SEQ ID NO: 57422 - DNA, 1600 bp, Homo sapiens
tgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttgaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccactctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgcaaaaaaaaaaaaaaaaaaaaaaaaaaaaaaaaaaaaaaaaaa

SEQ ID NO: 57423 - DNA, 1861 bp, Homo sapiens
tgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttgaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgcaaaaaaaaaaaaaaaaaaaaaaaaaaaaaaaaaaaaaaaaaa

SEQ ID NO: 57424 - DNA, 2349 bp, Homo sapiens
tgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttggtgagttcctgcacatcaagggtccttgggcctgagatggtctctgtgtgatgtgactttacttgagttaccaaccctgcctgagcctcagtttcctcccctgtgaaatgagaacacggggtaactgcgatcattgcacttggtgttcacagtgggccaggcacacagtagacactcagttcaaccaatccgctgccttctgttctgagctctaaagctgctaattctcccagtctggaagagatggagccaggactcctgggttctcctggggatcagggagagtcttgggaagtagggagaggaatggtctctccccattccaagcggtccacccaacatggacagtcaaggaagggccctgattttcaagggcttgaaggctgggcagatatgggaatatggacaacctaatctgagcccagccctgaccagcctcccccaacagaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagaacttcctacagctgcagacttccaggagtaaccgcttctcctggatgggactttcagacctaaatcaggaaggcacgtggcaatgggtggacggctcacctctgtcacccagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgcaaaaaaaaaaaaa

SEQ ID NO: 57425 - DNA, 2265 bp, Homo sapiens
tgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagggtgtcttggccatggcgccctggtgctgcaactcctctccttcatgctcttggctggggtcctggtggccatccttgtccaagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttggtgagttcctgcacatcaagggtccttgggcctgagatggtctctgtgtgatgtgactttacttgagttaccaaccctgcctgagcctcagtttcctcccctgtgaaatgagaacacggggtaactgcgatcattgcacttggtgttcacagtgggccaggcacacagtagacactcagttcaaccaatccgctgccttctgttctgagctctaaagctgctaattctcccagtctggaagagatggagccaggactcctgggttctcctggggatcagggagagtcttgggaagtagggagaggaatggtctctccccattccaagcggtccacccaacatggacagtcaaggaagggccctgattttcaagggcttgaaggctgggcagatatgggaatatggacaacctaatctgagcccagccctgaccagcctcccccaacagaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgcaaaaaaaaaaaaaaaaaaaaaaaaaaaaaaaaaaaaaaaaaa

SEQ ID NO: 57426 - DNA, 2202 bp, Homo sapiens
tgaggatcagagggtggaaaataaaagctgtggtccccaggagtcctgaacatctggggacagcgggaaaacatgagtgactccaaggaaccaagggtgcagcagctgggcctcctggaagaagatccaacaaccagtggcatcagactttttccaagagactttcaattccagcagatacatggccacaagagctctacagttccttttcttcttggcccagtgtccaaggtccccagctccctaagtcaggaacaatccgagcaagacgcaatctaccagaacctgacccagcttaaagctgcagtgggtgagctctcagagaaatccaagctgcaggagatctaccaggagctgacccagctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacccggctgaaggctgcagtgggtgagttgccagagaaatccaagctgcaggagatctaccaggagctgacggagctgaaggctgcagtgggtgagttgccagagaaatccaagctgcaggagatctaccaggagctgacccagctgaaggctgcagtgggtgagttgccagaccagtccaagcagcagcaaatctatcaagaactgaccgatttgaagactgcatttggtgagttcctgcacatcaagggtccttgggcctgagatggtctctgtgtgatgtgactttacttgagttaccaaccctgcctgagcctcagtttcctcccctgtgaaatgagaacacggggtaactgcgatcattgcacttggtgttcacagtgggccaggcacacagtagacactcagttcaaccaatccgctgccttctgttctgagctctaaagctgctaattctcccagtctggaagagatggagccaggactcctgggttctcctggggatcagggagagtcttgggaagtagggagaggaatggtctctccccattccaagcggtccacccaacatggacagtcaaggaagggccctgattttcaagggcttgaaggctgggcagatatgggaatatggacaacctaatctgagcccagccctgaccagcctcccccaacagaacgcctgtgccgccactgtcccaaggactggacattcttccaaggaaactgttacttcatgtctaactcccagcggaactggcacgactccgtcaccgcctgccaggaagtgagggcccagctcgtcgtaatcaaaactgctgaggagcagcttccagcggtactggaacagtggagaacccaacaatagcgggaatgaagactgtgcggaatttagtggcagtggctggaacgacaatcgatgtgacgttgacaattactggatctgcaaaaagcccgcagcctgcttcagagacgaatagttgtttccctgctagcctcagcctccattgtggtatagcagaacttcacccacttgtaagccagcgcttcttctctccatccttggaccttcacaaatgccctgagacggttctctgttcgatttttcatcccctatgaacctgggtcttattctgtccttctgatgcctccaagtttccctggtgtagagcttgtgttcttggcccatccttggagctttataagtgacctgagtgggatgcatttagggggcgggcttggtatgttgtatgaatccactctctgttccttttggagattagactatttggattcatgtgtagctgccctgtcccctggggctttatctcatccatgcaaactaccatctgctcaacttccagctacaccccgtgcacccttttgactggggacttgctggttgaaggagctcatcttgcaggctggaagcaccagggaattaattcccccagtcaaccaatggcatccagagagggcatggaggctccatacaacctcttccacccccacatctttctttgtcctatacatgtcttccatttggctgtttctgagttgtagcctttataataaagtggtaaatgttgtaactgcaaaaaaaaaaaaaaaaaaaaaaaaaaaaaaaaaaaaaaaaaa

SEQ ID NO: 57427 - DNA, 8089 bp, Homo sapiens
tggttccggttcggctccagccgcccctcggctcctcgccttccccctcccgtccgccttctcccctccctcccgctcctgggaaagagagaaaccaccgctgcgggtgggtagagaagcacttggcgcctcggggaggggaccgcgcccgcctcatttgcgccttgcagcactgctggaccaggttacaagatgttcacctaagattgagacctagtgactacatttcctacgggaacaaataaatggtttttcatctcccggagatacattacaaacaaatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcaggtggttagctcaaccaatggagagctgaatgttgatgatcccacgggagcccactccaatgcaccaatcacagctcatgccgaggtggaggtagtggaggaagctaagtgctgctgtttctttaagaggaaaaggaagaagactgctcagcgccacaagtgaccagtgcctcccaggagtcctcaggccctggggactctgactcaattgtacctgcagctcctgccatttctcattggaagggactcctctttgggggagggtggatatccaaaccaaaaagaagaaaacagatgcccccagaaggggccagtgcgggcagccagggcctagtgggtcattggccatctccgcctgcctaaggctctgagcaggtcccagagctgctgttcctccactgcttgcccatagggctgcctggttgactctccttcccattgtttacagtgaaggtgtcattcacaaaaactcaaggactgctattctccttcttccccttagtttactcctggtttttaccccaccctcaaccctctccagcataaaacctagtgagctaaaggctttgtctgcagaaggagatcaagaggctgggggtaaggccaagaaggtaggaggaaaatggcagacctgggctggagaagaaccttctccgtatcccaggtgtgcctggcagtatggtttcctcttcctctgtgcctgtgcagcattcatcccagctggccttggggttcaggttccttcttccctccctcctgtgaagttacactgtaggacacaagctgtgagcaatctgcagtctactgtccctgtgtgttggcgttcttagcttttttgacaaactcttttctccaggtagtaggacaatgaaaattgttctaagcaaaggaaagaaaactgactttgttgcacttttagtttttttaaaaaaaacaaaaacaaaaacatggcagatgcatattgtgtctggttatattgggggttttacttttacctgttttgagggggatggggccggccaagccattcagagagaacatgggtccagaggacattctcagtggaaagagtttgatctgcagcacccagaagagaagccaaactcggtgtcattctgagtgaacactcaggttggcaagaaaacatacttgaattttcattcatcttctcagcagctgaagaatgtccctaccagagcatcttgacctaatcagcttacagtttgaaaacctagctctccagaacatgagatgagccagccgagccagactgtgaccaggaaacagctcatcccagagaaggagatgcttaacaaaaaaaaattgaaattgtttcccatgctgccagggacttccaactagatagccatgtgacgtcctggtgacttgggggaaaaattagtgatgaaacagccaccaccatattgccattagtggaaaaaaagaggacagtgaacctgccttccacctgccagagggacctcagggtgtggcattatagggccaggaaaagaaaatcggtgtatcctatctgccccaatagctgagctgtagcatttgggctggcctgccttatcagaaaccaagcttatgaagatcttctcccagcaggtccatagcagtaggcttaggatgcagtatatggggccgcatttaaaaggagggaaagattgtttggtgctggaacattccagggaaaaggagactggaatgaaaggtctgaaattatcttctcaattggactccttccagaaaggtggccgtgcctctaagcatgtttttcccagtatgccctaggcctccccccatggtgttttcatatgaggtactactgtgaaggatctggttcctcattcactgtttgacaagtctttcatgtgtggagttactcttctcatgcccaattttcatttgagtttagtggcttaaccaaacaatgactcctcattccagcggtgacagaagagaaagggtcatttacatcaggaaagaggtcttgtatctgggagtagagagctaaccatggagcacagtggctggtgggtgacttagtctgatggtttgtggaccatagaagtcttcacctctggtttgaggtgcagggctgtcttttgtactggagggtgtggggatattttctgatagttgccatttcttgaaaaattcccttgatgtaccttacacagagcagaaataacattaacatggatcagaggtactgggcttcatctgttccattggaccttggctagggaatatcatttcactggcatcaaacctgcttagcttatgaaaagatggtaatatgtcatttctataaatgtttctatatatgaaacataaagtggcagggagatacaatatcacaccccttccccacaaggactgtgaatattgggatttatgtccttgccattacctagtggttacagccctatcactaaaatttacatcgtttctcagttgggatttgggcattgctaacttactgtatagaaagtttaacttttcctcacccctgtatagaaaatgccttgcctctcaagagagggcagagggggggccaggtgcagtggctcacgcctgtaatcccagcagtttgggaggccaaggcaagtggatcatgtgaggtcaagagttcgagaccagcctggccaacatggtgaaaccccgtctctacaaaaaatacaaaaattagctgggcatggtggcatgctcccgtagtcccagctactcgggaggctgaggcaggagaatcacttgagcctgggaggcagaagttgcagtgagccgagatcgcaccactgcactccagcctgggcaacagagtgagactctgtctaaaaagaaaaaaaaaaaagggcagagggaaatggtgggaatgcctggagcatcctggcactctatactctactgagtgcctctcttcagcccctcaccctgcttccacacacacacacacaaaagcaaaggcactgaccagcttggctgcagggcaagctgccttgcagctggatttgcgactttttttttgtcttaaaatttttactggatcagttgtaggggactgtacttcctaagacactgttctcaccttccaacctcacaaatctcttactagatatttggtttttataacaagggtaaagaatcccaggtccctttagcatgcagagtaatggtgatccctccagagccattggcacttcaaagtggtcccagacctgggagattctggtgggatcttccttaaaaataagcaaaaaacctgagtaccctagatgcaattggccatttgtttcaggcccatcagcgaatcagggctccctcctcaaccctactgctacagttccttagctgtatgcctcagccagatccttggggttagggcatgcactcgctgactgtccccacccatccacttgctctgtagtttctgagctttctccatttcacaagtatggtgcctaacgatctttttctttaggattgatgcagttgtttttcctgaaagctaactcagcatctattcataaaaacccttaatagtatacattaggagttttcccaagctctacagtccctcagacattgcatcctaaacagatttgaggcacacaggccaagactccaccaaggcataaatggtcccccctactcccttttgaccagggtatcacttgtgtctctgcagtaagagttggtcaagttgctctacgcaccttggtgctttccagagatctcactccagactgcccccaagggtggatagagtatcctgacagccagtgtgcactcatgactgccttaattaacattcttctgctattatggagcctgtccagcaataaacagggtctaggaaggtacaagattagcttccagttaaaatcccattttatattggaatgcatgagctacagatgacagcagagatcctgaggtttctagacatgttgattgtctcttttttctaaatgaactccaagtacttagaaaacagtccctgtccatcagccagaaaaggtgaccatcacccctaaagtaatttccaaacttagttcagtgggaagatatgctggtagtgcatattcagtgttgattttcagtgctagtaaccacttttaatgccagaaatatgtaacaatgataatgtaacgtcaaagtggttactaaagattatagccttaacttttttatgtaaaagataaaatccattcctcctcccagtgagcaagcatggcttgcatttctcaaaaatgagaacttccatggcagccaagaaaacgtcttctcagaggaactttcgtttgatgcatctcccaagcccacatgcctcctgtgttccagccacctcttccatttcacatttaaaccagctctccattcccattgagttgccctaacaacattgtctccagtgtcagaaccatattaaggttcgtttctcagattgggagcctgcaacaccatacagccaacattgcctttgccacgccactgccaccatccccaccattgccctatggtgggcagatgaattccagaaaccctcagggagccaggataattaggcaacccatctgaattggccacgtaagtgacaggcacttatctctcgggttcttgcttttgcagactccagggaagtcctgtctagaggtcgatggcagagactcctagtctttcccatgaggggttgataggaatcaaattgggattcctttggctttgggttttgtttttttgttgttgtttttggttttcagtttgttttttggtgtatggggggtgattttgtttctgaataagaaaaagaagaggcaaccatggcccttatgtgggtttatcctttttgagcaatgttttagccacaagtaaggaatcttgaaagtcttttgtccagcaagcagtcttaaaaatgtttttcctaactccttttgcaggtgactaagtacaaaaaaatagttttctcattgtattcaaaatagtgagtaggttccctggataatacacagtggtagttgacatattttctcaaaacacaaccagaaaacccacttccggtatttgtaaatcacctttcaagggaaaaagtgaacacgtattccttgtatttctagtttgattaccaaacctgatgttacaaagaaacctccgttctgtagacagaatttcttttatttttcttcttttactcctcacaatcactttcccagtgccatcaccatctataaggtctcagagcagaggattattcatggtaataagtgggggtgtggtgcagccattccagtaacacccacaagaggacagctgttctgaatgtccccacccacccctctttcagtacaggtgagacattttcagttcatgagctccagaccaaatcccaggccagcccttgcaccaaaagccttttttagaaggcttatcagtctattaggaatgtctcaggaaagatgagccatttctttggggagaaatatatttacagatggaagtgtgtgactgcgtgtctgtgtgtgtgtgtggtgtgtgtgcgcacgtgagtgcgtgtgttcatctatgtgcatttcacttccataaagacccagcccaagctgctgggaaccatgtgttcctgagtattctcagaggttaaacaagtgacaagtgagcttctgaaattagtgtctcagcaagctggctttaggaatgagccccattttatcaagcagagaaaaaaaataacagcagaaaagataaagataaaccaaaaatatataccccccaatggaaaataatgttgattcagcaattcccataggatgtattacatgctctaatttattatattattatttatctgtctttgatctttgcccattgtactcttaaaaagatgttgggatgttgattgcgatttttaaacaactagataatgtataaatcagcagtggaaatcagttttaatgtgtggatgtgtctgattattgttaaatgcctctttttttactttttttttttttagatgtataatgtttcataaaccctggcactggtcacaaagctcagctgtgaaaatgaaatttgtagtatttttaaacatgaatgtcaatttcaagtgtatttgaaatggttcctccaggagagatatttgtgcaccattaggaaaatcttctctgcagaggaagtagccttctttggagaaaatggaaaatgggttctgatatgtgatctcagagtagcccatttcctagggcaccatggaaaacacaaatgtgatctttaagtatacctcttccccagtttggggaggaaaggactcagtttgcaccctttttgtatgtaaaataaaatgtcttacctttcttggctacttctgcttgtttggttggttgattggtttgtctgtttttaatctccctcggctcatttgtaattaacaatctagctaggactaactttgatgcgattcaagactcctgtgaacaaaaataatttggcattcttgtttcattccttggattaaatattgtcttctcctgtgagtcacttcaaaaataaatactgctgtctctcttcgagtgctg

SEQ ID NO: 57428 - DNA, 8060 bp, Homo sapiens
aatatggtgctaaaagaactccttacctttctctgactacaatttatttggacatacttttgtattgaagagaggtatacatactgaagctacttgctgtactataggagactctgtcctgtaggatcatggaccatcctagtagggaaaaggatgaaagacaacggacaactaaacccatggcacaaaggagtgcacactgctctcgaccatctggctcctcatcgtcctctggggttcttatggtgggacccaacttcagggttggcaagaagataggatgtgggaacttcggagagctcagattaggtaaaaatctctacaccaatgaatatgtagcaatcaaactggaaccaataaaatcacgtgctccacagcttcatttagagtacagattttataaacagcttggcagtgcaggtgaaggtctcccacaggtgtattactttggaccatgtgggaaatataatgccatggtgctggagctccttggccctagcttggaggacttgtttgacctctgtgaccgaacatttactttgaagacggtgttaatgatagccatccagctgctttctcgaatggaatacgtgcactcaaagaacctcatttaccgagatgtcaagccagagaacttcctgattggtcgacaaggcaataagaaagagcatgttatacacattatagactttggactggccaaggaatacattgaccccgaaaccaaaaaacacataccttatagggaacacaaaagtttaactggaactgcaagatatatgtctatcaacacgcatcttggcaaagagcaaagccggagagatgatttggaagccctaggccatatgttcatgtatttccttcgaggcagcctcccctggcaaggactcaaggctgacacattaaaagagagatatcaaaaaattggtgacaccaaaaggaatactcccattgaagctctctgtgagaactttccagaggagatggcaacctaccttcgatatgtcaggcgactggacttctttgaaaaacctgattatgagtatttacggaccctcttcacagacctctttgaaaagaaaggctacacctttgactatgcctatgattgggttgggagacctattcctactccagtagggtcagttcacgtagattctggtgcatctgcaataactcgagaaagccacacacatagggatcggccatcacaacagcagcctcttcgaaatcagagccttaggactgttacagctgagcattatgatgttaacaactcagccatctggcacaggggaagaggcacctaaacagattcttctggacaaaagtcacatatgagcaagatcagaatagtagcagatgtaaaaagcagaatgtatcatcagagcgccgaggagagtgggaaattcagcccagccggcagaccaatacctcatacctaacgtctcacttggctgcagaccgccatgggggatcagtgcaggtggttagctcaaccaatggagagctgaatgttgatgatcccacgggagcccactccaatgcaccaatcacagctcatgccgaggtggaggtagtggaggaagctaagtgctgctgtttctttaagaggaaaaggaagaagactgctcagcgccacaagtgaccagtgcctcccaggagtcctcaggccctggggactctgactcaattgtacctgcagctcctgccatttctcattggaagggactcctctttgggggagggtggatatccaaaccaaaaagaagaaaacagatgcccccagaaggggccagtgcgggcagccagggcctagtgggtcattggccatctccgcctgcctaaggctctgagcaggtcccagagctgctgttcctccactgcttgcccatagggctgcctggttgactctccttcccattgtttacagtgaaggtgtcattcacaaaaactcaaggactgctattctccttcttccccttagtttactcctggtttttaccccaccctcaaccctctccagcataaaacctagtgagctaaaggctttgtctgcagaaggagatcaagaggctgggggtaaggccaagaaggtaggaggaaaatggcagacctgggctggagaagaaccttctccgtatcccaggtgtgcctggcagtatggtttcctcttcctctgtgcctgtgcagcattcatcccagctggccttggggttcaggttccttcttccctccctcctgtgaagttacactgtaggacacaagctgtgagcaatctgcagtctactgtccctgtgtgttggcgttcttagcttttttgacaaactcttttctccaggtagtaggacaatgaaaattgttctaagcaaaggaaagaaaactgactttgttgcacttttagtttttttaaaaaaaacaaaaacaaaaacatggcagatgcatattgtgtctggttatattgggggttttacttttacctgttttgagggggatggggccggccaagccattcagagagaacatgggtccagaggacattctcagtggaaagagtttgatctgcagcacccagaagagaagccaaactcggtgtcattctgagtgaacactcaggttggcaagaaaacatacttgaattttcattcatcttctcagcagctgaagaatgtccctaccagagcatcttgacctaatcagcttacagtttgaaaacctagctctccagaacatgagatgagccagccgagccagactgtgaccaggaaacagctcatcccagagaaggagatgcttaacaaaaaaaaattgaaattgtttcccatgctgccagggacttccaactagatagccatgtgacgtcctggtgacttgggggaaaaattagtgatgaaacagccaccaccatattgccattagtggaaaaaaagaggacagtgaacctgccttccacctgccagagggacctcagggtgtggcattatagggccaggaaaagaaaatcggtgtatcctatctgccccaatagctgagctgtagcatttgggctggcctgccttatcagaaaccaagcttatgaagatcttctcccagcaggtccatagcagtaggcttaggatgcagtatatggggccgcatttaaaaggagggaaagattgtttggtgctggaacattccagggaaaaggagactggaatgaaaggtctgaaattatcttctcaattggactccttccagaaaggtggccgtgcctctaagcatgtttttcccagtatgccctaggcctccccccatggtgttttcatatgaggtactactgtgaaggatctggttcctcattcactgtttgacaagtctttcatgtgtggagttactcttctcatgcccaattttcatttgagtttagtggcttaaccaaacaatgactcctcattccagcggtgacagaagagaaagggtcatttacatcaggaaagaggtcttgtatctgggagtagagagctaaccatggagcacagtggctggtgggtgacttagtctgatggtttgtggaccatagaagtcttcacctctggtttgaggtgcagggctgtcttttgtactggagggtgtggggatattttctgatagttgccatttcttgaaaaattcccttgatgtaccttacacagagcagaaataacattaacatggatcagaggtactgggcttcatctgttccattggaccttggctagggaatatcatttcactggcatcaaacctgcttagcttatgaaaagatggtaatatgtcatttctataaatgtttctatatatgaaacataaagtggcagggagatacaatatcacaccccttccccacaaggactgtgaatattgggatttatgtccttgccattacctagtggttacagccctatcactaaaatttacatcgtttctcagttgggatttgggcattgctaacttactgtatagaaagtttaacttttcctcacccctgtatagaaaatgccttgcctctcaagagagggcagagggggggccaggtgcagtggctcacgcctgtaatcccagcagtttgggaggccaaggcaagtggatcatgtgaggtcaagagttcgagaccagcctggccaacatggtgaaaccccgtctctacaaaaaatacaaaaattagctgggcatggtggcatgctcccgtagtcccagctactcgggaggctgaggcaggagaatcacttgagcctgggaggcagaagttgcagtgagccgagatcgcaccactgcactccagcctgggcaacagagtgagactctgtctaaaaagaaaaaaaaaaaagggcagagggaaatggtgggaatgcctggagcatcctggcactctatactctactgagtgcctctcttcagcccctcaccctgcttccacacacacacacacaaaagcaaaggcactgaccagcttggctgcagggcaagctgccttgcagctggatttgcgactttttttttgtcttaaaatttttactggatcagttgtaggggactgtacttcctaagacactgttctcaccttccaacctcacaaatctcttactagatatttggtttttataacaagggtaaagaatcccaggtccctttagcatgcagagtaatggtgatccctccagagccattggcacttcaaagtggtcccagacctgggagattctggtgggatcttccttaaaaataagcaaaaaacctgagtaccctagatgcaattggccatttgtttcaggcccatcagcgaatcagggctccctcctcaaccctactgctacagttccttagctgtatgcctcagccagatccttggggttagggcatgcactcgctgactgtccccacccatccacttgctctgtagtttctgagctttctccatttcacaagtatggtgcctaacgatctttttctttaggattgatgcagttgtttttcctgaaagctaactcagcatctattcataaaaacccttaatagtatacattaggagttttcccaagctctacagtccctcagacattgcatcctaaacagatttgaggcacacaggccaagactccaccaaggcataaatggtcccccctactcccttttgaccagggtatcacttgtgtctctgcagtaagagttggtcaagttgctctacgcaccttggtgctttccagagatctcactccagactgcccccaagggtggatagagtatcctgacagccagtgtgcactcatgactgccttaattaacattcttctgctattatggagcctgtccagcaataaacagggtctaggaaggtacaagattagcttccagttaaaatcccattttatattggaatgcatgagctacagatgacagcagagatcctgaggtttctagacatgttgattgtctcttttttctaaatgaactccaagtacttagaaaacagtccctgtccatcagccagaaaaggtgaccatcacccctaaagtaatttccaaacttagttcagtgggaagatatgctggtagtgcatattcagtgttgattttcagtgctagtaaccacttttaatgccagaaatatgtaacaatgataatgtaacgtcaaagtggttactaaagattatagccttaacttttttatgtaaaagataaaatccattcctcctcccagtgagcaagcatggcttgcatttctcaaaaatgagaacttccatggcagccaagaaaacgtcttctcagaggaactttcgtttgatgcatctcccaagcccacatgcctcctgtgttccagccacctcttccatttcacatttaaaccagctctccattcccattgagttgccctaacaacattgtctccagtgtcagaaccatattaaggttcgtttctcagattgggagcctgcaacaccatacagccaacattgcctttgccacgccactgccaccatccccaccattgccctatggtgggcagatgaattccagaaaccctcagggagccaggataattaggcaacccatctgaattggccacgtaagtgacaggcacttatctctcgggttcttgcttttgcagactccagggaagtcctgtctagaggtcgatggcagagactcctagtctttcccatgaggggttgataggaatcaaattgggattcctttggctttgggttttgtttttttgttgttgtttttggttttcagtttgttttttggtgtatggggggtgattttgtttctgaataagaaaaagaagaggcaaccatggcccttatgtgggtttatcctttttgagcaatgttttagccacaagtaaggaatcttgaaagtcttttgtccagcaagcagtcttaaaaatgtttttcctaactccttttgcaggtgactaagtacaaaaaaatagttttctcattgtattcaaaatagtgagtaggttccctggataatacacagtggtagttgacatattttctcaaaacacaaccagaaaacccacttccggtatttgtaaatcacctttcaagggaaaaagtgaacacgtattccttgtatttctagtttgattaccaaacctgatgttacaaagaaacctccgttctgtagacagaatttcttttatttttcttcttttactcctcacaatcactttcccagtgccatcaccatctataaggtctcagagcagaggattattcatggtaataagtgggggtgtggtgcagccattccagtaacacccacaagaggacagctgttctgaatgtccccacccacccctctttcagtacaggtgagacattttcagttcatgagctccagaccaaatcccaggccagcccttgcaccaaaagccttttttagaaggcttatcagtctattaggaatgtctcaggaaagatgagccatttctttggggagaaatatatttacagatggaagtgtgtgactgcgtgtctgtgtgtgtgtgtggtgtgtgtgcgcacgtgagtgcgtgtgttcatctatgtgcatttcacttccataaagacccagcccaagctgctgggaaccatgtgttcctgagtattctcagaggttaaacaagtgacaagtgagcttctgaaattagtgtctcagcaagctggctttaggaatgagccccattttatcaagcagagaaaaaaaataacagcagaaaagataaagataaaccaaaaatatataccccccaatggaaaataatgttgattcagcaattcccataggatgtattacatgctctaatttattatattattatttatctgtctttgatctttgcccattgtactcttaaaaagatgttgggatgttgattgcgatttttaaacaactagataatgtataaatcagcagtggaaatcagttttaatgtgtggatgtgtctgattattgttaaatgcctctttttttactttttttttttttagatgtataatgtttcataaaccctggcactggtcacaaagctcagctgtgaaaatgaaatttgtagtatttttaaacatgaatgtcaatttcaagtgtatttgaaatggttcctccaggagagatatttgtgcaccattaggaaaatcttctctgcagaggaagtagccttctttggagaaaatggaaaatgggttctgatatgtgatctcagagtagcccatttcctagggcaccatggaaaacacaaatgtgatctttaagtatacctcttccccagtttggggaggaaaggactcagtttgcaccctttttgtatgtaaaataaaatgtcttacctttcttggctacttctgcttgtttggttggttgattggtttgtctgtttttaatctccctcggctcatttgtaattaacaatctagctaggactaactttgatgcgattcaagactcctgtgaacaaaaataatttggcattcttgtttcattccttggattaaatattgtcttctcctgtgagtcacttcaaaaataaatactgctgtctctcttcgagtgctg

SEQ ID NO: 57429 - DNA, 1878 bp, Homo sapiens
gccttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatatatatatatatatatatatatatatatatatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgttttaaaaaaaaaaa

SEQ ID NO: 57430 - DNA, 1988 bp, Homo sapiens
gccttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacttcctcctctggatccttgcagcagttagttcggggttgtttttttatagctttctcctcacagctgtttctttgagcaaaatgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatatatatatatatatatatatatatatatatatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgttttaaaaaaaaaaa

SEQ ID NO: 57431 - DNA, 2427 bp, Homo sapiens
gagagaaggacggagtcgagtggcaccctagaagacgctctgtgccttcggaggtctttctgcctgcctgtcctcatgcctctcctcctcttgctgctcctgctgccaagccccttacacccccaccccatctgtgaggtctccaaagtggccagccacctagaagtgaactgtgacaagaggaatctgacagcgctgcctccagacctgccgaaagacacaaccatcctccacctgagtgagaacctcctgtacaccttctccctggcaaccctgatgccttacactcgcctcactcagctgaacctagataggtgcgagctcaccaagctccaggtcgatgggacgctgccagtgctggggaccctggatctatcccacaatcagctgcaaagcctgcccttgctagggcagacactgcctgctctcaccgtcctggacgtctccttcaaccggctgacctcgctgcctcttggtgccctgcgtggtcttggcgaactccaagagctctacctgaaaggcaatgagctgaagaccctgcccccagggctcctgacgcccacacccaagctggagaagctcagtctggctaacaacaacttgactgagctccccgctgggctcctgaatgggctggagaatctcgacacccttctcctccaagagaactcgctgtatacaataccaaagggcttttttgggtcccacctcctgccttttgcttttctccacgggaacccctggttatgcaactgtgagatcctctattttcgtcgctggctgcaggacaatgctgaaaatgtctacgtatggaagcaaggtgtggacgtcaaggccatgacctctaacgtggccagtgtgcagtgtgacaattcagacaagtttcccgtctacaaatacccaggaaaggggtgccccacccttggtgatgaaggtgacacagacctatatgattactacccagaagaggacactgagggcgataaggtgcgtgccacaaggactgtggtcaagttccccaccaaagcccatacaaccccctggggtctattctactcatggtccactgcttctctagacagccaaatgccctcctccttgcatccaacacaagaatccactaaggagcagaccacattcccacctagatggaccccaaatttcacacttcacatggaatccatcacattctccaaaactccaaaatccactactgaaccaaccccaagcccgaccacctcagagcccgtcccggagcccgccccaaacatgaccaccctggagcccactccaagcccgaccaccccagagcccacctcagagcccgcccccagcccgaccaccccggagcccaccccaatcccgaccatcgccacaagcccgaccatcctggtgtctgccacaagcctgatcactccaaaaagcacatttttaactaccacaaaacccgtatcactcttagaatccaccaaaaaaaccatccctgaacttgatcagccaccaaagctccgtggggtgctccaagggcatttggagagctccagaaatgacccttttctccaccccgacttttgctgcctcctccccctgggcttctatgtcttgggtctcttctggctgctctttgcctctgtggtcctcatcctgctgctgagctgggttgggcatgtgaaaccacaggccctggactctggccaaggtgctgctctgaccacagccacacaaaccacacacctggagctgcagaggggacggcaagtgacagtgccccgggcctggctgctcttccttcgaggttcgcttcccactttccgctccagcctcttcctgtgggtacggcctaatggccgtgtggggcctctagtggcaggaaggaggccctcagctctgagtcagggtcgtggtcaggacctgctgagcacagtgagcattaggtactctggccacagcctctgagggtgggaggtttggggaccttgagagaagagcctgtgggctctcctattggaatctagttgggggttggaggggtaaggaacacagggtgataggggaggggtcttagttcctttttctgtatcagaagccctgtcttcacaacacaggcacacaatttcagtcccagccaaagcagaaggggtaatgacatggacttggcggggggacaagacaaagctcccgatgctgcatggggcgctgccagatctcacggtgaaccattttggcagaatacagcatggttcccacatgcatctatgcacagaagaaaatctggaaagtgatttatcaggatgtgagcactcgttgtgtctggatgttacaaatatgggtggttttattttctttttccctgtttagcattttctagttttccactattattgtatattatctgtataataaaaaataattttagggttgggaaaa

SEQ ID NO: 57432 - DNA, 555 bp, Homo sapiens
gaagaagaagatagttttttttttcgtctgggctgccaacatgccatccagactgaggaagacccggaaacttaggggccacgtgagccaccgccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatctggctactacaaagttctgggaaagggaaagctccccaagcaggctgtcaccgtgcaggccaaattcttcagcagaagagctgaggagaagattaagagtgttgggggggcctgtgtcctggtggcttgaagccgcatggagggagtttcattaaatgctaactacttaaaaaaaaaaaaagaagaagaagaagaaga

SEQ ID NO: 57433 - DNA, 555 bp, Homo sapiens
gaagaagaagatagttttttttttcgtctgggctgccaacatgccatccagactgaggaagacccggaaacttaggggccacgtgagccaccgccacggccgcataggcaagcaccggaagcaccccggcggccgcggtaatgctggtggtctgcatcaccaccggatcaacttcgacaaataccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatctggctactacaaagttctgggaaagggaaagctccccaagcaggctgtcaccgtgcaggccaaattcttcagcagaagagctgaggagaagattaagagtgttgggggggcctgtgtcctggtggcttgaagccgcatggagggagtttcattaaatgctaactacttaaaaaaaaaagaagaagaagaagaagaaga

SEQ ID NO: 57434 - DNA, 396 bp, Homo sapiens
tcccactcaggacacagcatggacatgagggtccccgctcagctcctggggctcctgctgctctggttcccaggtgccagatgtaacatccagatgacccagtctccatctgccatgtctgcatctgtaggagacagagtcaccatcacttgtcgggcgaggcagggcattagcaattatttagcctggtttcagcagaaaccagggaaagtccctaagcacctgatctatgctgcatccagtttgcaaagtggggtcccatcaaggttcagcggcagtggatctgggacagaattcactctcacaatcagcagcctgcagcctgaagattttgcaacttattactgtctacagcataatagttaccctcccacagtgttacacacccgaacataa

SEQ ID NO: 57435 - DNA, 666 bp, Homo sapiens
atgagtgtggcaatgcagagactctatatagggaaatgtaaagacaatgggagaaaaaattcaaggacagtagagcaactggaagcttctgacaccaacagcttgatgaacggggtcactcaacccttggtggacacagagtcacttctcttagggaaattgcagtattctcaggtgacaatatgcaaacatgatgaatgtacacttgctacgtctccaattctatatgtctgcgccctgagagcatcacccaataaccacacacgtcctctagagaagcccctgagagcacagctcctcaccatgggctggacttggaggatcctgtttttggtggtcatagctgcaggtgcccagtcccaggtacagctgatgcagtctggggctgaggtgaagaagcctggggcctcagtgaggatctcctgcaaggcttctggatacaccttcaccagctactgtatgcactgggtgtgccaggcccatgcacaagggcttgagtggatgggattggtgtgccctagtgatggcagcacaagctatgcacagaagttccagggcagagtcaccataaccagggacacatccatgggcacagcctacatggagctaagcagcctgagatctgaggacacggccatgtattactgtgtgagagacacaatgtga

SEQ ID NO: 57436 - DNA, 1215 bp, Homo sapiens
atgggtgttctgaactacaataaacactggatggatccaggattgtttgaagtcactgtcattattacattcagctgttgtttcaatgtgtctgaagtagtaaatgacaatttagatggcctggggaaatgctttctgagagtcatggatctcatgtgcaagaaaatgaagcacctgtggttcttcctcctgctggtggcggctcccagatgggtcctgtcccagctgcagctgcaggagtcgggcccaggactggtgaagccttcggagaccctgtccctcacctgcgctgtctctggttactccatcagcagtggttactactggggctggatccggcagcccccagggaaggggctggagtggattgggagtatctatcatagtgggagcacctactacaacccgtccctcaagagtcgagtcaccatatcagtagacacgtccaagaaccagttctccctgaagctgagctctgtgaccgccgcagacacggccgtgtattactgtgcgagagacacagtgaggggaggtgagtgtgagcccagacaaaaacctccctgcagggaggctgagggggcgggcgcaggtccaaggactttctttggggggctattgaaaaacacttttgaatggaaaatcctaaagcatacaacagctgaaagaatggcccctgtgcacatgaaggctgaagggatggatgataggaagtcctctgtgaagttaactagtggagtcagacaggaaaatactacagaccaagaattctcagactgttctgcaaagcccctggattcactgaaaaaagaacaagtttggtccagcaggattcatggcaaggggggcgctcaggacactagggggctcagaaccactagggggcgcccaggaccaccaggtctctcaagacaggagggcgcactcaggacactagggggcgctcagaaccatcagggggcaatcaggacaccagagggacttcagaaccaccagggggcgctgagaaccaccagggggtgctcaggacatgaccggccctcaggaccaccaggggatgttcagaacaccaggaagcactcaggacaccagagagcgatcagaacaccagggggcactcagatcctccagggggcactcaggacaacagggagctctcaggacaccagggtgagctcagtaaaccagtgttcgctcagaaccaccagggagcactga

SEQ ID NO: 57437 - DNA, 387 bp, Homo sapiens
atggggtcaaccgccatcctcgccctcctcctggctgttctccaaggagtctgtgccgaggtgcagctggtgcagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacacacagtgagagaaaccagccccgagcccgtctaa

SEQ ID NO: 57438 - DNA, 1143 bp, Homo sapiens
atggagtttgggctgagctgggttttccttgttgctattttaaaaggtgtccagtgtgaggtgcagctggtggagtccgggggaggcttagttcagcctggggggtccctgagactctcctgtgcagcctctggattcaccttcagtagctactggatgcactgggtccgccaagctccagggaaggggctggtgtgggtctcacgtattaatagtgatgggagtagcacaagctacgcggactccgtgaagggccgattcaccatctccagagacaacgccaagaacacgctgtatctgcaaatgaacagtctgagagccgaggacacggctgtgtattactgtgcaagagacacagaaccagacatacaacttggcatctcagaagaagatctccaagatttcctttacctggacttcatgggcagcacaggaccagcaggagatgctcagaactcacccaaggcagaaccccagggaagagcaggacaccctcatctactctgtgcacagccttctcgtcaggcgtcccagcccagaccttgctatgtagcagaagacatgcaaataagacccccctttttgctgatgaaaagcagcccagccctgaccctgcagctctgggagaggagctccagccttgggattcccagctgtctccactcggtgatcggcactgaatacaggagactcaccatggagtttgggctgagctgggttttccttgttgctattttaaaaggtgtccagtgtgaggtgcagctggtggagtccgggggaggcttggtccagcctggggggtccctgaaactctcctgtgcagcctctgggttcaccttcagtggctctgctatgcactgggtccgccaggcttccgggaaagggctggagtgggttggccgtattagaagcaaagctaacagttacgcgacagcatatgctgcgtcggtgaaaggcaggttcaccatctccagagatgattcaaagaacacggcgtatctgcaaatgaacagcctgaaaaccgaggacacggccgtgtattactgtactagacacacagtgaggggaggtcagtgtgagcccggacacaaacctccctgcaggggcgcgcggggctaccagggggcgctcgggactcactga

SEQ ID NO: 57439 - DNA, 1536 bp, Homo sapiens
gggactgagcatggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgtcctgcacagcccgacctccccggagcctcccgacaccacctccccggagtctcccgacaccacctccccggagtctcccgacaccacctccccggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacgtatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgttcacagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgat

SEQ ID NO: 57440 - DNA, 1608 bp, Homo sapiens
gggactgagcatggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgtcctgcacagcccgacctccccggagcctcccgacaccacctccccggagtctcccgacaccacctccccggagtctcccgacaccacctccccggagtctcccgacaccacctcccaggagcctcccgacaccacctcccaggagcctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacgtatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgttcacagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgat

SEQ ID NO: 57441 - DNA, 1275 bp, Homo sapiens
gggactgagcatggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgcgtccaaacctgcgggtgaccagctgcccgcggctctgtggaccagcagtgcggtgctgggactgctgctcctggccttgcccacgtatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgttcacagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgat

SEQ ID NO: 57442 - DNA, 988 bp, Homo sapiens
gacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccagagactctgctcctatcctccccaccttccccctaactgagcagcagtcctgagggccctgcctcccagtccctccttgttccagatgtggcaaaatctggcaaaggcagagaccaaacttcatacctcaaactctggggggcggcgggagctgagcgagttgtctacacgatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctcacttcttttctctgcaaaaggtgcttgtggggctgggagtgcagacattggtgtttctgctgatgtcccttgtgaaaaaaaaa

SEQ ID NO: 57443 - DNA, 2672 bp, Homo sapiens
cttccagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcaccatgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactcccctaagtctctgctcaaaaaaaaaacaattctcggcccaaagaaaacaatcagaagaattcactgatttgactagaaacatcaaggaagaatgaagaacgttgacttttttccaggataaattatctctgatgcttctttagatttaagagttcataattccatccactgctgagaaatctcctcaaacccagaaggtttaatcacttcatcccaaaaatgggattgtgaatgtcagcaaaccataaaaaaagtgcttagaagtattcctatagaaatgtaaatgcaaggtcacacatattaatgacagcctgttgtattaatgatggctccaggtcagtgtctggagtttcattccatcccagggcttggatgtaaggattataccaagagtcttgctaccaggagggcaagaagaccaaaacagacagacaagtccagcagaagcagatgcacctgacaaaaatggatgtattaattggctctataaactatgtgcccagcactatgctgagcttacactaattggtcagacgtgctgtctgccctcatgaaattggctccaaatgaatgaactactttcatgagcagttgtagcaggcctgaccacagattcccagagggccaggtgtggatccacaggacttgaaggtcaaagttcacaaagatgaagaatcagggtagctgaccatgtttggcagatactataatggagacacagaagtgtgcatggcccaaggacaaggacctccagccaggcttcatttatgcacttgtgctgcaaaagaaaagtctaggttttaaggctgtgccagaacccatcccaataaagagaccgagtctgaagtcacattgtaaatctagtgtaggagacttggagtcaggcagtgagactggtggggcacggggggcagtgggtacttgtaaacctttaaagatggttaattcattcaatagatatttattaagaacctatgcggcccggcatggtggctcacacctgtaatcccagcactttgggaggccaaggtgggtgggtcatctgaggtcaggagttcaagaccagcctggccaacatggtgaaaccccatctctactaaagatacaaaaatttgctgagcgtggtggtgtgcacctgtaatcccagctactcgagaggccaaggcatgagaatcgcttgaacctgggaggtggaggttgcagtgagctgagatggcaccactgcactccggcctaggcaacgagagcaaaactccaatacaaacaaacaaacaaacacctgtgctaggtcagtctggcacgtaagatgaacatccctaccaacacagagctcaccatctcttatacttaagtgaaaaacatggggaaggggaaaggggaatggctgcttttgatatgttccctgacacatatcttgaatggagacctccctaccaagtgatgaaagtgttgaaaaacttaataacaaatgcttgttgggcaagaatgggattgaggattatcttctctcagaaaggcattgtgaaggaattgagccagatctctctccctactgcaaaaccctattgtagtaaaaaagtcttctttactatcttaataaaacagatattgtgagattcaaaaaaaaaaaaaaaa
